United States Patent 12,747,451 (RNA ENCODING AN ANTIBODY) - sequence listing, part 7

SEQ ID NO: 34152 - RNA, 399 nt, synthetic construct
  misc_feature 1..399: note = derived and/or modified sequence opt4 from anti-HIV-1_HeavyChain
  source 1..399: mol_type = other RNA
caggtgcagctggtgcagagcggcaccgaggtgaagaagcccggcgccagcctgagagtgagctgcagagccagcgaggacctgttcggcgacaagatcatctacgacgacgaggtgatccactggctgagacagctgcccggccagagacccgagtggatgggctggatcagacccaagagcggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 34153 - RNA, 399 nt, synthetic construct
  misc_feature 1..399: note = derived and/or modified sequence opt4 from anti-HIV-1_HeavyChain
  source 1..399: mol_type = other RNA
caggcccacctggagcagagcggcagcggcgtgaagaagcccggcgccagcgtgagagtgagctgcagagccagcgaggacctgttcggcgacgagatcatctacgacgacgaggtgatccactggctgagacaggtgcccggccagagacccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 34154 - RNA, 399 nt, synthetic construct
  misc_feature 1..399: note = derived and/or modified sequence opt4 from anti-HIV-1_HeavyChain
  source 1..399: mol_type = other RNA
ggcaacatctggagcgagagcggcggcggcgtgaagaagcccggcgccagcgtgagagtgagctgcagagccagcgaggacctgttcggcgacgagatcatctacgacgacgaggtgatccactggctgagacaggtgcccggccagagacccgagtggatgggctggatcagacccaagaacggcggcagaaaccaggccagacagttccagcccagaatcagcctgaccagagacagagccctgaacaccgcctacctggacctgaacagcctgaccagcgccgacagcggcacctacttctgcgccagacagaccttcaagcccgacttctacttcgccgaccagggctggagcttcaacctgtggggcagaggcgccagagtgatcgtgagcagc

SEQ ID NO: 34155 - RNA, 399 nt, synthetic construct
  misc_feature 1..399: note = derived and/or modified sequence opt4 from anti-HIV-1_HeavyChain
  source 1..399: mol_type = other RNA
caggtgcagctggtgcagagcggcgccgaggtgaagaagcccggcgccagcctgagagtgccctgcagagccagcgaggacctgttcggcgacgagatcatctacgacgacgaggtgatccactggctgagacaggtgcccggccagagacccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 34156 - RNA, 390 nt, synthetic construct
  misc_feature 1..390: note = derived and/or modified sequence opt4 from anti-HIV-1_HeavyChain
  source 1..390: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcagaagcgcc

SEQ ID NO: 34157 - RNA, 393 nt, synthetic construct
  misc_feature 1..393: note = derived and/or modified sequence opt4 from anti-HIV-1_HeavyChain
  source 1..393: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccagaagcacc

SEQ ID NO: 34158 - RNA, 414 nt, synthetic construct
  misc_feature 1..414: note = derived and/or modified sequence opt4 from anti-HIV-1_HeavyChain
  source 1..414: mol_type = other RNA
caggtgcagctggtgcagagcggcgccgaggtgaagaagcccggcgccagcgtgaccgtgagctgcaaggccagcagatacaccttcatcaactactacatccactgggtgagacaggcccccggccagggcctggagtggatcggctgggtgaagcccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34159 - RNA, 414 nt, synthetic construct
  misc_feature 1..414: note = derived and/or modified sequence opt4 from anti-HIV-1_HeavyChain
  source 1..414: mol_type = other RNA
caggtgcagctggtgcagagcggcgccgaggtgaagaagcccggcgccagcgtgaaggtgagctgcaaggccagcggctacaccatcaccagacactacatgcactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34160 - RNA, 408 nt, synthetic construct
  misc_feature 1..408: note = derived and/or modified sequence opt4 from anti-HIV-1_HeavyChain
  source 1..408: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagcgccagcaccaagggccccagcgacgacctgaga

SEQ ID NO: 34161 - RNA, 411 nt, synthetic construct
  misc_feature 1..411: note = derived and/or modified sequence opt4 from anti-HIV-1_HeavyChain
  source 1..411: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgtacgacctgaga

SEQ ID NO: 34162 - RNA, 417 nt, synthetic construct
  misc_feature 1..417: note = derived and/or modified sequence opt4 from anti-HIV-1_HeavyChain
  source 1..417: mol_type = other RNA
caggtgcagctggtgcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34163 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttccccaccatctacgtg

SEQ ID NO: 34164 - RNA, 417 nt, synthetic construct
  misc_feature 1..417: note = derived and/or modified sequence opt4 from anti-HIV-1_HeavyChain
  source 1..417: mol_type = other RNA
caggtgcagctggagcagagcggcagcggcgtgaagaagctgggcgccagcgtgagagtgagctgctggaccagcgaggacatcttcgaggacgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcggcctgcaccagggccccatcggcctgccccccagactgagcaga

SEQ ID NO: 34165 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagccccagagcccacagaagcagccccaccatctgcgtg

SEQ ID NO: 34166 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34167 - RNA, 414 nt, synthetic construct
  misc_feature 1..414: note = derived and/or modified sequence opt4 from anti-HIV-1_HeavyChain
  source 1..414: mol_type = other RNA
caggtgcacctggtgcagagcggcgccgaggtgaagagacccggcgccagcgtgaaggtgagctgcaaggccagcggctacaccttcaccgactacttcatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34168 - RNA, 420 nt, synthetic construct
  misc_feature 1..420: note = derived and/or modified sequence opt4 from anti-HIV-1_HeavyChain
  source 1..420: mol_type = other RNA
caggtgcagctggtgcagagcggcgccgaggtgaagaagcccggcgccagcgtgaaggtgagctgcaaggccagcggctacatcttcaccggcagctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttcccccacgacctgaga

SEQ ID NO: 34169 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34170 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34171 - RNA, 420 nt, synthetic construct
  misc_feature 1..420: note = derived and/or modified sequence opt4 from anti-HIV-1_HeavyChain
  source 1..420: mol_type = other RNA
caggtgcagctggtgcagagcggcgccgaggtgaagaagcccggcgccagcgtgaaggtgagctgcaaggccagcggctacaccttcaccggctactacatccactgggtgagacaggcccccggccagggcctggagtggatgggctggatcaaccccaacagcggcgccaccaactacgcccagaagttccagggcagactgaccatcgccagagacaccagcatcagcaccgcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttcccccacgacctgaga

SEQ ID NO: 34172 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccacgacctgaga

SEQ ID NO: 34173 - RNA, 414 nt, synthetic construct
  misc_feature 1..414: note = derived and/or modified sequence opt4 from anti-HIV-1_HeavyChain
  source 1..414: mol_type = other RNA
caggccaccctggagcagagcggcagcggcgtgaagaagcccggcgccagcgtgagagtgagctgctggagcagcgaggacatcttcaagaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacccacttctgcgccagacagaagttcgccagaggcgaccagggctggttcttcgacctgtggggcagaggcaccctgatcgtggtgagcagcgccagcaccaagggccccagcgtgttccccaccatctacgtg

SEQ ID NO: 34174 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttccccaccatctgcgtg

SEQ ID NO: 34175 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagccccagagcccacagaagcagccccagaagcgcc

SEQ ID NO: 34176 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccaccatctgcgtg

SEQ ID NO: 34177 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggccccggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagcgccagcaccaaggcccacagaagcagccccagaagcacc

SEQ ID NO: 34178 - RNA, 420 nt, synthetic construct
  misc_feature 1..420: note = derived and/or modified sequence opt4 from anti-HIV-1_HeavyChain
  source 1..420: mol_type = other RNA
caggtgcagctggtgcagagcggcgccgagatgaagaagcccggcgccagcgtgaagctgagctgcatgaccagcggctacgtgttcaccgacttctacatccactgggtgagacaggcccccggccagggcctggagtggatgggctggatcaaccccggcaccggcggcaccatcagcgcccccagattcctgggcagagtgaccctgaccagagacaccagcatcagcgccgcctacatcgagatcaacagagtgaccatcgacgacaccgccacctacttctgcgccagacagaagttcgccagcagatacagcggcgaccagggcagctacttcgacctgtggggcagaggcaccctgatcgtggtgagcagcgccagcaccaagggccccctgggcctgccccccagaagcgcc

SEQ ID NO: 34179 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggacccccgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagccccagagcccacagaagcagccccagaagcgcc

SEQ ID NO: 34180 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagcccgtgaccggcgccgtgaacctggcccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34181 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34182 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaaggcccacagaagcagccccagaagcacc

SEQ ID NO: 34183 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccatctgcgtg

SEQ ID NO: 34184 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagctgggcgccagcgtgagagtgagctgctggaccagcgaggacatcttcaagaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34185 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccatctacgtg

SEQ ID NO: 34186 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttccccaccatctgcgtg

SEQ ID NO: 34187 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccagatctacgtg

SEQ ID NO: 34188 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacagacccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccatctacgtg

SEQ ID NO: 34189 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatgggcatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccaccatctacgtg

SEQ ID NO: 34190 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34191 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccagaagcgccgtg

SEQ ID NO: 34192 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctggatgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34193 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcagcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagcgccagcaccaagggccccagcgtgttccccaccatctgcgtg

SEQ ID NO: 34194 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34195 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccaccatctacgtg

SEQ ID NO: 34196 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttccccaccatctgcgtg

SEQ ID NO: 34197 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacctgggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34198 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgagagaggcggccagggctggatcttcgacctgtggggcagaggcaccctgatcgccgtgagcagcgccagcaccaagggccccagcgtgttccccaccatctgcgtg

SEQ ID NO: 34199 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctggtg

SEQ ID NO: 34200 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttccccaccatctacgtg

SEQ ID NO: 34201 - RNA, 420 nt, synthetic construct
  misc_feature 1..420: note = derived and/or modified sequence opt4 from anti-HIV-1_HeavyChain
  source 1..420: mol_type = other RNA
caggtgcacctggagcagagcggcagcggcgtgaagaagcccggcgcccccgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaaggcccacagcgtgctgccccccagaagcagagtg

SEQ ID NO: 34202 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccctggtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34203 - RNA, 414 nt, synthetic construct
  misc_feature 1..414: note = derived and/or modified sequence opt4 from anti-HIV-1_HeavyChain
  source 1..414: mol_type = other RNA
caggtgcagctggtgcagagcggcgccgaggtgaagaagcccggcgccagcgtgaaggtgagctgccaggtgagcggctacaccctgaccgagctgagcatgcactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34204 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcaagaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34205 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttccccaccatctgcgtg

SEQ ID NO: 34206 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtgggtgggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34207 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttccccaccatctgcgtg

SEQ ID NO: 34208 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccagatctgcgtg

SEQ ID NO: 34209 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggccaccagatcagcgacagagtgagcctgacccccgacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccatctgcgtg

SEQ ID NO: 34210 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagaagagcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaaggcccacagaagcagccccaccatctgcgtg

SEQ ID NO: 34211 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgcccccaccaagggccccagcgtgttccccaccatctgcgtg

SEQ ID NO: 34212 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccagatctacgtg

SEQ ID NO: 34213 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagaggcagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccatctgcgtg

SEQ ID NO: 34214 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgaccacgtg

SEQ ID NO: 34215 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccagatctgcgtg

SEQ ID NO: 34216 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgtggtgagcagcgccagcaccaagggccccagcgtgttccccaccatctgcgtg

SEQ ID NO: 34217 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctgggccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgctg

SEQ ID NO: 34218 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34219 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34220 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagcgccagcaccaagggccccagcgtgttccccaccatctgcaga

SEQ ID NO: 34221 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34222 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttccccaccatctacgtg

SEQ ID NO: 34223 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagcgccagcaccaagggccccagcgtgttcccccacgacctgaga

SEQ ID NO: 34224 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34225 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggcccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34226 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34227 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtggagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagcgccagcaccaagggccccagcgtgttcccccacgacctgaga

SEQ ID NO: 34228 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34229 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagaaacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34230 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34231 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaactacggcagcctgaacttcagaagcagaatcagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34232 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34233 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaatcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34234 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34235 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggagcagcgaggacatcttcgagagagccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34236 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34237 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34238 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34239 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34240 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagggccccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34241 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgcccctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagcgccagcaccaagggccccagcgtgttcccccacgacctgaga

SEQ ID NO: 34242 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34243 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34244 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34245 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34246 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcgagagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34247 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccaccctgaga

SEQ ID NO: 34248 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34249 - RNA, 420 nt, synthetic construct
  misc_feature 1..420: note = derived and/or modified sequence opt4 from anti-HIV-1_HeavyChain
  source 1..420: mol_type = other RNA
caggccagacccggcgccaacagaggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34250 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagcgccagcaccaagggccccagcgtgttcccccacgacctgaga

SEQ ID NO: 34251 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagcgccagcaccaagggccccagcgtgttcccccacgacctgaga

SEQ ID NO: 34252 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgctgccccccagaagcgcc

SEQ ID NO: 34253 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcatgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34254 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaaggagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccagaccctgaga

SEQ ID NO: 34255 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34256 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34257 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34258 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34259 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaactacggcagcctgaacttcagaagcagaatcagcctgaccagagacagagacctgttcaccgcccacatggacatcagaggcctgaccgagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34260 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgcctggccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34261 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34262 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34263 - RNA, 417 nt, synthetic construct
  misc_feature 1..417: note = derived and/or modified sequence opt4 from anti-HIV-1_HeavyChain
  source 1..417: mol_type = other RNA
caggtgcacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34264 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacagagagtgagcctgaccagagacagagacctgttcaccgcccacatggacatcagaggcctgacccagggcgacaccgccacctacctgtgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34265 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagcgccagcaccaagggccccagcgtgttcccccacgacctgaga

SEQ ID NO: 34266 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgacccccgacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggcagcagcgtgttcccccacgacctgaga

SEQ ID NO: 34267 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgacccccgacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34268 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34269 - RNA, 417 nt, synthetic construct
  misc_feature 1..417: note = derived and/or modified sequence opt4 from anti-HIV-1_HeavyChain
  source 1..417: mol_type = other RNA
caggtgcacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacagaagcacc

SEQ ID NO: 34270 - RNA, 420 nt, synthetic construct
  misc_feature 1..420: note = derived and/or modified sequence opt4 from anti-HIV-1_HeavyChain
  source 1..420: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttcaccatctacgtg

SEQ ID NO: 34271 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgaccccgcc

SEQ ID NO: 34272 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgctgccccccagaagcacc

SEQ ID NO: 34273 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34274 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcgagtggaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34275 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcgaggtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34276 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34277 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcctgagaaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34278 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcgccagcggcgtgaagagacccggcgccagcgtgagagtgagctgcctggccagcgaggacatcttcgagagaagcgagctgatctactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34279 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagcgccagcaccaagggccccagcgtgttcccccacgacctgaga

SEQ ID NO: 34280 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcgccagcggcgtgaagagacccggcgccagcgtgagagtgagctgctggaccagcgaggacatcttcgagagaagcgagctgatctactgggtgagacaggcccccggccagggcctggagtggatcggctgggtgaagaccgtgagcggcgccgtgaacttcggcagcaccgacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34281 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcggcctgccccccagaagcgcc

SEQ ID NO: 34282 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccctgagaagcgcc

SEQ ID NO: 34283 - RNA, 423 nt, synthetic construct
  misc_feature 1..423: note = derived and/or modified sequence opt4 from anti-HIV-1_HeavyChain
  source 1..423: mol_type = other RNA
caggtgcagatggagcaggccggcgccggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagccagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttcccccacgacctgaga

SEQ ID NO: 34284 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagcgccagcaccaagggccccagcgtgttcccccagatctgcaga

SEQ ID NO: 34285 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcgccggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacctggtgcaccagatcagcgacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34286 - RNA, 420 nt, synthetic construct
  misc_feature 1..420: note = derived and/or modified sequence opt4 from anti-HIV-1_HeavyChain
  source 1..420: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcggcctgccccccagactgtgcgtg

SEQ ID NO: 34287 - RNA, 417 nt, synthetic construct
  misc_feature 1..417: note = derived and/or modified sequence opt4 from anti-HIV-1_HeavyChain
  source 1..417: mol_type = other RNA
caggccagactggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacagcgcc

SEQ ID NO: 34288 - RNA, 414 nt, synthetic construct
  misc_feature 1..414: note = derived and/or modified sequence opt4 from anti-HIV-1_HeavyChain
  source 1..414: mol_type = other RNA
caggtgcagctggtgcagagcggcgccgaggtgaagaagcccggcagcagcgtgaaggtgagctgcaaggtgagcggcggcgtgttcaccagctacgccgtgacctgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34289 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34290 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgaccgtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgacgacctgaga

SEQ ID NO: 34291 - RNA, 414 nt, synthetic construct
  misc_feature 1..414: note = derived and/or modified sequence opt4 from anti-HIV-1_HeavyChain
  source 1..414: mol_type = other RNA
caggtgcagctggtgcagagcggcgccgaggtgaagaagcccggcgccagcgtgaaggtgagctgcaagagcagcggctacagcttcaccagattcgacatcacctgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34292 - RNA, 420 nt, synthetic construct
  misc_feature 1..420: note = derived and/or modified sequence opt4 from anti-HIV-1_HeavyChain
  source 1..420: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccatcggcctgccccccagactgtgcgtg

SEQ ID NO: 34293 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34294 - RNA, 420 nt, synthetic construct
  misc_feature 1..420: note = derived and/or modified sequence opt4 from anti-HIV-1_HeavyChain
  source 1..420: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcggccccagccccgagatctgcgtg

SEQ ID NO: 34295 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcgccggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34296 - RNA, 417 nt, synthetic construct
  misc_feature 1..417: note = derived and/or modified sequence opt4 from anti-HIV-1_HeavyChain
  source 1..417: mol_type = other RNA
agagcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgccaactacggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34297 - RNA, 417 nt, synthetic construct
  misc_feature 1..417: note = derived and/or modified sequence opt4 from anti-HIV-1_HeavyChain
  source 1..417: mol_type = other RNA
caggtgcacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34298 - RNA, 417 nt, synthetic construct
  misc_feature 1..417: note = derived and/or modified sequence opt4 from anti-HIV-1_HeavyChain
  source 1..417: mol_type = other RNA
agagcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagccagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccaccatctacgtg

SEQ ID NO: 34299 - RNA, 414 nt, synthetic construct
  misc_feature 1..414: note = derived and/or modified sequence opt4 from anti-HIV-1_HeavyChain
  source 1..414: mol_type = other RNA
caggtgcagctggtgcagagcgaggccgaggtgaagaagcccggcgccagcgtgaagatcagctgcgccaccagcggctacgccttcaccctgtactacctgcactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagcgccagcaccaagggccccagcgtgttcccccacgacctgaga

SEQ ID NO: 34300 - RNA, 420 nt, synthetic construct
  misc_feature 1..420: note = derived and/or modified sequence opt4 from anti-HIV-1_HeavyChain
  source 1..420: mol_type = other RNA
caggcccaccccgagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcggcctgccccccagactgtgcgtg

SEQ ID NO: 34301 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccccagaagcacc

SEQ ID NO: 34302 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagagacccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34303 - RNA, 417 nt, synthetic construct
  misc_feature 1..417: note = derived and/or modified sequence opt4 from anti-HIV-1_HeavyChain
  source 1..417: mol_type = other RNA
ggcgcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34304 - RNA, 417 nt, synthetic construct
  misc_feature 1..417: note = derived and/or modified sequence opt4 from anti-HIV-1_HeavyChain
  source 1..417: mol_type = other RNA
agacacgacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttcccccacgacctgaga

SEQ ID NO: 34305 - RNA, 420 nt, synthetic construct
  misc_feature 1..420: note = derived and/or modified sequence opt4 from anti-HIV-1_HeavyChain
  source 1..420: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgaccatctacgtg

SEQ ID NO: 34306 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagccccggccccatcggccccagccccagaagcgcc

SEQ ID NO: 34307 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcgccagcggcgtgaagagacccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34308 - RNA, 417 nt, synthetic construct
  misc_feature 1..417: note = derived and/or modified sequence opt4 from anti-HIV-1_HeavyChain
  source 1..417: mol_type = other RNA
caggtgcagctggtgcagagcggcgccgaggtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccatctacgtg

SEQ ID NO: 34309 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagagaatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttccccaccatctgcgtg

SEQ ID NO: 34310 - RNA, 420 nt, synthetic construct
  misc_feature 1..420: note = derived and/or modified sequence opt4 from anti-HIV-1_HeavyChain
  source 1..420: mol_type = other RNA
cagagccacctggagcagagcggcagcgccatgaagaagcccggcgccagcgtgagagtgagctgctggaccagcgaggacatcttcgacaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaacggccccatcggccccagccccaccgacctgaga

SEQ ID NO: 34311 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccagtgggtgagacaggcccccggccagggcctggagtggatgggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34312 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34313 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttccccaccatctacgtg

SEQ ID NO: 34314 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgaccccaga

SEQ ID NO: 34315 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttcccccacgacctgaga

SEQ ID NO: 34316 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcatgaagaagcccggcgccagcatgaccgtgagctgcaagaccgccgacgaggacatcttcgacgccgcctacatgcactgggtgagacaggccagaggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttccccaccatctacgtg

SEQ ID NO: 34317 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttccccaccatctacgtg

SEQ ID NO: 34318 - RNA, 423 nt, synthetic construct
  misc_feature 1..423: note = derived and/or modified sequence opt4 from anti-HIV-1_HeavyChain
  source 1..423: mol_type = other RNA
caggtgtacagcggcgccggcagaggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttccccaccatctacgtg

SEQ ID NO: 34319 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccttcaccaagggccccagcgtgttcccccacgacctgaga

SEQ ID NO: 34320 - RNA, 414 nt, synthetic construct
  misc_feature 1..414: note = derived and/or modified sequence opt4 from anti-HIV-1_HeavyChain
  source 1..414: mol_type = other RNA
caggtgcagctgggccagagcggcgccgagatgaagaagcccggcagcagcgtgaaggtgagctgcaaggccagcggcggcaccttcagacacagccccatcagctgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34321 - RNA, 417 nt, synthetic construct
  misc_feature 1..417: note = derived and/or modified sequence opt4 from anti-HIV-1_HeavyChain
  source 1..417: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34322 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagctgggtgatcgtgagcagcgccagcaccaagggccccagcgtgttcccccacgacctgaga

SEQ ID NO: 34323 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttccccaccatctgcgtg

SEQ ID NO: 34324 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34325 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttccccaccatctacgtg

SEQ ID NO: 34326 - RNA, 423 nt, synthetic construct
  misc_feature 1..423: note = derived and/or modified sequence opt4 from anti-HIV-1_HeavyChain
  source 1..423: mol_type = other RNA
caggtgttcatggagcaggccggcgccggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 34327 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagactggacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 34328 - RNA, 420 nt, synthetic construct
  misc_feature 1..420: note = derived and/or modified sequence opt4 from anti-HIV-1_HeavyChain
  source 1..420: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttccccaccatc

SEQ ID NO: 34329 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttccccaccatctgcgtg

SEQ ID NO: 34330 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagcgccagcaccaagggccccagcgtgttcccccacgacctgaga

SEQ ID NO: 34331 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34332 - RNA, 423 nt, synthetic construct
  misc_feature 1..423: note = derived and/or modified sequence opt4 from anti-HIV-1_HeavyChain
  source 1..423: mol_type = other RNA
caggtgtacatgggcgccggcagaggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttccccaccatctacgtg

SEQ ID NO: 34333 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttccccaccatctgcgtg

SEQ ID NO: 34334 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttcccccacgacctgaga

SEQ ID NO: 34335 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcaaggtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 34336 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagagcagagtgagcttctacggcaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 34337 - RNA, 420 nt, synthetic construct
  misc_feature 1..420: note = derived and/or modified sequence opt4 from anti-HIV-1_HeavyChain
  source 1..420: mol_type = other RNA
cagggccacaccgtggagcagagcggcagcggcgtgaagaagctgggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34338 - RNA, 420 nt, synthetic construct
  misc_feature 1..420: note = derived and/or modified sequence opt4 from anti-HIV-1_HeavyChain
  source 1..420: mol_type = other RNA
caggccaccccctggagcaacctgggcagaggcgtgaagaagctgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagcgccagcaccaagggccccagcgtgttcccccacgacctgaga

SEQ ID NO: 34339 - RNA, 423 nt, synthetic construct
  misc_feature 1..423: note = derived and/or modified sequence opt4 from anti-HIV-1_HeavyChain
  source 1..423: mol_type = other RNA
caggtgttcatggagcaggccggcgccggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttcccccacgacctgaga

SEQ ID NO: 34340 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcagagcggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 34341 - RNA, 423 nt, synthetic construct
  misc_feature 1..423: note = derived and/or modified sequence opt4 from anti-HIV-1_HeavyChain
  source 1..423: mol_type = other RNA
caggtgtacatggagagaggcagaggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 34342 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaagattccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttccccaccatctgcgtg

SEQ ID NO: 34343 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttcccccacgacctgaga

SEQ ID NO: 34344 - RNA, 423 nt, synthetic construct
  misc_feature 1..423: note = derived and/or modified sequence opt4 from anti-HIV-1_HeavyChain
  source 1..423: mol_type = other RNA
caggtgttcatggagcaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttcccccacgacctgaga

SEQ ID NO: 34345 - RNA, 423 nt, synthetic construct
  misc_feature 1..423: note = derived and/or modified sequence opt4 from anti-HIV-1_HeavyChain
  source 1..423: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctg

SEQ ID NO: 34346 - RNA, 423 nt, synthetic construct
  misc_feature 1..423: note = derived and/or modified sequence opt4 from anti-HIV-1_HeavyChain
  source 1..423: mol_type = other RNA
caggtgttcatggagcaggccggcgccggcatgaagaagcccggcgccagcatgaccgtgagctgcaagaccgccgacgaggacgtgttcgacgccgcctacatgcactgggtgagacaggcccccggccccgacctggagtggctgggctggatgaagcccgtgaccggcgccgtgaactacgccagaaagttccagggcagagtgagcttctacagaaccagagagctgggcatcgcctacatggacctgagagacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaaggcccacagaagcagccccaccatctgcgtg

SEQ ID NO: 34347 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34348 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcaacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttcccccacgacctgaga

SEQ ID NO: 34349 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcggcctgccccacgacctgaga

SEQ ID NO: 34350 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacggcaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 34351 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttcccccacgacctgaga

SEQ ID NO: 34352 - RNA, 423 nt, synthetic construct
  misc_feature 1..423: note = derived and/or modified sequence opt4 from anti-HIV-1_HeavyChain
  source 1..423: mol_type = other RNA
caggtgcagctggtgcagagcggcgccgaggtgaagaagcccggcgccagcctgaaggtgagctgcaaggccagcggctacaccttcaccgactactacatccactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34353 - RNA, 423 nt, synthetic construct
  misc_feature 1..423: note = derived and/or modified sequence opt4 from anti-HIV-1_HeavyChain
  source 1..423: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcaccctgatcgtggtgagcagcgccagcaccagagcccacagaagcccccacgacctgaga

SEQ ID NO: 34354 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34355 - RNA, 426 nt, synthetic construct
  misc_feature 1..426: note = derived and/or modified sequence opt4 from anti-HIV-1_HeavyChain
  source 1..426: mol_type = other RNA
caggtgcagctggtgcagagcggcgccgaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccagatctgcgtg

SEQ ID NO: 34356 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctggatgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaaggcccacagaagcagccccaccaccctgaga

SEQ ID NO: 34357 - RNA, 423 nt, synthetic construct
  misc_feature 1..423: note = derived and/or modified sequence opt4 from anti-HIV-1_HeavyChain
  source 1..423: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttccccagaagcgcc

SEQ ID NO: 34358 - RNA, 423 nt, synthetic construct
  misc_feature 1..423: note = derived and/or modified sequence opt4 from anti-HIV-1_HeavyChain
  source 1..423: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggccaccagatcagcgacagagtgagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34359 - RNA, 423 nt, synthetic construct
  misc_feature 1..423: note = derived and/or modified sequence opt4 from anti-HIV-1_HeavyChain
  source 1..423: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccagagcccacagaagcagccccagaagcgcc

SEQ ID NO: 34360 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34361 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttccccaccatctacgtg

SEQ ID NO: 34362 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34363 - RNA, 423 nt, synthetic construct
  misc_feature 1..423: note = derived and/or modified sequence opt4 from anti-HIV-1_HeavyChain
  source 1..423: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttccccaccatctgc

SEQ ID NO: 34364 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccctgcaccagggccccatcggcctgccccccagaagcacc

SEQ ID NO: 34365 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgctgccccccagaagcgcc

SEQ ID NO: 34366 - RNA, 423 nt, synthetic construct
  misc_feature 1..423: note = derived and/or modified sequence opt4 from anti-HIV-1_HeavyChain
  source 1..423: mol_type = other RNA
caggtgcagctggtgcagagcggcgccgaggtgaagaagcccggcgccagcgtgaagatcagctgcaaggccagcggctacaccttcatcagacacggcatccactggctgagacaggtgcccggccagagacccgagtggatgggctggatcagacccaagaccggcgccagaaaccaggccagacagttccagcccagaatcagcctggccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagcgccctgcaccagggccccatcggcctgccccccagaagcacc

SEQ ID NO: 34367 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34368 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacctgtgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34369 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccagatctgcgtg

SEQ ID NO: 34370 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34371 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcctgtacagcgacgaccagggcagctacttcgacctgtggggcagaggcaccctgatcatcgtgagcagcgccagcaccaagggccccagcgtgttccccaccatctgcgtg

SEQ ID NO: 34372 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34373 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttccccaccatctgcgtg

SEQ ID NO: 34374 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttccccaccatctgcgtg

SEQ ID NO: 34375 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccacagaagcagccccaccatctgcgtg

SEQ ID NO: 34376 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttccccaccatctacgtg

SEQ ID NO: 34377 - RNA, 423 nt, synthetic construct
  misc_feature 1..423: note = derived and/or modified sequence opt4 from anti-HIV-1_HeavyChain
  source 1..423: mol_type = other RNA
cagagccacctggagcagagcggcagcgccatgaagaagcccggcgccagcgtgagagtgagctgctggaccagcgaggacatcttcgacaccaccgagctgtactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34378 - RNA, 423 nt, synthetic construct
  misc_feature 1..423: note = derived and/or modified sequence opt4 from anti-HIV-1_HeavyChain
  source 1..423: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttcccccacgaccccgcc

SEQ ID NO: 34379 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34380 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacagagagtgagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttccccaccatctgcgtg

SEQ ID NO: 34381 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcgccagcggcgtgaagagacccggcgccagcgtgagagtgagctgctggaccagcgaggacatcttcgagagaaccgagctgatctactgggtgagacaggcccccggccagggcctggagtggatcggctgggtgaagaccgtgagcggcgccgtgaacttcggcagccaggacttcagagacagattcagcctgaccagagacagagacctgttcaccgcccacatggacatcagaggcctgacccagggcgacaccgccacctacttctgcgccagacagaagttcgccagcagatacagcggcgaccagggcagctacttcgacctgtggggcagaggcaccctgatcgtggtgagcagcgccagcaccaagggccccagcgtgttccccaccatctgcgtg

SEQ ID NO: 34382 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34383 - RNA, 423 nt, synthetic construct
  misc_feature 1..423: note = derived and/or modified sequence opt4 from anti-HIV-1_HeavyChain
  source 1..423: mol_type = other RNA
caggtgcacatggagcaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttcctgcaggaccagggcatcagaatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcagcctgcaccagggccccatcggcctgccccccagaagcgcc

SEQ ID NO: 34384 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctacgtg

SEQ ID NO: 34385 - RNA, 426 nt, synthetic construct
  misc_feature 1..426: note = derived and/or modified sequence opt4 from anti-HIV-1_HeavyChain
  source 1..426: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaacttccagggcagagtgagcttctacagaaccagagagctgggcatcgcctacatggacctgagaaacctgagattcgacgacaccgccgtgtacttctgcgccagaaagaccaagggcgacgtgagcggcgacgacagaggcttcttcttcgacctgtggggcagaggcaccagagtgatcgtgagcagcggcctgcaccagagagcccacagaagcagccccaccatctgcgtg

SEQ ID NO: 34386 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttccccaccatctgcgtg

SEQ ID NO: 34387 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgtgggcgtgaagaagcccggcgccagcgtgaccctgagctgcaagaccgccgacgaggacgtgttcgacgccgcctacatgcactgggtgagacaggcccccggccccgacctggagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagcgccagcaccaagggccccagcgtgttccccaccatctgcgtg

SEQ ID NO: 34388 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttcccccacgacctgaga

SEQ ID NO: 34389 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34390 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagagaatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34391 - RNA, 423 nt, synthetic construct
  misc_feature 1..423: note = derived and/or modified sequence opt4 from anti-HIV-1_HeavyChain
  source 1..423: mol_type = other RNA
gaggtgtacatggagagaggcagaggcggcgtgaagaagcccggcgccagcgccaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttcccccacgacctgaga

SEQ ID NO: 34392 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgccagagtgagctgctggagcagcgaggacatcttcgagagaatcgagctgatccactgggtgagacaggcccccggccagggcctggagtggatcggctgggtgaagaccgtggccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34393 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagcgccagcaccaagggccccagcgtgttccccaccatctacgtg

SEQ ID NO: 34394 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacggcatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34395 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34396 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcggcgacatcctgagaaagagcgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34397 - RNA, 426 nt, synthetic construct
  misc_feature 1..426: note = derived and/or modified sequence opt4 from anti-HIV-1_HeavyChain
  source 1..426: mol_type = other RNA
caggtgcacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgcctgcaccaagggccccagcgtgttcccccacgacctgaga

SEQ ID NO: 34398 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagctggagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34399 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggccccgagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34400 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatcctgaga

SEQ ID NO: 34401 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcgccgtgagcagcgccagcaccaagggccccagcgtgttcccccacgacctgaga

SEQ ID NO: 34402 - RNA, 426 nt, synthetic construct
  misc_feature 1..426: note = derived and/or modified sequence opt4 from anti-HIV-1_HeavyChain
  source 1..426: mol_type = other RNA
cagagccacctgaagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34403 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcgagtgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34404 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgagagcagatacagcggcgaccagggcagctacttcgacctgtggggcagaggcaccctgatcatcgtgagcagcgccagcaccaagggccccagcgtgttcccccacgacctgaga

SEQ ID NO: 34405 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34406 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacagagagtgagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttcccccacgacctgaga

SEQ ID NO: 34407 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34408 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34409 - RNA, 426 nt, synthetic construct
  misc_feature 1..426: note = derived and/or modified sequence opt4 from anti-HIV-1_HeavyChain
  source 1..426: mol_type = other RNA
caggtgcacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34410 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagcgccagcaccaagggccccagcgtgttcccccacgacctgaga

SEQ ID NO: 34411 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcgtggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttcccccacgacctgaga

SEQ ID NO: 34412 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagaaacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagcgccagcaccaagggccccagcgtgttcccccacgacctgaga

SEQ ID NO: 34413 - RNA, 423 nt, synthetic construct
  misc_feature 1..423: note = derived and/or modified sequence opt4 from anti-HIV-1_HeavyChain
  source 1..423: mol_type = other RNA
caggtgcagctggtgcagagcggcgccgaggtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttccccaccatctacgtg

SEQ ID NO: 34414 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctggtgcactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34415 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccctgggcctgccccacgacctgaga

SEQ ID NO: 34416 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34417 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttcccccacgacctgaga

SEQ ID NO: 34418 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34419 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34420 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34421 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgccagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcacccacatcgtggtgagcagcgccagcaccaagggccccagcgtgttcccccacgacctgaga

SEQ ID NO: 34422 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34423 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34424 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttcccccacgacctgaga

SEQ ID NO: 34425 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgccagaatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttccccaccgacctgaga

SEQ ID NO: 34426 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34427 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaacggccccatcggcctgccccacgacctgaga

SEQ ID NO: 34428 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34429 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34430 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccggcctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34431 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccagatcttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34432 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34433 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgaggtgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34434 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcggcggcgtgaagaagcccggcgccagcgtgaccctgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccagcgtgttcccccacgacctgaga

SEQ ID NO: 34435 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttcccccacgacctgaga

SEQ ID NO: 34436 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34437 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcgccaagggccccagcgtgttcccccacgacctgaga

SEQ ID NO: 34438 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgagagaaccgagctgatctactgggtgagacaggcccccggcagaggcctggagtggatcggctgggtgaagaccgtgagcggcaccgtgaacttcggcagcagcgacttcagaaacagaatcagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcgtggtgagcagcgccagcaccaagggccccagcgtgttcccccccagaagcgcc

SEQ ID NO: 34439 - RNA, 426 nt, synthetic construct
  misc_feature 1..426: note = derived and/or modified sequence opt4 from anti-HIV-1_HeavyChain
  source 1..426: mol_type = other RNA
caggtgcacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccaagggcgacgtgagcggcgacgacagaggcttcttcttcgacctgtggggcagaggcaccagagtgatcgtgagcagcgccagcaccaagggccccctgagaagcttccccagaagaagcgcc

SEQ ID NO: 34440 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctacgtg

SEQ ID NO: 34441 - RNA, 426 nt, synthetic construct
  misc_feature 1..426: note = derived and/or modified sequence opt4 from anti-HIV-1_HeavyChain
  source 1..426: mol_type = other RNA
gagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttcccccacgacctgaga

SEQ ID NO: 34442 - RNA, 429 nt, synthetic construct
  misc_feature 1..429: note = derived and/or modified sequence opt4 from anti-HIV-1_HeavyChain
  source 1..429: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcggcctgccccccagaagctgcgtg

SEQ ID NO: 34443 - RNA, 423 nt, synthetic construct
  misc_feature 1..423: note = derived and/or modified sequence opt4 from anti-HIV-1_HeavyChain
  source 1..423: mol_type = other RNA
caggtgcacctggtgcagagcggcgccgaggtgaagaagcccggcgccagcgtgaaggtgagctgcaaggccagcggctacaccttcaccaccagcggcatccactggctgagacaggtgcccggccagagacccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagcgccagcaccaagggccccagcgtgttcccccacgacctgaga

SEQ ID NO: 34444 - RNA, 429 nt, synthetic construct
  misc_feature 1..429: note = derived and/or modified sequence opt4 from anti-HIV-1_HeavyChain
  source 1..429: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcacccagggccccatcggcctgccccccagactgtgcgtg

SEQ ID NO: 34445 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccatcggcctgccccccagaagcacc

SEQ ID NO: 34446 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34447 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccctgcaccagggccccatcggcctgccccccagaagcacc

SEQ ID NO: 34448 - RNA, 429 nt, synthetic construct
  misc_feature 1..429: note = derived and/or modified sequence opt4 from anti-HIV-1_HeavyChain
  source 1..429: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagagtgagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccctgcaccagggccccatcggccccagccccaccatcctgaga

SEQ ID NO: 34449 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcgtgttccccaccatctacgtg

SEQ ID NO: 34450 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34451 - RNA, 426 nt, synthetic construct
  misc_feature 1..426: note = derived and/or modified sequence opt4 from anti-HIV-1_HeavyChain
  source 1..426: mol_type = other RNA
caggtgcagctggtgcagagcggcgccgaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34452 - RNA, 426 nt, synthetic construct
  misc_feature 1..426: note = derived and/or modified sequence opt4 from anti-HIV-1_HeavyChain
  source 1..426: mol_type = other RNA
agaagacacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34453 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgagagcagatacagcggcgaccagggcagctacttcgacctgtggggcagaggcaccctgatcatcgtgagcagcgccagcaccaagggccccagcgtgttccccaccatctgcgtg

SEQ ID NO: 34454 - RNA, 429 nt, synthetic construct
  misc_feature 1..429: note = derived and/or modified sequence opt4 from anti-HIV-1_HeavyChain
  source 1..429: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggcccccaccccgtgttcccccacgacctgccc

SEQ ID NO: 34455 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagctgggcgccagcgtgagagtgagctgctggaccagcgaggacatcttcgagagaaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttccccaccatctacgtg

SEQ ID NO: 34456 - RNA, 429 nt, synthetic construct
  misc_feature 1..429: note = derived and/or modified sequence opt4 from anti-HIV-1_HeavyChain
  source 1..429: mol_type = other RNA
caggcccacctggagcagagcggcagcggcgtgaagaagcccggcgccagcgtgagagtgagctgctggaccagcgaggacatcttcgagagaaccgagctgatccactgggccagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccctgggcctgccccccagactgagcaga

SEQ ID NO: 34457 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagcgccagcaccaagggccccagcggcctgccccccagaagcgcc

SEQ ID NO: 34458 - RNA, 426 nt, synthetic construct
  misc_feature 1..426: note = derived and/or modified sequence opt4 from anti-HIV-1_HeavyChain
  source 1..426: mol_type = other RNA
caggtgcagctggtgcagagcggcgccgaggtgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgagacaggacgacaccgccacctacttctgcgccagacagaagttcgagagcagatacagcggcgaccagggcagctacttcgacctgtggggcagaggcaccctgatcatcgtgagcagcgccagcaccaagggccccagcgtgttcccccacgacctgaga

SEQ ID NO: 34459 - RNA, 426 nt, synthetic construct
  misc_feature 1..426: note = derived and/or modified sequence opt4 from anti-HIV-1_HeavyChain
  source 1..426: mol_type = other RNA
gaggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34460 - RNA, 423 nt, synthetic construct
  misc_feature 1..423: note = derived and/or modified sequence opt4 from anti-HIV-1_HeavyChain
  source 1..423: mol_type = other RNA
caggtgcagctggtgcagagcggcgccgaggtgaagaagcccggcgccagcgtgaaggtgagctgcagagccagcggctacaccttcggcaaccacgccatcagctgggtgagacaggcccccggccagggcctggagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagcgccagcaccaagggccccagcgtgttcccccacgacctgaga

SEQ ID NO: 34461 - RNA, 429 nt, synthetic construct
  misc_feature 1..429: note = derived and/or modified sequence opt4 from anti-HIV-1_HeavyChain
  source 1..429: mol_type = other RNA
cagggccacaacctggagcagagcggcagcgaggtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttcccccacgacctgaga

SEQ ID NO: 34462 - RNA, 426 nt, synthetic construct
  misc_feature 1..426: note = derived and/or modified sequence opt4 from anti-HIV-1_HeavyChain
  source 1..426: mol_type = other RNA
cccaccacctggaacaagagcggcagcgacgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgagcaccgcccacatggacatcagaggcctgacccaggacgacaccgccacctacttctgcgccagacagaagttcgagagcctgtacagcgacgaccagggcagctacttcgacctgtggggcagaggcaccctgatcatcgtgagcagcgccagcaccaagggccccagcgtgttcccccacgacctgaga

SEQ ID NO: 34463 - RNA, 432 nt, synthetic construct
  misc_feature 1..432: note = derived and/or modified sequence opt4 from anti-HIV-1_HeavyChain
  source 1..432: mol_type = other RNA
cacgtgaccccctggaacgagtacgtgggcagagccatgaagaagcccggcagaagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttcccccacgacctgaga

SEQ ID NO: 34464 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgagaagacccggcgccagcgtgaaggtgagctgcaaggccagcggcttcagcttcctgggccactacatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 34465 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcgccagcgtgaaggtgagctgcaaggccagcggctacaccttcaccagctacggcatcagctgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 34466 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcgaggccgaggtgaagaagcccggcgccagcgtgaagatcagctgcgccaccagcggctacgccttcaccctgtactacctgcactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 34467 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34468 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgcccctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 34469 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggacccccgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 34470 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcgccagcggcgtgaagagacccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 34471 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 34472 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagagccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 34473 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34474 - RNA, 375 nt, synthetic construct
  misc_feature 1..375: note = derived and/or modified sequence opt4 from anti-HIV-1_HeavyChain
  source 1..375: mol_type = other RNA
caggtgcacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 34475 - RNA, 375 nt, synthetic construct
  misc_feature 1..375: note = derived and/or modified sequence opt4 from anti-HIV-1_HeavyChain
  source 1..375: mol_type = other RNA
caggcctacctggagcagagcggcagcatcatgaagaagcccggcgccagcgtgagagtgagctgctggaccagcgaggacatcttcgacagaaccgagctgatctactgggtgagacaggcccccggccagggcctggagtggatcggctgggtgaagatcgtgagcggcgccgtgaacttcggcagcctggacttcagaaacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34476 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatcaactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 34477 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34478 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 34479 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcggcgacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 34480 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacaccgacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34481 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgcctggccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34482 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggcagaggcaccctgatcgtggtgagcagc

SEQ ID NO: 34483 - RNA, 375 nt, synthetic construct
  misc_feature 1..375: note = derived and/or modified sequence opt4 from anti-HIV-1_HeavyChain
  source 1..375: mol_type = other RNA
agacacacctggaacaagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagc

SEQ ID NO: 34484 - RNA, 375 nt, synthetic construct
  misc_feature 1..375: note = derived and/or modified sequence opt4 from anti-HIV-1_HeavyChain
  source 1..375: mol_type = other RNA
ggcacccccggcagcgagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 34485 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcaccgaggtgcagaagcccggcgccagcgtgaaggtgagctgcaaggccttcggctacagcttcaccgactactacgtgtactgggtgagacaggcccccggccagggcctggagtacgtggcctggatcaaccccagcaacggctacaccaagtacgcccagaagttccaggactgggtgaccctgaccagagacagcagcatcaacaccgcctacctgcagctggccagagtgaccagcgacgacaccgccatctactactgcgccagacagaagttcgccagcagatacagcggcgaccagggcagctacttcgacctgtggggcagaggcaccctgatcgtggtgagcagc

SEQ ID NO: 34486 - RNA, 378 nt, synthetic construct
  misc_feature 1..378: note = derived and/or modified sequence opt4 from anti-HIV-1_HeavyChain
  source 1..378: mol_type = other RNA
caggtgcagctggtgcagagcggcgccgccgtgaagaagcccggcagcagcgtgaaggtgagctgcaaggccagcggctacatcttcaccggctactacatccactggatcagacaggcccccggccagggcctggagtggatgggctggatcaaccccagcaccggcgacaccaagttcgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 34487 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcgccggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 34488 - RNA, 381 nt, synthetic construct
  misc_feature 1..381: note = derived and/or modified sequence opt4 from anti-HIV-1_HeavyChain
  source 1..381: mol_type = other RNA
caggtgttcatggagcaggccggcggcggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 34489 - RNA, 381 nt, synthetic construct
  misc_feature 1..381: note = derived and/or modified sequence opt4 from anti-HIV-1_HeavyChain
  source 1..381: mol_type = other RNA
caggtgttcatggagcaggccggcggcggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 34490 - RNA, 381 nt, synthetic construct
  misc_feature 1..381: note = derived and/or modified sequence opt4 from anti-HIV-1_HeavyChain
  source 1..381: mol_type = other RNA
caggtgcacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 34491 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcatgaagaagcccggcgccagcatgaccgtgagctgcaagaccgccgacgaggacatcttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagc

SEQ ID NO: 34492 - RNA, 381 nt, synthetic construct
  misc_feature 1..381: note = derived and/or modified sequence opt4 from anti-HIV-1_HeavyChain
  source 1..381: mol_type = other RNA
caggtgtacatggagcaggccggcggcggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagctgggtgatcgtgagcagc

SEQ ID NO: 34493 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgaactacgccagaaagttccagggcagagtgagcttctacagaaccagagagctgggcatcgcctacatggacctgagaaacctgagattcgacgacaccgccgtgtacttctgcgccagaaagaccgccggcgacgtgagcggcgacaagagaggcttcttcttcgacctgtggggcagaggcagcagagtgatcgtgagcagc

SEQ ID NO: 34494 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagaggcctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34495 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcgccagcggcgtgagaagacccggcgccagcgtgagagtgagctgctggaccagcgaggacatcttcgagagaagcgagctgatctactgggtgagacaggcccccggcagaggcctggagtggatcggctggatcaagctggtgagcggcgccgtgaacttcggcagcgtggacttcagagacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34496 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaactacggcagcctgaacttcagaagcagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34497 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34498 - RNA, 384 nt, synthetic construct
  misc_feature 1..384: note = derived and/or modified sequence opt4 from anti-HIV-1_HeavyChain
  source 1..384: mol_type = other RNA
caggtgcacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34499 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgggcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34500 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34501 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgagggcatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34502 - RNA, 384 nt, synthetic construct
  misc_feature 1..384: note = derived and/or modified sequence opt4 from anti-HIV-1_HeavyChain
  source 1..384: mol_type = other RNA
cagagcagactggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcccacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34503 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34504 - RNA, 384 nt, synthetic construct
  misc_feature 1..384: note = derived and/or modified sequence opt4 from anti-HIV-1_HeavyChain
  source 1..384: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcagcgacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcatcgtgagcagc

SEQ ID NO: 34505 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagc

SEQ ID NO: 34506 - RNA, 384 nt, synthetic construct
  misc_feature 1..384: note = derived and/or modified sequence opt4 from anti-HIV-1_HeavyChain
  source 1..384: mol_type = other RNA
agacacacctgggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34507 - RNA, 384 nt, synthetic construct
  misc_feature 1..384: note = derived and/or modified sequence opt4 from anti-HIV-1_HeavyChain
  source 1..384: mol_type = other RNA
agacacacctgggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34508 - RNA, 414 nt, synthetic construct
  misc_feature 1..414: note = derived and/or modified sequence opt4 from anti-HIV-1_HeavyChain
  source 1..414: mol_type = other RNA
caggcccacctggagcagagcggcagcggcgtgaagaagcccggcgccagcgtgagagtgagctgctggaccagcgaggacatcttcgagagaagcgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagtactacgccggcggccagggctggtacttcgacctgtggggcagaggcaccctgatcgtggtgagcagcgccagcaccaagggccccagcgtgttccacgacctgaga

SEQ ID NO: 34509 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagcgccagcaccaagggccccagcgtgttccccaccatctgcgtg

SEQ ID NO: 34510 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34511 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaaggtgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccatctacttctgcgccagacagaagttcgccagaggcgaccagggctggttcttcgacctgtggggcagaggcaccctgatcgtggtgagcagcgccagcaccaagggccccagcgtgttcccccacgacctgaga

SEQ ID NO: 34512 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34513 - RNA, 423 nt, synthetic construct
  misc_feature 1..423: note = derived and/or modified sequence opt4 from anti-HIV-1_HeavyChain
  source 1..423: mol_type = other RNA
caggtgtacatggagcaggccggcgccggcgtgaagaagcccggcgccagcgtgaccctgagctgcaagaccgccgacgaggacgtgttcgacgccgcctacatgcactgggtgagacaggcccccggccagaccttcgagtggctgggctggatgaagcccgtgaccggcgccgtgagctacgccagaaagttccagggcagagtgagcttctacatgaccagagagctgggcatggcctacatggacctgagaaacctgagattcgacgacaccgccgtgtacttctgcgccagaaagaccgccggcgacgtgagcggcgacaacagaggctacttcttcgacctgtggggcagaggcagcagagtgatcgtgagcagcgccagcaccaagggccccagcgtgttcccccacgacctgaga

SEQ ID NO: 34514 - RNA, 426 nt, synthetic construct
  misc_feature 1..426: note = derived and/or modified sequence opt4 from anti-HIV-1_HeavyChain
  source 1..426: mol_type = other RNA
cagagccacctggagcagagcggcagcgccatgaagaagcccggcgccagcgtgagagtgagctgctggaccagcgaggacatcttcgacaccaccgagctgatctactgggtgagacaggcccccggccagggcctggagtggatcggctgggtgaagatcgtgagcggcaccgtgaacttcgccagcctggacttcagaaacagaatcagcctgagcagagacagagacctgagcaccgcctacatggacatcagaggcctgacccaggacgacaccgccacctacttctgcgccagacagaagttcgccagcagatacagcggcgaccagggcagctacttcgacctgtggggcagaggcaccctgatcgtggtgagcagcgccagcaccaagggccccagcgtgttccccaccatctacgtg

SEQ ID NO: 34515 - RNA, 372 nt, synthetic construct
  misc_feature 1..372: note = derived and/or modified sequence opt4 from anti-HIV-1_HeavyChain
  source 1..372: mol_type = other RNA
caggtgcagctggtgcagagcggcgccgaggtgaagaagcccggcgccagcgtgaaggtgagctgcaaggccagcggcggcaccctgagcagctacgccatcagctgggtgagacaggcccccggccagggcctggagtggatcggctgggtgaagaccgtgaccggcgccgtgaacttcggcagcgcctgcttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 34516 - RNA, 372 nt, synthetic construct
  misc_feature 1..372: note = derived and/or modified sequence opt4 from anti-HIV-1_HeavyChain
  source 1..372: mol_type = other RNA
cacgtgagactggtgcagagcggcgccgaggtggagaagcccggcgccagcgtgaaggtgagctgcgagaccagcaactaccccttcaacatgtacggcatgacctgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 34517 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacgtgttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttctacgccggcggccagggctggtacttcgacctgtggggcagaggcaccctgatcgtggtgagcagc

SEQ ID NO: 34518 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34519 - RNA, 375 nt, synthetic construct
  misc_feature 1..375: note = derived and/or modified sequence opt4 from anti-HIV-1_HeavyChain
  source 1..375: mol_type = other RNA
agacacacctgggagcagagcggcagcggcgtgaagagacccggcgccagcgtgagagtgagctgctggaccagcgaggacatcttcgagaccaccgagctgatccactgggtgagacaggcccccggccagggcctggagtggatcggctgggtgaagaccgtgagcggcgccgtgaacttcggcagcctgaacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 34520 - RNA, 381 nt, synthetic construct
  misc_feature 1..381: note = derived and/or modified sequence opt4 from anti-HIV-1_HeavyChain
  source 1..381: mol_type = other RNA
caggtgttcatggagcaggccggcgccggcatgaagaagcccggcgccagcatgaccgtgagctgcaagaccgccgacgaggacgtgttcgacgccgcctacatgcactgggtgagacaggcccccggccagaccttcgagtggctgggctggatgaagcccgtgaccggcgccgtgaactacgccagacagttccagggcagagtgagcttctacagaaccagagagctgggcatcgcctacatggacctgagagacctgaagttcgacgacaccgccgtgtacttctgcgccagaaagaccaagggcgacgtgagcggcgacgacagaggcttcttcttcgacctgtggggcagaggcaccagagtgatcgtgagcagc

SEQ ID NO: 34521 - RNA, 384 nt, synthetic construct
  misc_feature 1..384: note = derived and/or modified sequence opt4 from anti-HIV-1_HeavyChain
  source 1..384: mol_type = other RNA
caggtgcacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34522 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgccagcaccaagggccccagcgtgttccccaccatctgcgtg

SEQ ID NO: 34523 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatcgtggtgagcagcgccagcaccaagggccccagcgtgttccccaccatctgcgtg

SEQ ID NO: 34524 - RNA, 417 nt, synthetic construct
  misc_feature 1..417: note = derived and/or modified sequence opt4 from anti-HIV-1_HeavyChain
  source 1..417: mol_type = other RNA
caggcccacctggagcagagcggcagcggcgtgaagaagctgggcgccagcgtgagagtgagctgctggaccagcgaggacgtgttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttctacgccggcggccagggctggtacttcgacctgtggggcagaggcaccctgatcgtggtgagcagcgccagcaccaagggccccagcgtgttcccccacgacctgaga

SEQ ID NO: 34525 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34526 - RNA, 384 nt, synthetic construct
  misc_feature 1..384: note = derived and/or modified sequence opt4 from anti-HIV-1_HeavyChain
  source 1..384: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagc

SEQ ID NO: 34527 - RNA, 426 nt, synthetic construct
  misc_feature 1..426: note = derived and/or modified sequence opt4 from anti-HIV-1_HeavyChain
  source 1..426: mol_type = other RNA
caggcccacctggagcagagcggcagcggcgtgaagaagcccggcgccagcgtgagagtgagctgctggagcagcgaggacatcttcgagagaaccgagctgatccactgggtgagacaggcccccggccagggcctggagtggatcggctgggtgaagaccgtgaccggcgccgtgaacttcggcagcctggacttcagacacagaatcagcctgaccagagacagagacctgttcaccgcccacatggacatcagaggcctgacccagggcgacaccgccacctacttctgcgccagacagaagttcgagagcagatacaccggcggccagggctggtacttcgacctgtggggcagaggcacccacatcgtggtgagcagcgccagcaccaagggccccagcgtgttccccaccatctgcgtg

SEQ ID NO: 34528 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34529 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaaggtgagctgcaaggccagcggctacacctacaccacctacggcgtgagctggctgagacaggtgcccggccagagacccgagtggatgggctggatcagacccaagaccggcgccagaaaccaggccagacagttccagcccagaatcagcctgaccagagacagagccctgagcaccgcctacctggacctgaacagcctgaccagcgccgacagcggcacctacttctgcgccagacagaccttcaagcccgacttctacttcgccgaccagggctggagcttcaacctgtggggcagaggcgcccacttcatcgtgagcagc

SEQ ID NO: 34530 - RNA, 384 nt, synthetic construct
  misc_feature 1..384: note = derived and/or modified sequence opt4 from anti-HIV-1_HeavyChain
  source 1..384: mol_type = other RNA
agagcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgagagcagatacaccggcggccagggctggtacttcgacctgtggggcagaggcacccacatcaccgtgagcagc

SEQ ID NO: 34531 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagatcgtgagcggcgccgtgaacttcggcagccccaacttcagacagagagtgagcctgaccagagacagagacctgttcaccgcccacatggacatcagaggcctgacccagggcgacaccgccacctactactgcgccagacagaagttcgagagaggcggccagggctggatcttcgacctgtggggcagaggcaccctgatcgccgtgagcagc

SEQ ID NO: 34532 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctacttctgcgccagacagaagttcgccagaggcgaccagggctggttcttcgacctgtggggccacggcaccctgatcgtggtgagcagc

SEQ ID NO: 34533 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggccacggcaccctgatcgtggtgagcagc

SEQ ID NO: 34534 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacggcgacctgttcaccgcccacatggacatcagaggcctgacccagggcgacaccgccacctacttctgcgccagacagaagttctacgccggcggccagggctggtacttcgacctgtggggcagaggcaccctgatcatcgtgagcagc

SEQ ID NO: 34535 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggccaccagatcagcgacagagtgagcctgaccagagacagagacctgttcaccgcccacatggacatcagaggcctgacccagggcgacaccgccacctacttctgcgccagacagaagttctacgccggcggccagggctggtacttcgacctgtggggccacggcaccctgatcgtggtgagcagc

SEQ ID NO: 34536 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggccacggcaccctgatcgtggtgagcagc

SEQ ID NO: 34537 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcgccggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctactactgcgccagacagaagttcgagagaggcggccagggctggtacttcgacctgtggggcagaggcaccctgatcgtggtgagcagc

SEQ ID NO: 34538 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggcagaggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctactactgcgccagacagaagttcgagagaggcggccagggctggatcttcgacctgtggggcagaggcaccctgatcgccgtgagcagc

SEQ ID NO: 34539 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctactactgcgccagacagaagttctacgccggcggccagggctggtacttcgacctgtggggcagaggcaccctgatcgtggtgagcagc

SEQ ID NO: 34540 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 34541 - RNA, 372 nt, synthetic construct
  misc_feature 1..372: note = derived and/or modified sequence opt4 from anti-HIV-1_HeavyChain
  source 1..372: mol_type = other RNA
tacgtggagctgggcaccaacaccggccccgaggtgagaaagcccggcgccagcgtgaagatcagctgcaagaccagcggctacatcttcaccgacaactacttccactggctgagacaggcccccgccgtgggcctggagtggatgggctggatcaacagccacaacggctacaccaagagcgccaagaagttccagggcagaatcaccatgaccagagacaccgccgtggacaccgcctacatggagctgatcgacctgaccagcgacgacaccgccacctactactgcgccagacagaagttctacgccggcggccagggctggtacttcgacctgtggggctgcggcaccctgatcgtggtgagcagc

SEQ ID NO: 34542 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggcagaggcaccctgatctgcgtgagcagc

SEQ ID NO: 34543 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctactactgcgccagacagaagttctacgccggcggccagggctggtacttcgacctgtggggcagaggcaccctgatcgtggtgagcagc

SEQ ID NO: 34544 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagcccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatcgtggtgagcagc

SEQ ID NO: 34545 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctactactgcgccagacagaagttcgagagaggcggccagggctggtacttcgacctgtggggcagaggcaccctgatcgtggtgagcagc

SEQ ID NO: 34546 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacagctgcgccagacagaagttcgccagaggcgaccagggctggttcttcgacctgtggggcagaggcaccctgatcgtggtgagcagc

SEQ ID NO: 34547 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctactactgcgccagacagaagttcgagagaggcggccagggctggtacttcgacctgtggggcagaggcaccctgatcgtggtgagcagc

SEQ ID NO: 34548 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcaccgtgaacttcggcagcctgaacttcagacagagagtgagcctgaccagagacagagacctgttcaccgcccacatggacatcagaggcctgacccagggcgacaccgccacctacttctgcgccagacagaagttcgccagaggcgaccagggctggttcttcgacctgtggggccacggcaccctgatcgtggtgagcagc

SEQ ID NO: 34549 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagaccccttcaccgcccacatggacatcagaggcctgacccagggcgacaccgccacctacttctgcgccagacagaagttcgagagaggcggccagggctggtacttcgacctgtggggccacggcaccctgatcgtggtgagcagc

SEQ ID NO: 34550 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatctgcggcctgacccagggcgacaccgccacctacttctgcgccagacagaagttcgagagaggcggccagggctggtacttcgacctgtggggccacggcaccctgatcgtggtgagcagc

SEQ ID NO: 34551 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacagagagtgagcctgaccagagacagagacctgttcaccgcccacatggacatcagaggcctgacccagggcgacaccgccacctactactgcgccagacagaagttctacgccggcggccagggctggtacttcgacctgtggggcagaggcaccctgatcgtggtgagcagc

SEQ ID NO: 34552 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctacttctgcgccagacagaagttctacgccggcggccagggctggtacttcgacctgtggggccacggcaccctgatcgtggtgagcagc

SEQ ID NO: 34553 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgccagaggcgaccagggctggttcttcgacctgtggggccacggcaccctgatcgtggtgagcagc

SEQ ID NO: 34554 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctactactgcgccagacagaagttcgccagaggcgaccagggctggttcttcgacctgtggggcagaggcaccctgatcgtggtgagcagc

SEQ ID NO: 34555 - RNA, 381 nt, synthetic construct
  misc_feature 1..381: note = derived and/or modified sequence opt4 from anti-HIV-1_HeavyChain
  source 1..381: mol_type = other RNA
caggtgcagctggtgcagagcggcgccgaggtgaagaagcccggcgccagcgtgaaggtgagctgcaaggccagcggctacaccttcaccgactactacctgcactgggtgagacaggcccccggccagggcctggactgggtgggctggatcaaccccaacagcggcggcaccaactacgcccagaagttccagggcagagtggccatgaccagagacaccagcctgagcagcgtgtacctggacctgaacagcctgaccagcgccgacagcggcacctacttctgcgccagacagaccttcaagcccgacttctacttcgccgaccagggctggagcttcaacctgtggggccagggcagccacttcatcgtgagcagc

SEQ ID NO: 34556 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagaagagcgagctgatccactgggtgagaagagcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctactactgcgccagacagaagttctacgccggcggccagggctggtacttcgacctgtggggcagaggcaccctgatcgtggtgagcagc

SEQ ID NO: 34557 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgaccgtgagctgctggaccagcgaggacatcttcgagaagagcgagctgatccactgggtgagacaggcccccggccagggcctggagtggatcggctgggtgaagaccgtgaccggcgccgtgaacctggtgtaccagatcagcgacagagtgagcctgaccagagacagaggcctgttcaccgcccacatggacatcagaggcctgacccagggcgacaccgccacctactactgcgccagacagaagttctacgccggcggccagggctggtacttcgacctgtggggcagaggcaccctgatcgtggtgagcagc

SEQ ID NO: 34558 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagggcagcgagctgatccactgggtgagacaggcccccggccagggcctggagtggatcggctgggtgaagaccgtgaccggcgccgtgaacttcggcagcgcctacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggccacggcaccctgatcgtggtgagcagc

SEQ ID NO: 34559 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaactacggcagcctgaacttcagaagcagaatcagcctgaccagagacagagacctgttcaccgcccacatggacatcagaggcctgaccgagggcgacaccgccacctacttctgcgccagacagaagttctacgccggcggccagggctggtacttcgacctgtggggccacggcaccctgatcgtggtgagcagc

SEQ ID NO: 34560 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacatggccacctacttctgcgccagacagaagttcgagagaggcggccagggctggtacttcgacctgtggggccacggcaccctgatcgtggtgagcagc

SEQ ID NO: 34561 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaaggagcccggcaccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggatcttcgacctgtggggcagaggcaccctgatcgccgtgagcagc

SEQ ID NO: 34562 - RNA, 375 nt, synthetic construct
  misc_feature 1..375: note = derived and/or modified sequence opt4 from anti-HIV-1_HeavyChain
  source 1..375: mol_type = other RNA
caggtgcagctggagcagagcggcagcggcgtgaagaagctgggcgccagcgtgagagtgagctgctggaccagcgaggacatcttcggcagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccaggacgacaccgccacctactactgcgccagacagaagttcgccagaggcgaccagggctggttcttcgacctgtggggcagaggcaccctgatcgtggtgagcagc

SEQ ID NO: 34563 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgacgacatcttcaagaccgagctgatccactgggtgagacaggcccccggccagggcctggagtggatcggctgggtgaagaccgtgaccggcgccgtgaacttcggcagccccaacttcagacagagagtgagcctgaccagagacagagacctgttcaccgcccacatggacatcagaggcctgacccaggacgacaccgccacctacttctgcgccagacagaagttcgccagaggcgaccagggctggttcttcgacctgtggggcagaggcaccctgatcgtggtgagcagc

SEQ ID NO: 34564 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcgagagaaccgagctgatccactgggtgagacaggcccccggccagggcctggagtggatcggctgggtgaagaccgtgaccggcgccgtgaacttcggcagccccaacttcagacacagagtgagcctgaccagagacagagacctgttcaccgcccacatggacatcagaggcctgacccagggcgacaccgccacctactactgcgtgagacagaagttcgagagaggcggccagggctggtacttcgacctgtggggcagaggcaccctgatcgtggtgagcagc

SEQ ID NO: 34565 - RNA, 375 nt, synthetic construct
  misc_feature 1..375: note = derived and/or modified sequence opt4 from anti-HIV-1_HeavyChain
  source 1..375: mol_type = other RNA
caggtgcagctggtgcagagcggcgccgaggtgaagaagcccggcgccagcgtgaaggtgagctgctggaccagcgaggacatcttcgagaagagcgagctgatccactgggtgagacaggcccccggccagggcctggagtggatcggctgggtgaagaccgtgaccggcgccgtgaacttcggcagcagcgacttcagacagagagtgagcctgaccagagacagagacctgttcaccgcccacatggacatcagaggcctgacccagggcgacaccgccacctactactgcgccagacagaagttctacgccggcggccagggctggtacttcgacctgtggggcagaggcaccctgatcgtggtgagcagc

SEQ ID NO: 34566 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagctgggcgccagcgtgagagtgagctgctggaccagcgaggacatcttcgagagaaccgagctgatccactgggtgagacaggcccccggccagggcctggagtggatcggctgggtgaaggccgtgagcggcgccgtgaactacggcagcctggacttcagacacagagtgagcctgaccagagacagagacctgttcaccgcccacatggacatcagaggcctgacccagggcgacaccgccacctacttctgcgccagacagaagttctacaagggcggccagggctggtacttcgacctgtggggcagaggcaccctgatcgtggtgagcagc

SEQ ID NO: 34567 - RNA, 372 nt, synthetic construct
  misc_feature 1..372: note = derived and/or modified sequence opt4 from anti-HIV-1_HeavyChain
  source 1..372: mol_type = other RNA
caggcccacctggagcagagcggcagcggcgtgaagaagcccggcgccagcgtgagagtgagctgctggaccagcgaggacatcttcgagaagagcgagctgatccactgggtgagacaggcccccggccagggcctggagtggatcggctgggtgaagaccgtgaccggcgccgtgaacttcgcccaccagatcagcgacagagtgagcctgaccagagacagagacctgttcaccgcccacatggacatcagaggcctgacccagggcgacaccgccacctactactgcgccagacagaagttctacgccggcggccagggctggtacttcgacctgtggggcagaggcaccctgatcgtggtgagcagc

SEQ ID NO: 34568 - RNA, 375 nt, synthetic construct
  misc_feature 1..375: note = derived and/or modified sequence opt4 from anti-HIV-1_HeavyChain
  source 1..375: mol_type = other RNA
caggcccacctggagcagagcggcagcggcgtgaagaagcccggcgccagcgtgagagtgagctgctggaccagcgaggacatcttcggcagaaccgagctgatccactgggtgagacaggcccccggccagggcctggagtggatcggctgggtgaagaccgtgagcggcgccgtgaacttcggcagccccaacttcagacacagagtgagcctgaccagagacagagacctgttcaccgcccacatggacatcagaggcctgacccagggcgacaccgccacctacttctgcgccagacagaagttcgagagaggcggccagggctggtacttcgacctgtggggcagaggcaccctgatctgcgtgagcagc

SEQ ID NO: 34569 - RNA, 636 nt, synthetic construct
  misc_feature 1..636: note = derived and/or modified sequence opt4 from anti-HIV_5CIN_LightChain
  source 1..636: mol_type = other RNA
gagatcgtgctgacccagagccccggcacccagagcctgagccccggcgagagagccaccctgagctgcagagccagccagagcgtgggcaacaacaagctggcctggtaccagcagagacccggccaggcccccagactgctgatctacggcgccagcagcagacccagcggcgtggccgacagattcagcggcagcggcagcggcaccgacttcaccctgaccatcagcagactggagcccgaggacttcgccgtgtactactgccagcagtacggccagagcctgagcaccttcggccagggcaccaaggtggaggtgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacaga

SEQ ID NO: 34570 - RNA, 672 nt, synthetic construct
  misc_feature 1..672: note = derived and/or modified sequence opt4 from anti-HIV_5CIN_HeavyChain
  source 1..672: mol_type = other RNA
gtgcagctggtgcagagcggcgccgaggtgaagagacccggcagcagcgtgaccgtgagctgcaaggccagcggcggcagcttcagcacctacgccctgagctgggtgagacaggcccccggcagaggcctggagtggatgggcggcgtgatccccctgctgaccatcaccaactacgcccccagattccagggcagaatcaccatcaccgccgacagaagcaccagcaccgcctacctggagctgaacagcctgagacccgaggacaccgccgtgtactactgcgccagagagggcaccaccggcagcggcggcaagcccatcggcgccttcgcccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagccc

SEQ ID NO: 34571 - RNA, 678 nt, synthetic construct
  misc_feature 1..678: note = derived and/or modified sequence opt4 from anti-HIV_5CIL_HeavyChain
  source 1..678: mol_type = other RNA
gtgcagctggtgcagagcggcgccgaggtgaagagacccggcagcagcgtgaccgtgagctgcaaggccagcggcggcagcttcagcacctacgccctgagctgggtgagacaggcccccggcagaggcctggagtggatgggcggcgtgatccccctgctgaccatcaccaactacgcccccagattccagggcagaatcaccatcaccgccgacagaagcaccagcaccgcctacctggagctgaacagcctgagacccgaggacaccgccgtgtactactgcgccagagagggcaccaccggcgacggcgacctgggcaagcccatcggcgccttcgcccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagccc

SEQ ID NO: 34572 - RNA, 678 nt, synthetic construct
  misc_feature 1..678: note = derived and/or modified sequence opt4 from anti-HIV_5CIP_A-Chain
  source 1..678: mol_type = other RNA
gtgcagctggtgcagagcggcgccgaggtgaagagacccggcagcagcgtgaccgtgagctgcaaggccagcggcggcagcttcagcacctacgccctgagctgggtgagacaggcccccggcagaggcctggagtggatgggcggcgtgatccccctgctgaccatcaccaactacgcccccagattccagggcagaatcaccatcaccgccgacagaagcaccagcaccgcctacctggagctgaacagcctgagacccgaggacaccgccgtgtactactgcgccagagagggcaccaccggctggggctggctgggcaagcccatcggcgccttcgcccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagccc

SEQ ID NO: 34573 - RNA, 681 nt, synthetic construct
  misc_feature 1..681: note = derived and/or modified sequence opt4 from anti-HIV_5CIP_HeavyChain
  source 1..681: mol_type = other RNA
gtgcagctggtgcagagcggcgccgaggtgaagagacccggcagcagcgtgaccgtgagctgcaaggccagcggcggcagcttcagcacctacgccctgagctgggtgagacaggcccccggcagaggcctggagtggatgggcggcgtgatccccctgctgaccatcaccaactacgcccccagattccagggcagaatcaccatcaccgccgacagaagcaccagcaccgcctacctggagctgaacagcctgagacccgaggacaccgccgtgtactactgcgccagagagggcaccaccggctggggctggctgggcaagcccatcggcgccttcgcccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaag

SEQ ID NO: 34574 - RNA, 630 nt, synthetic construct
  misc_feature 1..630: note = derived and/or modified sequence opt4 from anti-HIV_4JKP_LightChain
  source 1..630: mol_type = other RNA
gagatcgtgctgacccagagccccgccaccctgagcctgagccccggcgagaccgccatcatcagctgcagaaccagccagtacggcagcctggcctggtaccagcagagacccggccaggcccccagactggtgatctacagcggcagcaccagagccgccggcatccccgacagattcagcggcagcagatggggcgccgactacaacctgagcatcagcaacctggagagcggcgacttcggcgtgtactactgccagcagtacgagttcttcggccagggcaccaaggtgcaggtggacatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 34575 - RNA, 678 nt, synthetic construct
  misc_feature 1..678: note = derived and/or modified sequence opt4 from anti-HIV_3TNN_E-Chain
  source 1..678: mol_type = other RNA
gaggtgcagctggtggagagcggcggcggcctggtgcagcccggcggcagcctgagactgagctgcgccgccagcggcttcaccttcagcacctacgccatgagctgggtgagacaggcccccggcaagggcctggagtgggtgagcagcatcaacaacagcggcagaaacaccttcagcgccgacagcgtgaagggcagattcaccatcagcagagacaacagcaagaacaccctgttcctggtgatgaacagcctgagagccgaggacaccgccgtgtactactgcgccaaggacctgagactgggcggcggcagcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccac

SEQ ID NO: 34576 - RNA, 705 nt, synthetic construct
  misc_feature 1..705: note = derived and/or modified sequence opt4 from anti-HIV_3BQU_B-Chain
  source 1..705: mol_type = other RNA
agaatcaccctgaaggagagcggcccccccctggtgaagcccacccagaccctgaccctgacctgcagcttcagcggcttcagcctgagcgacttcggcgtgggcgtgggctggatcagacagccccccggcaaggccctggagtggctggccatcatctacagcgacgacgacaagagatacagccccagcctgaacaccagactgaccatcaccaaggacaccagcaagaaccaggtggtgctggtgatgaccagagtgagccccgtggacaccgccacctacttctgcgcccacagaagaggccccaccaccctgttcggcgtgcccatcgccagaggccccgtgaacgccatggacgtgtggggccagggcatcaccgtgaccatcagcagcaccagcaccaagggccccagcgtgttccccctggcccccagcagcaagagcaccgccggcggcgccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacacctgcaacgtgaaccacaagcccagcaacaccaaggtggacaagagagtggagcccaagagctgc

SEQ ID NO: 34577 - RNA, 642 nt, synthetic construct
  misc_feature 1..642: note = derived and/or modified sequence opt4 from anti-HIV_3BQU_A-Chain
  source 1..642: mol_type = other RNA
gccctgcagctgacccagagccccagcagcctgagcgccagcgtgggcgacagaatcaccatcacctgcagagccagccagggcgtgaccagcgccctggcctggtacagacagaagcccggcagccccccccagctgctgatctacgacgccagcagcctggagagcggcgtgcccagcagattcagcggcagcggcagcggcaccgagttcaccctgaccatcagcaccctgagacccgaggacttcgccacctactactgccagcagctgcacttctacccccacaccttcggcggcggcaccagagtggacgtgagaagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgagtgcgaggtgacccaccagggcctgagcagccccgtgaccaagagcttcaacagaggcgagtgc

SEQ ID NO: 34578 - RNA, 387 nt, synthetic construct
  misc_feature 1..387: note = derived and/or modified sequence opt4 from anti-HIV_IgG_VR-Chain
  source 1..387: mol_type = other RNA
atggagacccccgcccagctgctgttcctgctgctgctgtggctgcccgacaccaccggcgagatcgtgctgacccagagccccggcaccctgagcctgagcgccggcgagagagccaccctgagctgcagagccagccagagcgtgagcagcagatacctggcctggtaccagcagaagcccggccaggcccccagactgctgatctacggcgccagcagcagagccaccggcatccccgacagattcagcggcagcggcagcggcaccgacttcaccctgaccatcagcagagtggagcccgaggacttcgccggctactactgccagcagtacgacaacagcgtgtgcaccttcggccagggcaccaagctggagatcaagaga

SEQ ID NO: 34579 - RNA, 348 nt, synthetic construct
  misc_feature 1..348: note = derived and/or modified sequence opt4 from anti-HIV_IgG_HeavyChain
  source 1..348: mol_type = other RNA
atgaagcacctgtggttcttcctgctgctggtggccgcccccagatgggtgctgagccaggtgcagctgcaggagagcggccccggcctggtgaagcccagcgagaccctgagcctgacctgcaccgtgagcggcggcagcatcagcagccactactggagctggatcagacagagccccggcaagggcctgcagtggatcggctacatctactacagcggcagcaccaactacagccccagcctgaagagcagagtgaccatcagcgtggagaccagcaagaaccagttcagcctgaagctgaccagcatgaccgccgccgacaccgccgtgtactactgcgccaga

SEQ ID NO: 34580 - RNA, 714 nt, synthetic construct
  misc_feature 1..714: note = derived and/or modified sequence opt4 from anti-HIV_4P9M_HeavyChain
  source 1..714: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacctgaccagcgacgacaccgccgtgtacttctgcaccaccaccagcacctacgacaagtggagcggcctgcaccacgacggcgtgatggccttcagcagctggggccagggcaccctgatcagcgtgagcgccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacc

SEQ ID NO: 34581 - RNA, 645 nt, synthetic construct
  misc_feature 1..645: note = derived and/or modified sequence opt4 from anti-HIV_4P9M_LightChain
  source 1..645: mol_type = other RNA
gacatccagatgacccagagccccagcaccctgagcgccagcatcggcgacaccgtgagaatcagctgcagagccagccagagcatcaccggcaactgggtggcctggtaccagcagagacccggcaaggcccccagactgctgatctacagaggcgccgccctgctgggcggcgtgcccagcagattcagcggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 34582 - RNA, 558 nt, synthetic construct
  misc_feature 1..558: note = derived and/or modified sequence opt4 from anti-HIV_4P9H_C-Chain
  source 1..558: mol_type = other RNA
aagaaggtggtgctgggcaagaagggcgacaccgtggagctgacctgcaccgccagccagaagaagagcatccagttccactggaagaacagcaaccagatcaagatcctgggcaaccagggcagcttcctgaccaagggccccagcaagctgaacgacagagccgacagcagaagaagcctgtgggaccagggcaacttccccctgatcatcaagaacctgaccatcgaggacagcgacacctacatctgcgaggtggaggaccagaaggaggaggtgcagctgctggtgttcggcctgaccgccaacagcgacacccacctgctgcagggccagagcctgaccctgaccctggagagcccccccggcagcagccccagcgtgcagtgcagaagccccagaggcaagaacatccagggcggcaagaccctgagcgtgagccagctggagctgcaggacagcggcacctggacctgcaccgtgctgcagaaccagaagaaggtggagttcaagatcgacatcgtggtgctggccttccagaaggccatcgacggcaga

SEQ ID NO: 34583 - RNA, 462 nt, synthetic construct
  misc_feature 1..462: note = derived and/or modified sequence opt4 from anti-HIV_4YBL_A-Chain
  source 1..462: mol_type = other RNA
gtgcccgtgtggaaggacgccgacaccaccctgttctgcgccagcgacgccaaggcccacgagaccgagtgccacaacgtgtgggccacccacgcctgcgtgcccaccgaccccaacccccaggagatccacctggagaacgtgaccgagaacttcaacatgtggaagaacaacatggtggagcagatgcaggaggacgtgatcagcctgtgggaccagtgcctgcagcccggcggcgcccccaagatcagcttcgaccccatccccatccactactgcacccccgccggctacgtgatcctgaagtgcaacgacaagaacttcaacggcaccggcccctgcaagaacgtgagcagcgtgcagtgcacccacggcatcaagcccgtggtgagcagcggcggcggcaacatcaaggacaactggagaagcgagctgtacaagtacaaggtggtgcagatcgag

SEQ ID NO: 34584 - RNA, 1056 nt, synthetic construct
  misc_feature 1..1056: note = derived and/or modified sequence opt4 from anti-HIV_4R4N_V-Chain
  source 1..1056: mol_type = other RNA
atctggaaggacgccaacaccaccctgttctgcgccagcgacgccaaggcctacgacaccgaggtgcacaacgtgtgggccacccacgcctgcgtgcccaccgaccccagcccccaggagctgaagatggagaacgtgaccgaggagttcaacatgtggaagaacaacatggtggagcagatgcacaccgacatcatcagcctgtgggaccagagcctgaagccctgcgtgcagctgaccggcggcagcgccctgacccaggcctgccccaaggtgaccttcgagcccatccccatccactactgcgcccccgccggctacgccatcctgaagtgcaacgacaaggagttcaacggcaccggcctgtgcaagaacgtgagcaccgtgcagtgcacccacggcatcagacccgtggtgagcacccagctgctgctgaacggcagcctggccgagggcaaggtgatgatcagaagcgagaacatcaccaacaacgtgaagaacatcatcgtgcagctgaacgagagcgtgaccatcaactgcaccagacccaacaacggcggcagcggcagcggcggcgacatcagacaggcccactgcaacgtgagcggcagccagtggaacaagaccctgcaccaggtggtggagcagctgagaaagtactggaacaacaacaccatcatcttcaacagcagcagcggcggcgacctggagatcaccacccacagcttcaactgcggcggcgagttcttctactgcaacaccagcggcctgttcaacagcacctgggtgaacggcaccgccagcatcgagaacggcaccatcaccctgccctgcagaatcaagcagatcatcaacatgtggcagagagtgggccaggccatctacgccccccccatccagggcgtgatcagatgcgtgagcaacatcaccggcctgatcctgaccagagacggcggcggcaacagcaacgagaacgagaccttcagacccggcggcggcgacatgagagacaactggagaagcgagctgtacaagtacaaggtggtgaagatcgag

SEQ ID NO: 34585 - RNA, 1065 nt, synthetic construct
  misc_feature 1..1065: note = derived and/or modified sequence opt4 from anti-HIV_4JKP_G-Chain
  source 1..1065: mol_type = other RNA
gtgtggaaggacgccgacaccaccctgttctgcgccagcgacgccaaggcccacgagaccgagtgccacaacgtgtgggccacccacgcctgcgtgcccaccgaccccaacccccaggagatccacctggagaacgtgaccgagaacttcaacatgtggaagaacaacatggtggagcagatgcaggaggacgtgatcagcctgtgggaccagtgcctgcagccctgcgtgaagctgaccggcggcagcgtgatcaagcaggcctgccccaagatcagcttcgaccccatccccatccactactgcacccccgccggctacgtgatcctgaagtgcaacgacaagaacttcaacggcaccggcccctgcaagaacgtgagcagcgtgcagtgcacccacggcatcaagcccgtggtgagcacccagctgctgctgaacggcagcctggccgaggaggagatcatcatcagaagcgagaacctgaccaacaacgccaagaccatcatcgtgcacctgaacaagagcgtggagatcaactgcaccagacccagcaacggcggcagcggcagcggcggcgacatcagaaaggcctactgcgagatcaacggcaccaagtggaacaaggtgctgaagcaggtgaccgagaagctgaaggagcacttcaacaacaagaccatcatcttccagccccccagcggcggcgacctggagatcaccatgcaccacttcaactgcagaggcgagttcttctactgcaacaccacccagctgttcaacaacacctgcatcggcaacgagaccatgaagggctgcaacggcaccatcaccctgccctgcaagatcaagcagatcatcaacatgtggcagggcaccggccaggccatgtacgccccccccatcgacggcaagatcaactgcgtgagcaacatcaccggcatcctgctgaccagagacggcggcgccaacaacaccagcaacgagaccttcagacccggcggcggcaacatcaaggacaactggagaagcgagctgtacaagtacaaggtggtgcagatcgagggcagc

SEQ ID NO: 34586 - RNA, 723 nt, synthetic construct
  misc_feature 1..723: note = derived and/or modified sequence opt4 from anti-HIV_3BQU_D-Chain
  source 1..723: mol_type = other RNA
atgggctggagctggatcttcctgttcctgctgagcggcaccgccggcgtgcacagcggcgtgcagctgcagcagagcggccccgagctggtgaagcccggcgccagcgtgaagatgagctgcaaggccagcggctacagcttcaccgactacttcatgcactgggtgaagcagagccacggcaagagcctggactggatcggctacatcaactgctacaccggcgccaccaactacagccagaagttcaagggcaaggccaccttcaccgtggacaccagcagcaacaccgcctacatgcagttcaacagcctgaccagcgaggacagcgccgtgtactactgcgccagaaccagcatcggctacggcagcagcccccccttcccctactggggccagggcaccctggtgaccgtgagcgccgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagccccagacccagcgagaccgtgacctgcaacgtggcccaccccgccagcagcaccaaggtggacaagaagatcgtgcccaga

SEQ ID NO: 34587 - RNA, 699 nt, synthetic construct
  misc_feature 1..699: note = derived and/or modified sequence opt4 from anti-HIV_3BQU_C-Chain
  source 1..699: mol_type = other RNA
atgaccatgttcagcctggccctgctgctgagcctgctgctgctgtgcgtgagcgacagcggcgccgagaccaccgtgacccagagccccgccagcctgagcatgagcatcggcgagaaggtgaccatcagatgcatcaccagcaccgacatcgacgacgacatgaactggtaccagcagaagcccggcgagccccccagactgctgatcagcgacggcaacaccctgagacccggcgtgcccagcagattcagcagcagcggctacggcaccgacttcgtgttcaccatcgagaacatgctgagcgaggacgtggccgactactactgcctgcagagcgacaacctgccctacaccttcggcggcggcaccaacctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacaga

SEQ ID NO: 34588 - RNA, 333 nt, synthetic construct
  misc_feature 1..333: note = derived and/or modified sequence opt4 from anti-HIV_Ig_LightChain
  source 1..333: mol_type = other RNA
gacgtggtgctgacccagagccccgccagcctggccgtgagcctgggccagagagccaccatcagctgcaaggccagccagagcgtggactacgacggcgacagctacatgaactggtaccagcagaagcccggccagccccccaagctgctgatccacgccgccagcaacctggtgagcggcatgcccgccagattcagcggcagcggcagcggcaccgacttcaccctgaacatccaccccgtggaggaggaggacgccgccacctactactgccagcagagcatcgaggacccccccaccttcggcggcggcaccaagctggagatcaag

SEQ ID NO: 34589 - RNA, 342 nt, synthetic construct
  misc_feature 1..342: note = derived and/or modified sequence opt4 from anti-HIV_Ig_HeavyChain
  source 1..342: mol_type = other RNA
gacgtgcagctgcagcagagcggccccggcctggtgaagcccagccagagcctgagccacacctgcaccgtgaccggctacagcatcaccagcgactacgcctggaactggatcagacagttccccggcaacaagctggagtggatgggctacatcagcttcagcggcagcaccagctacaaccccagcctgaagagcagaatcagcatcaccagagacaccagcaagaacctgttcttcctgcagctgaacagcgtgaccaccgaggacaccgccacctactactgcgccagaggcctgcccgactactggggccagggcaccaccctgaccgtgagcagc

SEQ ID NO: 34590 - RNA, 1083 nt, synthetic construct
  misc_feature 1..1083: note = derived and/or modified sequence opt4 from anti-HIV_4P9H_G-Chain
  source 1..1083: mol_type = other RNA
gtgtggaaggacgccgacaccaccctgttctgcgccagcgacgccaaggcccacgagaccgagtgccacaacgtgtgggccacccacgcctgcgtgcccaccgaccccaacccccaggagatccacctggagcaggtgaccgagaacttcaacatgtggaagaacaacatggtggagcagatgcaggaggacgtgatcagcctgtgggaccagtgcctgcagccctgcgtgaagctgaccggcggcagcgtgatcaagcaggcctgccccaagatcagcttcgaccccatccccatccactactgcacccccgccggctacgtgatcctgaagtgcaacgacaagaacttcaacggcaccggcccctgcaagaacgtgagcagcgtgcagtgcacccacggcatcaagcccgtggtgagcacccagctgctgctgaacggcagcctggccgaggaggagatcatcatcagaagcgagaacctgaccaacaacgccaagaccatcatcgtgcacctgcagaagagcgtggagatcaactgcaccagacccagcaacggcggcagcggcagcggcggcgacatcagaaaggcctactgcgagatccagggcaccaagtggaacaaggtgctgaagcaggtgaccgagaagctgaaggagcacttcaacaacaagaccatcatcttccagccccccagcggcggcgacctggagatcaccatgcaccacttcaactgcagaggcgagttcttctactgcaacaccacccagctgttccagaacacctgcatcggcaacgagaccatgaagggctgcaacggcaccatcaccctgccctgcaagatcaagcagatcatcaacatgtggcagggcaccggccaggccatgtacgccccccccatcgacggcaagatcaactgcgtgagccagatcaccggcatcctgctgaccagagacggcggcgccaacaacaccagcaacgagaccttcagacccggcggcggcaacatcaaggacaactggagaagcgagctgtacaagtacaaggtggtgcagatcgagggcagccaccaccaccaccaccac

SEQ ID NO: 34591 - RNA, 147 nt, synthetic construct
  misc_feature 1..147: note = derived and/or modified sequence opt4 from anti-HIV_Chain
  source 1..147: mol_type = other RNA
caggtgcagctggtgcagagcggcggccagatgaagaagcccggcgagagcatgagaatcagctgcagagccagcggctacgagttcatcgactgcaccctgaactggatcagactggcccccggcaagagacccgagtggatgggc

SEQ ID NO: 34592 - RNA, 180 nt, synthetic construct
  misc_feature 1..180: note = derived and/or modified sequence opt4 from anti-HIV_Chain
  source 1..180: mol_type = other RNA
ccctgctgcttcgcctacatcgccagacccctgcccagagcccacatcaaggagtacttctacaccagcggcaagtgcagcaaccccgccgtggtgttcgtgaccagaaagaacagacaggtgtgcgccaaccccgagaagaagtgggtgagagagtacatcaacagcctggagatgagc

SEQ ID NO: 34593 - RNA, 249 nt, synthetic construct
  misc_feature 1..249: note = derived and/or modified sequence opt4 from anti-HIV_Chain
  source 1..249: mol_type = other RNA
ctggagtggatgggcagaatcatccccgccatcgacgacgtgacctacgcccagaccttcagaggcagagtgaccttcagcgccgacaagttcaccaccaccgcctacatggacctgaccggcctgagaagcgaggacaccgccacctacttctgcgccagagacccccaggtgaacagaagaggcaactgcttcgaccactggggccagggcaccctggtgaccgtgagcagcgccagcaccaagggc

SEQ ID NO: 34594 - RNA, 270 nt, synthetic construct
  misc_feature 1..270: note = derived and/or modified sequence opt4 from anti-HIV_Chain
  source 1..270: mol_type = other RNA
gacgtggtgatgacccagagccccctgagcctgcccgtgaccctgggccagcccgccagcatcagctgcagaagcagccagagcctggtgtacagccacggcgacacctacctgaagtgcttccagcagagacccggccagagccccagaagacccatctacaaggtgagcaacagagacagcggcgtgcccgacagattcagcggcagcggcagcggcaccgacttcaccctgaagatcagcagagtggaggccgaggacgtgggcgtg

SEQ ID NO: 34595 - RNA, 294 nt, synthetic construct
  misc_feature 1..294: note = derived and/or modified sequence opt4 from anti-HIV_Chain
  source 1..294: mol_type = other RNA
agcagcttcgccatcagctgggtgagacaggcccccggccagggcctggagtggatgggcggcatcatccccatcttcgaggccaccagctacgcccagaagttccaggacagactgaccatcaccaccgacgagagcaccaccaccgcctacatggacctgagcagcctgagaagcgaggacaccgccgtgtactactgcgccagagcccagggcgacatcctgaccgagggctacttcgactactggggccagggcaccctggtgaccgtgagcagcgccagcaccaagggc

SEQ ID NO: 34596 - RNA, 297 nt, synthetic construct
  misc_feature 1..297: note = derived and/or modified sequence opt4 from anti-HIV_Chain
  source 1..297: mol_type = other RNA
aacaccttcaccagccactacgtgcactgggtgagacaggcccccggccagggcctggagtggatgggcatgatcaaccccggcggcaccaccagatacgcccccaagttccaggacagagtgaccctgaccagagacaccagcaccagaaccgtgtacatggagctgagaagcctgagaagcgaggacaccgccgtgtactactgcgccagaccccagtacaacctgggcagagagcccctgaacgtgtggggccagggcaccatggtgaccgtgagcagcgccagcaccaagggc

SEQ ID NO: 34597 - RNA, 297 nt, synthetic construct
  misc_feature 1..297: note = derived and/or modified sequence opt4 from anti-HIV_Chain
  source 1..297: mol_type = other RNA
atcagaagcttctactggcactggatcagacagagccccggcaagggcctggagtggctgggcagcgtgttcgacaacggcctgaccacccacaaccccagcctgaagagcagactgaccatcagcgaggaccccagcagaaaccagatcagcctgaagctgagaagcatgaccgccgccgacaccgccgtgtactactgcgccagaggcgactacgacatcctgaccagcagctaccagttcgactactggggccagggcaccctggtggccgtgagcagcgccagcaccaagggc

SEQ ID NO: 34598 - RNA, 300 nt, synthetic construct
  misc_feature 1..300: note = derived and/or modified sequence opt4 from anti-HIV_Chain
  source 1..300: mol_type = other RNA
cagagcgccctgacccagcccgccttcgtgagcggcagccccggccagagcatcaccctgagctgcaccctgggcaccgaggacgtgagctggtaccagcagagacccaacagcgcccccagactgatcatcttcgacgtgaagaagagacccagcgacgtgagcgacagattcagcggccacaacagcgacaccgccgccttcctgaccatcagcgagctgagacccgaggacgaggccgactacttctgcaccagctggccctacagattcgacagaggcaccaaggtggacgtggcc

SEQ ID NO: 34599 - RNA, 300 nt, synthetic construct
  misc_feature 1..300: note = derived and/or modified sequence opt4 from anti-HIV_Chain
  source 1..300: mol_type = other RNA
cagagcgccctgacccagcccgccttcgtgagcggcagccccggccagagcatcaccctgagctgcaccctgggcaccgaggacgtgagctggtaccagcagagacccaacagcgcccccagactgatcatcttcgacgtgaagaagagacccagcgacgtgagcgacagattcagcggccacaacagcgacaccgccgccttcctgaccatcagcgagctgagacccgaggacgaggccgagtacttctgcaccagctggccctacagattcggcagaggcaccaaggtggacgtggcc

SEQ ID NO: 34600 - RNA, 300 nt, synthetic construct
  misc_feature 1..300: note = derived and/or modified sequence opt4 from anti-HIV_Chain
  source 1..300: mol_type = other RNA
cagagcgccctgacccaccccgccttcgtgagcggcagccccggccagagcatcaccctgagctgcaccctgggcaccgaggacgtgagctggtaccagcagagacccaacagcgcccccagactgatcatcttcgacgtgagaaagagacccagcgaggtgagcgacagattcagcggccacaagagcgacaccgccgccttcctgaccatcagcgacctgagacccgaggacgaggccgagtacttctgcaccagctggccctacagattcgacagaggcaccagactggacgtggcc

SEQ ID NO: 34601 - RNA, 300 nt, synthetic construct
  misc_feature 1..300: note = derived and/or modified sequence opt4 from anti-HIV_Chain
  source 1..300: mol_type = other RNA
cagagcgtgctgacccagcccgccttcgtgagcggcagccccggccagagcatcaccatcagctgcaccgtgggcaccaccgacgtgagctggtaccagcagagacccaacagcgcccccagactgatcatcttcgacgtgaagaagagacccagcggcgtgagcgacagattcagcggcagcagcagcgacaacgccgccttcctgaccatcgccggcctgagacccgaggacgaggccgagtactactgcaccagctggccctacagattcggcagaggcaccaaggtggacgtgggc

SEQ ID NO: 34602 - RNA, 300 nt, synthetic construct
  misc_feature 1..300: note = derived and/or modified sequence opt4 from anti-HIV_Chain
  source 1..300: mol_type = other RNA
cagagcgtgctgacccagcccgccttcgtgagcgccagccccggccagagcatcaccctgagctgcaacctgggcaccgactacgtgagctggtaccagcagagacccagcagcgcccccagactgatcatcttcgacgtgaagaacagacccagcggcgtgagcgacagattcagcggctacaacagcgacaccgccgccttcctgaccatcagcggcctgcagcccgaggacgaggccgagtactactgcaccagctggccctacaacttcggccccggcaccaaggtggacgtgacc

SEQ ID NO: 34603 - RNA, 300 nt, synthetic construct
  misc_feature 1..300: note = derived and/or modified sequence opt4 from anti-HIV_Chain
  source 1..300: mol_type = other RNA
cagagcgtgctgacccagcccgccagcgtgagcggcagccccggccagagcatcaacatcagctgcgccggcagaagcgacagagtgagctggtaccagcagagacccaacggcgtgcccaagctgctgctgttcgacgtgtacagaagacccagcggcgtgagcgacagattcagcggcagccacagcgacgacaccgccttcctgaccatcagcggcctgcagaccgacgacgaggccgactactactgcaccagccacccctacgccttcggccccggcaccaaggtgaacgtgctg

SEQ ID NO: 34604 - RNA, 300 nt, synthetic construct
  misc_feature 1..300: note = derived and/or modified sequence opt4 from anti-HIV_Chain
  source 1..300: mol_type = other RNA
cagagcgtgctgacccagcccgccttcgtgagcggcagccccggccagagcatcaccctgagctgcaccctgggcaccgaggacgtgagctggtaccagcagagacccaacagcgcccccagactgatcatcttcgacgtgaagaagagacccagcgacgtgagcgacagattcagcggccacaacagcgacaccgccgccttcctgaccatcagcgagctgagacccgaggacgaggccgagtacttctgcaccagctggccctacagattcggcagaggcaccaaggtggacgtggcc

SEQ ID NO: 34605 - RNA, 306 nt, synthetic construct
  misc_feature 1..306: note = derived and/or modified sequence opt4 from anti-HIV_Chain
  source 1..306: mol_type = other RNA
cagagcgccctgacccagcccgccagcgtgagcggcagccccggccagagcatcaccatcagctgcaccgccgacagcgactacgtgagctggtaccagcagagacccaacagcgcccccaagctgatcctgttcgacgtgaacagcagacccagcggcgtgagcgacagatacagcggcagcagaagcggcaacaccgccagcctgaccatcagcggcctgcagagagaggacgaggccgactacttctgcaccccctggccctacgacttcagacccggcaccagagtgttcgtgctgggccag

SEQ ID NO: 34606 - RNA, 306 nt, synthetic construct
  misc_feature 1..306: note = derived and/or modified sequence opt4 from anti-HIV_Chain
  source 1..306: mol_type = other RNA
cagagcgccctgacccagcccgccttcgtgagcggcagccccggccagagcatcaccctgagctgcagcctgggcaccgccgacgtgagctggtaccagcagagacccaacagcgcccccagactgatcatcttcgacgtgaagaagagacccagcgacgtgagcgacagattcagcggccacaacagcgacaccgccgccttcgtgaccatcagcgagctgagacccgaggacgaggccgagtacttctgcaccagctggccctacagattcggccccggcaccaaggtggacgtggccagacag

SEQ ID NO: 34607 - RNA, 306 nt, synthetic construct
  misc_feature 1..306: note = derived and/or modified sequence opt4 from anti-HIV_Chain
  source 1..306: mol_type = other RNA
cagagcgtgctgacccagcccgccagcgtgagcggcagccccggccagaccatcagcatcagctgcagcggcaccttcggcagcgacagcgtgagctggtaccagcagttccccaacagcgcccccaccctgatcatcttcgacgtgcacagaagacccagcggcatcagcaccagattcagcggcagcaccagcggcgacaccgccagcctgaccatcagcaccctgcacagagaggacgaggccttctactactgcaccagccacccctacgacttcggcggcggcacctacgtgatcgtgctg

SEQ ID NO: 34608 - RNA, 306 nt, synthetic construct
  misc_feature 1..306: note = derived and/or modified sequence opt4 from anti-HIV_Chain
  source 1..306: mol_type = other RNA
cagagcgtgctgacccagcccgccagcgtgagcggcagccccggccagaccatcagcatcagctgcagcggcaccttcggcagcgacagcgtgagctggtaccagcagtaccccaacagcgcccccaccctgatcatcttcgacgtgcacagaagacccagcggcatcagcaccagattcagcggcagcaccagcggcgacaccgccagcctgaccatcagcaccctgcacagagaggacgaggcctactactactgcaccagccacccctacgacttcggcggcggcacctacgtgatcgtgctg

SEQ ID NO: 34609 - RNA, 306 nt, synthetic construct
  misc_feature 1..306: note = derived and/or modified sequence opt4 from anti-HIV_Chain
  source 1..306: mol_type = other RNA
cagagcgccctgacccagcccgccagcgtgagcggcagccccggccagagcatcaacatcagctgcgccggcagaagcgacagagtgagctggtaccagcagagacccaacggcgtgcccaagctgctgatgttcgacgtgtacagaagacccagcggcgtgagcgacagattcagcggcagccacagcggcgacaccgccttcctgaccatcagcggcctgcagaccgaggacgaggccgactactactgcaccagccacccctacgccttcggcgccggcaccaaggtgaacgtgctgagacag

SEQ ID NO: 34610 - RNA, 306 nt, synthetic construct
  misc_feature 1..306: note = derived and/or modified sequence opt4 from anti-HIV_Chain
  source 1..306: mol_type = other RNA
gacatccagatgacccagagccccagcagcctgagcgccagcgtgggcgacagagtgagcatccactgccaggccggccagggcatcggcagcagcctgaactggtaccagcagaagcccggcagagcccccagactgctggtgcacggcgccagcaacctgcagagaggcgtgcccagcagattcagcggcagcggcttccacaccaccttcaccctgaccatcagcagcctgcagcccgacgacgtggccacctactggtgcgccgccctggagttcttcggccccggcaccaaggtggagatc

SEQ ID NO: 34611 - RNA, 309 nt, synthetic construct
  misc_feature 1..309: note = derived and/or modified sequence opt4 from anti-HIV_Chain
  source 1..309: mol_type = other RNA
gacatccagatgacccagagccccagcagcctgagcgccagcgtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcgtggtgcccggcaccagactggacctgaagagaaccgtggcc

SEQ ID NO: 34612 - RNA, 309 nt, synthetic construct
  misc_feature 1..309: note = derived and/or modified sequence opt4 from anti-HIV_Chain
  source 1..309: mol_type = other RNA
gacatccagatgacccagagccccagcagcctgagcgccagagtgggcgacaccgtgaccatcacctgccaggccaacggctacctgaactggtaccagcagagaagaggcaaggcccccaagctgctgatctacgacggcagcaagctggagagaggcgtgcccgccagattcagcggcagaagatggggccaggagtacaacctgaccatcaacaacctgcagcccgaggacgtggccacctacttctgccaggtgtacgagttcatcgtgcccggcaccagactggacctgaagagaaccgtggcc

SEQ ID NO: 34613 - RNA, 309 nt, synthetic construct
  misc_feature 1..309: note = derived and/or modified sequence opt4 from anti-HIV_Chain
  source 1..309: mol_type = other RNA
gacatccagatgacccagagccccagcagcctgagcgccagagtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcgccgtgcccggcaccagactggacctgaagagaaccgtggcc

SEQ ID NO: 34614 - RNA, 309 nt, synthetic construct
  misc_feature 1..309: note = derived and/or modified sequence opt4 from anti-HIV_Chain
  source 1..309: mol_type = other RNA
gacatccagatgacccagagccccagcagcctgagcgccagcgtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcaggccgaggacatcgccacctacttctgccaggtgtacgagttcgccgtgcccggcaccagactggacctgaagagaaccgtggcc

SEQ ID NO: 34615 - RNA, 309 nt, synthetic construct
  misc_feature 1..309: note = derived and/or modified sequence opt4 from anti-HIV_Chain
  source 1..309: mol_type = other RNA
gacatccagatgacccagagccccagcagcctgagcgccagcgtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcatcgtgcccggcaccagactggacctgaagagaaccgtggcc

SEQ ID NO: 34616 - RNA, 309 nt, synthetic construct
  misc_feature 1..309: note = derived and/or modified sequence opt4 from anti-HIV_Chain
  source 1..309: mol_type = other RNA
gacatccagatgacccagagccccagcagcctgagcgccagagtgggcgacaccgtgaccatcacctgccaggccaacggctacctgaactggtaccagcagagaagaggcaaggcccccaagctgctgatctacgacggcagcaagctggagaccggcgtgcccagcagattcaccggcagaagatggggccaggagtacaacctgaccatcaacaacctgcagcccgaggacatcgccacctacttctgccaggtgtacgagttcatcgtgcccggcaccagactggacctgaagagaaccgtggcc

SEQ ID NO: 34617 - RNA, 312 nt, synthetic construct
  misc_feature 1..312: note = derived and/or modified sequence opt4 from anti-HIV_Chain
  source 1..312: mol_type = other RNA
gacatccagatgacccagagccccagcagcctgagcgccagcgtgggcgacaaggtgaccatcacctgccagaccagcgccggctacctgaactggtaccagcagagaagaggcagagcccccaagctgctgatgtacgacggcagcagactggtgaccggcgtgcccagcagattcagcggcagaagatggggcacccagtacaacctgaccatcggcagcctgcagcccgaggacgtggccacctactactgccaggtgtacgagttcttcggccccggcaccagactggacctgaagagaaccgtggcc

SEQ ID NO: 34618 - RNA, 312 nt, synthetic construct
  misc_feature 1..312: note = derived and/or modified sequence opt4 from anti-HIV_Chain
  source 1..312: mol_type = other RNA
gacatccagatgacccagagccccagcagcctgagcgccagcgtgggcgacaaggtgaccatcacctgccagaccagcgccggctacctgaactggtaccagcagagaagaggcagagcccccaagctgctgatgtacgacggcagcagactggtgaccggcgtgcccagcagattcagcggcagaagatggggcacccagtacaacctgaccatcggcagcctgcagcccgaggacatcgccacctactactgccaggtgtacgagttcttcggccccggcaccagactggacctgaagagcaccgtggcc

SEQ ID NO: 34619 - RNA, 312 nt, synthetic construct
  misc_feature 1..312: note = derived and/or modified sequence opt4 from anti-HIV_Chain
  source 1..312: mol_type = other RNA
gacatccagatgacccagagccccagcagcctgagcgccagagtgggcgacaccgtgaccatcacctgccaggccaacggctacctgaactggtaccagcagagaagaggcaaggcccccaagctgctgatctacgacggcagcaagctggagagaggcgtgcccgccagattcagcggcagaagatggggccaggagtacaacctgaccatcaacaacctgcagcccgaggacgtggccacctacttctgccaggtgtacgagttcatcgtgcccggcaccagactggacctgaagagaaccgtggccgcc

SEQ ID NO: 34620 - RNA, 312 nt, synthetic construct
  misc_feature 1..312: note = derived and/or modified sequence opt4 from anti-HIV_Chain
  source 1..312: mol_type = other RNA
tgcaccgtgagcggcggcagcatcatcagctactactggaactggatcagacagagccccggcaagggcctggagtggctgggctacatcttcgacggcggcagagccaactacaaccccagcctgagaagcagactgaccatgagcgtggacaccagcaagaaccagatcagcctgaaggtgaagagcgtgaccgccgccgacagcgccatctactactgcgccagactggacggcgaggccttcagatactacttcgacagctggggccagggcaccctggtgaccgtgagcagcgccagcaccaagggc

SEQ ID NO: 34621 - RNA, 312 nt, synthetic construct
  misc_feature 1..312: note = derived and/or modified sequence opt4 from anti-HIV_Chain
  source 1..312: mol_type = other RNA
gtgagcggcggcagattcagcaactacggcctgagctgggtgagacaggcccccggccagggcctggagtggatgggcagaatcgtgcccgccatcaacagagccaagtacgcccagaagttccagggcagagtgatcctgaccgccgacaagatcaccgacaccgcctacatggagctgagaagcctgagaagcgaggacaccgccatcttctactgcgccagagacccccagatcgagatcagaggcaacgccttcgacatctggggccagggcaccgtggtgaccgtgagcagcgccagcaccaagggc

SEQ ID NO: 34622 - RNA, 315 nt, synthetic construct
  misc_feature 1..315: note = derived and/or modified sequence opt4 from anti-HIV_Chain
  source 1..315: mol_type = other RNA
agcgacatcagcgtggcccccggcgagaccgccagaatcagctgcggcgagaagagcctgggcagcagagccgtgcagtggtaccagcacagagccggccaggcccccagcctgatcatctacaacaaccaggacagacccagcggcatccccgagagattcagcggcagccccgacagccccttcggcaccaccgccaccctgaccatcaccagcgtggaggccggcgacgaggccgactactactgccacatctgggacagcagagtgcccaccaagtgggtgttcggcggcggcaccaccctgaccgtgctg

SEQ ID NO: 34623 - RNA, 315 nt, synthetic construct
  misc_feature 1..315: note = derived and/or modified sequence opt4 from anti-HIV_Chain
  source 1..315: mol_type = other RNA
agcagcatgagcgtgagccccggcgagaccgccaagatcagctgcggcaaggagagcatcggcagcagagccgtgcagtggtaccagcagaagagcggccagccccccagcctgatcatctacaacaaccaggacagacccagcggcgtgcccgagagattcagcgccacccccgacttcggcgccggcaccaccgccaccctgaccatcaccaacgtggaggccgacgacgaggccgactactactgccacatctacgacgccagaggcggcaccaactgggtgttcgacagaggcgccaccctgaccgtgctg

SEQ ID NO: 34624 - RNA, 315 nt, synthetic construct
  misc_feature 1..315: note = derived and/or modified sequence opt4 from anti-HIV_Chain
  source 1..315: mol_type = other RNA
agcttcgtgagcgtggcccccggccagaccgccagaatcacctgcggcgaggagagcctgggcagcagaagcgtgatctggtaccagcagagacccggccaggcccccagcctgatcatctacaacaacaacgacagacccagcggcatccccgagagattcagcggcagccccggcagcaccttcggcaccaccgccaccctgaccatcaccagcgtggaggccggcgacgaggccgactactactgccacatctgggacagcagaagacccaccaactgggtgttcggcgagggcaccaccctgaccgtgctg

SEQ ID NO: 34625 - RNA, 315 nt, synthetic construct
  misc_feature 1..315: note = derived and/or modified sequence opt4 from anti-HIV_Chain
  source 1..315: mol_type = other RNA
agcttcgtgagcgtggcccccggccagaccgccagaatcacctgcggcgaggagagcctgggcagcagaagcgtgatctggtaccagcagagacccggccaggcccccagcctgatcatgtacaacaaccacgacagacccagcggcatccccgagagattcagcggcagccccggcagcaccttcggcaccaccgccaccctgaccatcaccagcgtggaggccggcgacgaggccgactactactgccacatctgggacagcagaagacccaccaactgggtgttcggcgagggcaccaccctgaccgtgctg

SEQ ID NO: 34626 - RNA, 315 nt, synthetic construct
  misc_feature 1..315: note = derived and/or modified sequence opt4 from anti-HIV_Chain
  source 1..315: mol_type = other RNA
gacatccagatgacccagagccccagcagcctgagcgccagcgtgggcgacaaggtgaccatcacctgccagaccagcgccggctacctgaactggtaccagcagagaagaggcagagcccccaagctgctgatgtacgacggcagcagactggtgaccggcgtgcccagcagattcagcggcagaagatggggcacccagtacaacctgaccatcggcagcctgcagcccgaggacatcgccacctactactgccaggtgtacgagttcttcggccccggcaccagactggacctgaagagcaccgtggccgcc

SEQ ID NO: 34627 - RNA, 315 nt, synthetic construct
  misc_feature 1..315: note = derived and/or modified sequence opt4 from anti-HIV_Chain
  source 1..315: mol_type = other RNA
gacatccagatgacccagagccccagcagcctgagcgccagcgtgggcgacagagtgagcatcaactgccaggccggccagggcctgggcagcagcctgaactggtaccagcagaagcccggcagagcccccaagctgctggtgcacggcgccagcaacctgcagagaggcgtgcccagcagattcagcggcagcggcttccacaccaccttcaccctgaccatcagcagcctgcagcccgacgacgtggccacctacttctgcgccgccttccagtggttcggccccggcaccaaggtggagatcaagagaacc

SEQ ID NO: 34628 - RNA, 318 nt, synthetic construct
  misc_feature 1..318: note = derived and/or modified sequence opt4 from anti-HIV_Chain
  source 1..318: mol_type = other RNA
tgcaccgtgagcggcggcagcatcagcagcgccggctactactggacctggatcagacagcaccccggcaagggcctggagttcatcggctacatctactacatcggcaccacctactacaaccccagcctgaagagcagactgaccatcagcatcgacaccagcaagaaccagttcagcctgaagctgagcagcgtgaccgccgccgacaccgccatctactactgcgccagagactacaccgccagaggcagacacttcttcgactactggggccagggcgccctggtgaccgtgagcagcgccagcaccaagggc

SEQ ID NO: 34629 - RNA, 321 nt, synthetic construct
  misc_feature 1..321: note = derived and/or modified sequence opt4 from anti-HIV_Chain
  source 1..321: mol_type = other RNA
agcagcctgcccctgagcctggcccccggcgccaccgccaagatcccctgcggcgagaagagcagaggcagcagagccgtgcagtggtaccagcagaagcccggccaggcccccaccctgatcatctacaacaaccaggacagacccgccggcgtgagcgagagatacagcggcaaccccgacgtggccatcggcgtgaccgccaccctgaccatcagcagagtggaggccggcgacgaggccgagtactactgccactactgggacagcagaagccccatcagctgggtgttcggcggctggacccagctgaccgtgctg

SEQ ID NO: 34630 - RNA, 321 nt, synthetic construct
  misc_feature 1..321: note = derived and/or modified sequence opt4 from anti-HIV_Chain
  source 1..321: mol_type = other RNA
agcagcctgcccctgagcgtggcccccggcgccaccgccaagatcgcctgcggcgagaagagcttcgccagcagagccgtgcagtggtaccagcagaagcccggccaggcccccgtgctgatcatctacaacaaccaggacagacccgccggcgtgagcgagagattcagcggcacccccgacgtgggcttcggcagcaccgccaccctgaccatcagcagagtggaggccggcgacgaggccgactactactgccacaagtgggacagcagaagccccctgagctgggtgttcggcggcggcacccagctgaccgtgctg

SEQ ID NO: 34631 - RNA, 321 nt, synthetic construct
  misc_feature 1..321: note = derived and/or modified sequence opt4 from anti-HIV_Chain
  source 1..321: mol_type = other RNA
gacatccagatgacccagagccccagcagcctgagcgccagcatcggcgacagagtgaccatcacctgcagagccagccaggacatcgccaactacctgaactggtaccagaagaagagcggcaccccccccaagctgctgatcttcgccgccaccaacctgcacagaggcgtgagccccagattcaccggcagcggccacggcacccacttcagcctgaccatcaccaacgtgcagcacgaggacttcggcaactacttctgccagcagagcttcgccaccgtgggcagcttcggccagggcacctgggtggacatcaga

SEQ ID NO: 34632 - RNA, 321 nt, synthetic construct
  misc_feature 1..321: note = derived and/or modified sequence opt4 from anti-HIV_Chain
  source 1..321: mol_type = other RNA
gacatccagatgacccagagccccagcagcctgagcgccagcatcggcgacagagtgaccatcacctgcagagccagccaggacatcgccaactacctgaactggtaccagaagaagagcggcaccccccccaagctgctgatcttcgccgccaccaacctgcacagaggcgtgagccccagattcaccggcagcggccacggcacccacttcagcctgaccatcaccaacgtgcagcacgaggacttcggccactacttctgccagcagagcttcgccaccgtgggcagcttcggccagggcacctgggtggacatcaga

SEQ ID NO: 34633 - RNA, 321 nt, synthetic construct
  misc_feature 1..321: note = derived and/or modified sequence opt4 from anti-HIV_Chain
  source 1..321: mol_type = other RNA
gacatccagatgacccagagccccagcagcctgagcgccagcgtgggcgacagagtgaccatcacctgcagagccagccaggacatcgccaactacctgaactggtaccagaagaagagcggcaccccccccaagctgctgatcttcgccgccaccaacctgcacagaggcgtgagccccagattcagcggcagcggcagcggcacccacttcagcctgaccatcaccaacgtgcagtacgaggacttcgccaactacttctgccagcacagcttcggcaccatcggcaccttcggccagggcacctgggtggacatcaga

SEQ ID NO: 34634 - RNA, 321 nt, synthetic construct
  misc_feature 1..321: note = derived and/or modified sequence opt4 from anti-HIV_Chain
  source 1..321: mol_type = other RNA
gacatccagatgacccagagccccagcagcctgagcgccagcatcggcgacagagtgaccatcacctgcagagccagccaggacatcgccaactacctgaactggtaccagaagaagagcggcaccccccccaagctgctgatcttcggcgccaccaacctgcaccacggcgtgagccccagattcagcggcagcggccacggcacccacttcagcctgaccatcaccaacgtgcagcacgaggacttcgccaactacttctgccagcagagcttccagaccgtgggcagcttcggccagggcacctgggtggacatcaga

SEQ ID NO: 34635 - RNA, 321 nt, synthetic construct
  misc_feature 1..321: note = derived and/or modified sequence opt4 from anti-HIV_Chain
  source 1..321: mol_type = other RNA
gagatcgtgctgacccagagccccgccaccctgagcctgagccccggcgagaccgccatcatcagctgcagaaccagccagagcggcagcctggcctggtaccagcagagacccggccaggcccccagactggtgatctacagcggcagcaccagagccgccggcatccccgacagattcagcggcagcagatggggcgccgactacaacctgagcatcagcaacctggagagcggcgacttcggcgtgtactactgccagcagtacgagttcttcggccagggcaccaaggtgcaggtggacatcaagagaaccgtggcc

SEQ ID NO: 34636 - RNA, 321 nt, synthetic construct
  misc_feature 1..321: note = derived and/or modified sequence opt4 from anti-HIV_Chain
  source 1..321: mol_type = other RNA
gacatccagatgacccagagccccagcagcctgagcgccagcatcggcgacagagtgaacatcacctgccaggccagcagagacaccggcagcgccctgaactggtaccagcagaaggtgggcagaccccccagactgctgatcagcgccgtgagcaacctgggcgccggcgtgcccagcagattcagcggcagaagaagcggcacccagagcaccctgaccatcaacaccctgcagcccgaggacatcgccacctacttctgccagcactacgagttcttcggccccggcaccaaggtggacatcaagagaaccgtggcc

SEQ ID NO: 34637 - RNA, 321 nt, synthetic construct
  misc_feature 1..321: note = derived and/or modified sequence opt4 from anti-HIV_Chain
  source 1..321: mol_type = other RNA
gacatccagatgacccagagccccagcagcctgagcgccagcgtgggcgacagagtgaccatcacctgccaggccggccagggcatcggcagcagcctgcagtggtaccagcagaagcccggcaaggcccccaagctgctggtgcacggcgccagcaacctgcacagaggcgtgcccagcagattcagcggcagcggcttccacaccaccttcagcctgaccatcagcggcctgcagagagacgacttcgccacctacttctgcgccgtgctggagttcttcggccccggcaccaaggtggagatcaagagaaccgtggcc

SEQ ID NO: 34638 - RNA, 324 nt, synthetic construct
  misc_feature 1..324: note = derived and/or modified sequence opt4 from anti-HIV_Chain
  source 1..324: mol_type = other RNA
agctacgtgagacccctgagcgtggccctgggcgagaccgccagcatcagctgcggcagacaggccctgggcagcagagccgtgcagtggtaccagcacagacccggccaggcccccatcctgctgatctacaacaaccaggacagacccagcggcatccccgagagattcagcggcacccccgacatcaacttcggcaccagagccaccctgaccatcagcggcgtggaggccggcgacgaggccgactactactgccacatgtgggacagcagaagcggcttcagctggagcttcggcggcgccaccagactgaccgtgctg

SEQ ID NO: 34639 - RNA, 324 nt, synthetic construct
  misc_feature 1..324: note = derived and/or modified sequence opt4 from anti-HIV_LightChain
  source 1..324: mol_type = other RNA
gacatcctgatgacccagagccccagcctgctgagcgccagcgtgggcgacagagtgaccatcacctgcaaggccagccaggacgtgagcaccgccgtggcctggtaccagcagaagcccggcaaggcccccaagctgctgatctactgggccagcaccagacacaccggcgtgcccagcagattcaccggcagcggcagcggcaccgacttcaccctgaccatcagcagactgcaggccgaggacttcgccctgtactactgccagcagcactacaccaccccctggaccttcggcggcggcaccaaggtggagatcaagaga

SEQ ID NO: 34640 - RNA, 324 nt, synthetic construct
  misc_feature 1..324: note = derived and/or modified sequence opt4 from anti-HIV_LightChain
  source 1..324: mol_type = other RNA
gacatcgtgatgacccagagccccagcctgctgagcgccagcgtgggcgacagagtgaccatcacctgcaaggccagccaggacgtgagcaccgccgtggcctggtaccagcagaagcccggcaaggcccccaagctgctgatctactgggccagcaccagacacaccggcgtgcccagcagattcagcggcagcggcagcggcaccgacttcaccctgaccatcagcagcctgcagcccgaggacttcgccctgtactactgccagcagcactacaccaccccctggaccttcggcggcggcaccaaggtggagatcaagaga

SEQ ID NO: 34641 - RNA, 324 nt, synthetic construct
  misc_feature 1..324: note = derived and/or modified sequence opt4 from anti-HIV_Chain
  source 1..324: mol_type = other RNA
gacatccagatgacccagagccccagcagcctgagcgccagcgtgggcgacaccgtgaccatcaactgccagaccaacaagggctacctgaactggtaccagcagagaagaggcagagcccccaagctgctgatgtacgacggcagcaagctggtgaccggcgtgcccagcagattcagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgac

SEQ ID NO: 34642 - RNA, 333 nt, synthetic construct
  misc_feature 1..333: note = derived and/or modified sequence opt4 from anti-HIV_Chain
  source 1..333: mol_type = other RNA
ctgagcgcctacgtgggcgacagagtgaccatcacctgcagagccagccagaacatcaacacctacctgaactggtaccagcagagacccggcaaggcccccaagctgctgatctacgccgccagcaccctgcagagcggcgtgcccagcagattcagcggcagcggcagcggcaccgacttcaccctgaccatcagcaacctggagaccgaggacttcgccgtgtactactgccagcagacctacagcagcgtgaccttcggccagggcaccaagctggagaccagaagaaccgtggccgcccccagcgtgttcatcttcccccccagcgac

SEQ ID NO: 34643 - RNA, 333 nt, synthetic construct
  misc_feature 1..333: note = derived and/or modified sequence opt4 from anti-HIV_Chain
  source 1..333: mol_type = other RNA
gagatcgtgctgacccagagccccgccaccctgagcctgagccccggcgagagagccaccctgagctgcagagccagccagggcgtgaacttcgtggtgtggtaccagcagaagagaggccaggcccccagactgctgatctacggcaacagcgacagagtgcccggcgtgcccgacagattcagcgccagaggcagcggcaccgagttcagcctggtgatcagcagcgtggagcccgacgacttcgccctgtactactgccaggagtacagcagcaccccctacaacttcggccccggcaccagagtggacagaaagagaaccgtggccgcc

SEQ ID NO: 34644 - RNA, 336 nt, synthetic construct
  misc_feature 1..336: note = derived and/or modified sequence opt4 from anti-HIV_HeavyChain
  source 1..336: mol_type = other RNA
gaggtgaagctggaggagagcggcggcggcctggtgcagcccggcggcagcagaaagctgagctgcgccgccagcggcttcaccttcagcagcttcggcatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaagctgcccagcctgtgctacggcctgctgggcagcagaaacctgagccacagactgctgagccagaacgacacccccatctgcctg

SEQ ID NO: 34645 - RNA, 336 nt, synthetic construct
  misc_feature 1..336: note = derived and/or modified sequence opt4 from anti-HIV_Chain
  source 1..336: mol_type = other RNA
gagatcgtgctgacccagagccccgccaccctgagcctgagccccggcgagagagccaccctgagctgcagagccagccagggcgtgaacttcgtggtgtggtaccagcagaagagaggccaggcccccagactgctgatctacggccccagcgacagagcccccggcgtgcccgacagattcagcgccagaggcagcggcaccgagttcagcctggtgatcagcagcgtggagcccgacgacttcgccctgtactactgccaggagtacagcagcaccccctacaacttcggcaccggcaccagagtggacagaaagagaaccgtggccgccccc

SEQ ID NO: 34646 - RNA, 336 nt, synthetic construct
  misc_feature 1..336: note = derived and/or modified sequence opt4 from anti-HIV_Chain
  source 1..336: mol_type = other RNA
cagaccctgagcctgacctgcagcgtgagcggcggcagcatcagcagcgccggctactactggggctggatcagacagcaccccggcaagggcctggagtggatcggccacatctactacagcggcaacaccaactacaaccccagcctgaagagcagactgagcatgagcgtggagaccagcaagaaccagttcagcctgaacctggccagcgtgaccgccgccgacaccgccgtgtacttctgcgccagagactacagcgccgccggcagacacctgttcgacagctggggccagggcatcctggtgaccgtgagcagcgccagcaccaagggc

SEQ ID NO: 34647 - RNA, 336 nt, synthetic construct
  misc_feature 1..336: note = derived and/or modified sequence opt4 from anti-HIV_LightChain
  source 1..336: mol_type = other RNA
gacatcgtgatgacccagcagacccccctgaccctgagcatcaccatcggccagcccgccagcatcagctgcaagagcagccagagcctgctggacagcgacggcaagacctacctgaactggctgctgcagagacccggccagagccccaagagactgatctactggatgagcaagctggacagcggcgtgcccgacagattcaccggcagcggcagcggcaccgacttcaccctgaagatcagcagagtggaggccgaggacctgggcgtgtactactgctggcagggcacccacttcccctggaccttcggcggcggcaccaagctggagctg

SEQ ID NO: 34648 - RNA, 339 nt, synthetic construct
  misc_feature 1..339: note = derived and/or modified sequence opt4 from anti-HIV_LightChain
  source 1..339: mol_type = other RNA
gacatcgtgatcacccagagcaccaagttcatgagcaccagcgtgggcgacagagtgagcatcacctgcaaggccagccaggacgtgagcaccgccgtggcctggtaccagcagaagcccggccagagccccaagctgctgatctactgggccagcaccagacacaccggcgtgcccgacagattcaccggcagcggcagcggcaccgactacaccctgaccatcagcagagtgcaggccgaggacctggccctgtactactgccagcagcactacaccaccccctggaccttcggcggcggcaccaagctggagatcaagagaaccgtggccgccccc

SEQ ID NO: 34649 - RNA, 339 nt, synthetic construct
  misc_feature 1..339: note = derived and/or modified sequence opt4 from anti-HIV_Chain
  source 1..339: mol_type = other RNA
gacatccagatgacccagagccccagcagcctgagcgccagagtgggcgacaccgtgaccttcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcgccgtgcccggcaccagactggacctgaagagaaccgtggccgcccccagcgtgttcatcttccccagcgac

SEQ ID NO: 34650 - RNA, 339 nt, synthetic construct
  misc_feature 1..339: note = derived and/or modified sequence opt4 from anti-HIV_Chain
  source 1..339: mol_type = other RNA
cagagcgtgctgacccagcccgccagcgtgagcggcagccccggccagagcatcaccatcagctgcaccggcaccaacagcgacgtgggctacagctacgtgagctggttccagcagcaccccggcaaggtgcccaagctgctgatctacgacgtgagcagaagaagcagcggcgtgagcaacagattcagcggcagcagaagcggcaacaccgccagcctgaccatcagcggcctgagagccgaggacgaggccgactactactgcggcagcttcaccaccagcctgaccctggtgttcggcggcggcaccaagctggccgtgctggtgagccccagc

SEQ ID NO: 34651 - RNA, 339 nt, synthetic construct
  misc_feature 1..339: note = derived and/or modified sequence opt4 from anti-HIV_Chain
  source 1..339: mol_type = other RNA
agcctgagcgccagcgtgggcgacagagtgaccatcacctgcagagccagcgagagcatcagcttctacctgaactggtaccagcagaagcccggcaaggcccccgagctgctgatcttcgccaccagcaccctgcacagcggcgtgcccagcagattcagcggcagcggcagcggcaccgacttcaccctgaccatcagcagcctgcagctggaggacttcgccacctactactgccagcagagcagcagcacccccttcaccttcggcggcggcaccaaggtggagatcaagagaaccgtggccgcccccagcgtgttcatcttcccccccagcgac

SEQ ID NO: 34652 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagcgtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcatcgtgcccggcaccagactggacctgaagagaaccgtggccgcccccagcgtgttcatcttcccccccagcgac

SEQ ID NO: 34653 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagagtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcgccgtgcccggcaccagactggacctgaagagaaccgtggccgcccccagcgtgttcatcttcccccccagcgac

SEQ ID NO: 34654 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagagtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcgtggtgcccggcaccagactggacctgaagagaaccgtggccgcccccagcgtgttcatcttcccccccagcgac

SEQ ID NO: 34655 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagagtgggcgacaccgtgaccttcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcgccgtgcccggcaccagactggacctgaagagaaccgtggccgcccccagcgtgttcatcttcccccccagcgac

SEQ ID NO: 34656 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagcgtgggcgacaccgtgaccatcacctgccaggccaacggctacctgaactggtaccagcagagaagaggcaaggcccccaagctgctgatgtacgacggcagcaccctggagagaggcgtgcccgccagattcagcggcagaagatggggccaggagtacaacctgaccatcaacaacctgcagcccgaggacgtggccacctacttctgccaggtgtacgagttcatcgtgcccggcaccagactggacctgaagagaaccgtggccgcccccagcgtgttcatcttcccccccagcgac

SEQ ID NO: 34657 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagcgtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcaggccgaggacatcgccacctacttctgccaggtgtacgagttcgccgtgcccggcaccagactggacctgaagagaaccgtggccgcccccagcgtgttcatcttcccccccagcgac

SEQ ID NO: 34658 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagcgtgggcgacaccgtgaccttcacctgccaggccaacggctacctgaactggtaccagcagagaagaggcaaggcccccaagctgctgatctacgacggcagcagactggagagaggcgtgcccagcagattcagcggcagaagatggggccaggagtacaacctgaccatcaacaacctgcagcccgaggacatcgccacctacttctgccaggtgtacgagttcgccgtgcccggcaccagactggacctgaagagaaccgtggccgcccccagcgtgttcatcttcccccccagcgac

SEQ ID NO: 34659 - RNA, 342 nt, synthetic construct
  misc_feature 1..342: note = derived and/or modified sequence opt4 from anti-HIV_Chain
  source 1..342: mol_type = other RNA
gacatccagatgacccacagccccagcagcctgagcgccagcgtgggcgacaccgtgaccatcacctgccaggccaacggctacctgaactggtaccagcagagaagaggcaaggcccccaagctgctgatctacgacggcagcaagctggagaccggcgtgcccagcagattcaccggcagaagatggggccaggagtacaacctgaccatcaacaacctgcagcccgaggacatcgccacctacttctgccaggtgtacgagttcatcgtgcccggcaccagactggacctgaagagaaccgtggccgcccccagcgtgttcatcttcccccccagcgac

SEQ ID NO: 34660 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagagtgggcgacaccgtgaccatcacctgccaggccaacggctacctgaactggtaccagcagagaagaggcaaggcccccaagctgctgatctacgacggcagcaagctggagaccggcgtgcccagcagattcaccggcagaagatggggccaggagtacaacctgaccatcaacaacctgcagcccgaggacatcgccacctacttctgccaggtgtacgagttcatcgtgcccggcaccagactggacctgaagagaaccgtggccgcccccagcgtgttcatcttcccccccagcgac

SEQ ID NO: 34661 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagagtgggcgacaccgtgaccttcacctgccaggccaacggctacctgaactggtaccagcagagaagaggcaaggcccccaagctgctgatctacgacggcagcaagctggagagaggcgtgcccagcagattcagcggcagaggctggggccaggagtacaacctgaccatcaacaacctgcagcccgaggacatcgccacctacttctgccaggtgtacgagttcgccgtgcccggcaccagactggacctgaagagaaccgtggccgcccccagcgtgttcatcttcccccccagcgac

SEQ ID NO: 34662 - RNA, 342 nt, synthetic construct
  misc_feature 1..342: note = derived and/or modified sequence opt4 from anti-HIV_Chain
  source 1..342: mol_type = other RNA
gacatccagatgacccagagccccagcagcctgagcgccagcgtgggcgacaccgtgaccatcacctgccaggccaacggctacctgaactggtaccagcagagaagaggcaaggcccccaagctgctgatctacgacggcagcaagctggagagaggcgtgcccagcagattcagcggcagaagatggggccaggagtacaacctgaccatcaacaacctgcagcccgaggacatcgccacctacttctgccaggtgtacgagttcgtggtgcccggcaccagactggacctgaagagaaccgtggccgcccccagcgtgttcatcttcccccccagcgac

SEQ ID NO: 34663 - RNA, 342 nt, synthetic construct
  misc_feature 1..342: note = derived and/or modified sequence opt4 from anti-HIV_Chain
  source 1..342: mol_type = other RNA
agccagagcgtggtgacccaggagcccagcctgaccgtgagccccggcggcaccgtgaccctgacctgcggccccagcaccggcgccgtgaccagcggcttctacccccactggttccagcagaagcccggccaggcccccagagccctgatctacagcaccagcaacaagtacagctggacccccgccagattcagcggcagcctgctgggcggcaaggccgtgctgaccctgagcgacgtgcagcccgacgacgaggccgagtactactgcctgctgctgctgtactacggcggcccctggatcttcggcggcggcaccaagctgaccgtgctggtgagc

SEQ ID NO: 34664 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagcgtgggcgacaaggtgaccatcacctgccagaccagcgccggctacctgaactggtaccagcagagaagaggcagagcccccaagctgctgatgtacgacggcagcagactggtgaccggcgtgcccagcagattcagcggcagaagatggggcacccagtacaacctgaccatcggcagcctgcagcccgaggacgtggccacctactactgccaggtgtacgagttcttcggccccggcaccagactggacctgaagagaaccgtggccgcccccagcgtgttcatcttcccccccagcgac

SEQ ID NO: 34665 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagcgtgggcgacaccgtgaccatcacctgccagaccaccaagggctacctgaactggtaccagcagagaagaggcagagcccccaagctgctgatgttcgacggcagcaagctggtgaccggcgtgcccagcagattcagcggcagaagatggggcacccagtacaacctgaccatcggcagcctgcagcccgaggacctggccacctactactgccaggtgtacgagttcttcggccccggcaccagactggacctgaagagaaccgtggccgcccccagcgtgttcatcttcccccccagcgac

SEQ ID NO: 34666 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagcgtgggcgacaccgtgaccatcacctgccagaccaacaagggctacctgaactggtaccagcagagaagaggcagagcccccaagctgctgatgtgcgacggcagcaagctggtgaccggcgtgcccagcagattcagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgtgttcatcttcccccccagcgac

SEQ ID NO: 34667 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagagtgggcgacaaggtgaccatcacctgccagaccagcgccggctacctgaactggtaccagcagagaagaggcagagcccccaagctgctgatgtacgacggcagcagactggtgaccggcgtgcccagcagattcagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgtgttcatcttcccccccagcgac

SEQ ID NO: 34668 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagcgtgggcgacaccgtgaccatcacctgccagaccaacaagggctacctgaactggtaccagcagaagagaggcagagcccccaagctgctgatgtacgacggcagcaagctggtgaccggcgtgcccagcagactgagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgtgttcatcttcccccccagcgac

SEQ ID NO: 34669 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagcgtgggcgacaccgtgaccatcacctgccagaccaacaagggctacctgaactggtaccagcagagaagaggcagagcccccaagctgctgatgtacgacggcagcaagctggtgaccggcgtgcccagcagactgagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgtgttcatcttcccccccagcgac

SEQ ID NO: 34670 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagcgtgggcgacaccgtgaccatcacctgccacaccaacaagggctacctgaactggtaccagcagagaagaggcagagcccccaagctgctgatgttcgacggcagcaagctggtgaccggcgtgcccagcagattcagcggcagaagatggggcacccagtacaacctgaccatcggcagcctgcagcccgaggacatcgccacctactactgccaggtgtacgaggtgttcggccccggcaccagactggacctgaagagaaccgtggccgcccccagcgtgttcatcttcccccccagcgac

SEQ ID NO: 34671 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagcgtgggcgacaccgtgaccatcaactgccagaccaacaagggctacctgaactggtaccagcagagaagaggcagagcccccaagctgctgatgtacgacggcagcaagctggtgaccggcgtgcccagcagattcagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgtgttcatcttcccccccagcgac

SEQ ID NO: 34672 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagagtgggcgacaaggtgaccatcacctaccagaccagcgccggctacctgaactggtaccagcagagaagaggcagagcccccaagctgctgatgtacgacggcagcagactggtgaccggcgcccccagcagattcagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgtgttcatcttcccccccagcgac

SEQ ID NO: 34673 - RNA, 345 nt, synthetic construct
  misc_feature 1..345: note = derived and/or modified sequence opt4 from anti-HIV_Chain
  source 1..345: mol_type = other RNA
gacatccagatgacccagagccccagcagcctgagcgccagcgtgggcgacaccgtgaccatcacctgccagaccaacaagggctacctgaactggtaccagcagagaagaggcagagcccccaagctgctgatgtacgacggcagcaagctggtgaccggcgtgcccagcagattcagcggcagaagatggggcacccagtacaacctgaccatcggcagcctgcagcccgaggacatcgccacctactactgccaggtgtacgagttcttcggccccggcaccagactggacctgaagagaaccgtggccgcccccagcgtgttcatcttcccccccagcgac

SEQ ID NO: 34674 - RNA, 345 nt, synthetic construct
  misc_feature 1..345: note = derived and/or modified sequence opt4 from anti-HIV_Chain
  source 1..345: mol_type = other RNA
gtgaccctgagcctgagccccggcgagagagccaccctgagctgcagagccagccagaccatcagcaacaactacctggcctggtaccagcagaagcccggccaggcccccagactgctgatctacggcgccagcagcggcgccaccggcctgcccgacagattcagcggcagcggcagcggcaccgacttcaccctgaccatcagcagactggagcccgaggacttcgccgtgtactactgccaccagtacgccctgagcccctggaccttcggcagaggcaccaaggtggagatcaagagaaccgtggccgcccccagcgtgttcatcttcccccccagcgac

SEQ ID NO: 34675 - RNA, 345 nt, synthetic construct
  misc_feature 1..345: note = derived and/or modified sequence opt4 from anti-HIV_Chain
  source 1..345: mol_type = other RNA
accctgagcgccagcgtgggcgacagagtgaccatcacctgcagagccagccagagcatcaacaactacctgaactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgtgacctactactgccagcagacctacagcaaccccagaatgttcggccagggcaccaaggtggagatcaagagaaccgtggccgcccccagcgtgttcatcttcccccccagcgacgagcag

SEQ ID NO: 34676 - RNA, 345 nt, synthetic construct
  misc_feature 1..345: note = derived and/or modified sequence opt4 from anti-HIV_Chain
  source 1..345: mol_type = other RNA
cagagcgccctgacccaggcccccagcgccagcggcacccccggccagagagtgaccatcagctgcagcggcggcggcagcaacatcggcggcaacctggtgagctggtaccagcacttccccggcgccgcccccaagctgctgatctacagaaacgaccagagacccagcggcgtgcccgacagattcagcgccagcaagagcggcaccagcgccagcctggccatcagcggcctgagaagcgacgacgaggccacctacttctgcgccgcctacgacagcaccctgagcctgagactgttcggcggcggcaccaccctggccgtgctgagccagcccaaggcc

SEQ ID NO: 34677 - RNA, 345 nt, synthetic construct
  misc_feature 1..345: note = derived and/or modified sequence opt4 from anti-HIV_Chain
  source 1..345: mol_type = other RNA
aagcccagccagaccctgagcctgacctgcaccgtgagcggcggcagcatcagcagcgccggctactactggacctggatcagacaccaccccggcaagggcctggagttcatcggctacatctaccacatcggcaccccctactacaaccccagcctgaagagcagactgaccatcagcatcgacaccagcaagaaccagttcagcctgaagctgagcagcgtgaccgccgccgacaccgccatctactactgcgccagagactacaccgccagaggcagacacttcttcgactactggggccagggcgccctggtgaccgtgagcagcgccagcaccaagggc

SEQ ID NO: 34678 - RNA, 345 nt, synthetic construct
  misc_feature 1..345: note = derived and/or modified sequence opt4 from anti-HIV_Chain
  source 1..345: mol_type = other RNA
cccagcgagaccctgagcctgacctgcagagtgagcggcgccagcatcagcaacttctactggacctggatcagacagcccgccggcaagggcctggagtggatcggcagactgtacagcagcgacaagaccaactacaaccccagcctgaacggcagagtgaccatgagcctggacaccagcaagaaccagttcagcctgagactgaccagcatgaccgacgccgacaccgccatctactactgcgccagagagaagggccagtgggtgaccctgcccccctactacttcgacagctggggccagggcatcctggtgaccgtgagcagcgccagcaccaagggc

SEQ ID NO: 34679 - RNA, 348 nt, synthetic construct
  misc_feature 1..348: note = derived and/or modified sequence opt4 from anti-HIV_Chain
  source 1..348: mol_type = other RNA
ggccccgccaccctgagcgtgagccccggcgagagagccaccctgagctgcagagccagccagagcctgagaaacaacctggcctggtaccagcagaagaccggccagagccccagactgctgatctacgccgtgagcaccagagccaccggcatcccccccagattcagcggcggcggcagcggcaccgagttcaccctgaccatcgacagcctgcagagcgaggacttcgccgtgtacttctgccagcagtacgacagcccccagtggaccttcggccagggcaccaaggtggagatcaagagaaccgtggccgcccccagcgtgttcatcttcccccccagcgac

SEQ ID NO: 34680 - RNA, 348 nt, synthetic construct
  misc_feature 1..348: note = derived and/or modified sequence opt4 from anti-HIV_Chain
  source 1..348: mol_type = other RNA
gcccccgtgaccctgagcgccagcgtgggcgacaccgtgaccatcacctgcagagccagccagcccatcgccaccttcctgaactggtaccagcacaagcccggccaggcccccaagctgctgatctacgccgccagcaccttccagagaggcgcccccagcagatacagcggcagcggcagcggcaccgacttcaccctgaccatcaacagcctgcagcccgaggacctggccacctactactgccagcagaccttcaccgaccccgtgaccttcggccagggcaccagactggagatcaagagaaccgtggccgcccccagcgtgttcatcttcccccccagcgac

SEQ ID NO: 34681 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcggctggctggcctggtaccaccagagacccggcaaggcccccagactgctgatctacagaggcagcagactgctgggcggcgtgcccagcagattcagcggcagcgccgccggcaccgacttcaccctgaccatcgccaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34682 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcaactgggtggcctggtaccagcagagacccggcaaggcccccagactgctgatctacagaggcgccgccctgctgggcggcgtgcccagcagattcagcggcagcgccgccggcaccgacttcaccctgaccatcggcaacctgcagaccgaggacttcggcaccttctactgccagcagtacgacacctaccccggcaccttcggccagggcaccaaggtggaggtgaagagaaccgtggccgcccccagcgtgttc

SEQ ID NO: 34683 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcaactgggtggcctggtaccagcagagacccggcaaggcccccagactgctgatctacagaggcgccgccctgctgggcggcgtgcccagcagattcagaggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34684 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcgtgggcgacaccgtgagaatcagctgcagagccagccagagcatcaccggcggctggctggcctggtaccaccagagacccggcaaggcccccagactgctgatctacagaggcagcagactgctgggcggcgtgcccagcagattcagcggcagcgccgccggcaccgacttcaccctgaccatcgccaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34685 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcaactgggtggcctggtaccagcagagacccggcaaggcccccagactgctgatctacagaggcgccgccctgctgggcggcgtgcccagcagattcagcggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34686 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcggctgggtggcctggtaccaccagagacccggcaaggcccccagactgctgatctacagaggcagcagactgctgggcggcgtgcccagcagattcagcggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34687 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcgtgggcgacaccgtgagaatcagctgcagagccagccagagcatcaccggcggctggctggcctggtaccaccagagacccggcaaggcccccagactgctgatctacagaggcagcagactgctgggcggcgtgcccagcagattcagcggcagcgccgccggcaccggcttcaccctgaccatcgccaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34688 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcgtgggcggcaccgtgagaatcagctgcagagccagccagagcatcaccggcggctggctggcctggtaccaccagagacccggcaaggcccccagactgctgatctacagaggcagcagactgctgggcggcgtgcccagcagattcagcggcagcgccgccggcaccgacttcaccctgaccatcgccaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34689 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcaactgggtggcctggtaccaccagagacccggcaaggcccccagactgctgatctacagaggcgccgccctgctgggcggcgtgcccagcagattcagcggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34690 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgatgatcagctgcagagccagccagagcatcaccggcggctggctggcctggtaccaccagagacccggcaaggcccccagactgctgatctacagaggcagcaagctgctgggcggcgtgcccagcagattcagcggcagcgccgccggcaccggcttcaccctgaccatcggcaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34691 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcgtgggcgacaccgtgagaatcagctgcagagccagccagagcatcaccggcggctggctggcctggtaccaccagagacccggcaaggcccccagactgctgatctacagaggcagcagactgctgggcggcgtgcccagcagattcagcggcagcgccgccggcgccgacttcaccctgaccatcgccaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34692 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcggctggctggcctggtaccaccagagacccggcaaggcccccagactgctgatctacagaggcagcagactggtgggcggcgtgcccagcagattcagcggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34693 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcggctggctggcctggtaccaccagagacccggcaaggcccccagactgctgatctacagaggcagcagactgctgggcggcgtgcccagcaagttcagcggcagcgccgccggcaccgacttcaccctgaccatcgccaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34694 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcaccggcgacaccgtgagaatcagctgcagagccagccagagcatcaccggcaactgggtggcctggtaccagcagagacccggcaaggcccccagactgctgatctacagaggcgccgccctgctgggcggcgtgcccagcagattcagaggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34695 - RNA, 351 nt, synthetic construct
  misc_feature 1..351: note = derived and/or modified sequence opt4 from anti-HIV_LightChain
  source 1..351: mol_type = other RNA
gacatccagatgacccagagccccagcaccctgagcgccagcatcggcgacaccgtgagaatcagctgcagagccagccagagcatcaccggcaactggctggcctggtaccaccagagacccggcaaggcccccagactgctgatctacagaggcagcagactgctgggcggcgtgcccagcagattcagcggcagcgccgccggcaccgacttcaccctgaccatcgccaacctgcaggccgaggacttcggcaccttctactgccagcagtacgacacctaccccggcaccttcggccagggcaccaaggtggaggtgaagagaaccgtggccgcccccagcgtgttc

SEQ ID NO: 34696 - RNA, 351 nt, synthetic construct
  misc_feature 1..351: note = derived and/or modified sequence opt4 from anti-HIV_Chain
  source 1..351: mol_type = other RNA
atcatcctgttcctggtggccaccgccaccggcagctgggcccagagcgccctgacccagcccagaagcgtgagcggcagcctgggccagagcgtgaccatcagctgcaccggcagcagcagcgacgtgggcagatacaactacgtgagctggtaccagcaccaccccggcaaggcccccaagctgatgatcagcgacgtgaacaagagacccagcggcgtgcccgacagattcagcggcagcaagagcggcaacaccgccagcctgaccatcagcggcctgcaggccgaggacgagaccgactactactgctgcagctacgccggcagctacatctgggtgttcggcggc

SEQ ID NO: 34697 - RNA, 351 nt, synthetic construct
  misc_feature 1..351: note = derived and/or modified sequence opt4 from anti-HIV_Chain
  source 1..351: mol_type = other RNA
cccgtgaccctgagcgccagcgtgggcgacagagtgaccatcacctgcagagccagcgaggacatcagcaagtacctgaactggtaccagcacaagcccggcaaggcccccaagctgctgatctacaccgccagcagcctggagaccggcgtgcccagcagattcagcggcagcggcagcggcaccgacttcagcctgaccatcagcagcctgcagcccgacgacttcgccacctactactgccagcagagctacaccagcagcgtgaccttcggccagggcaccagagtggaggtgaagagaaccgtggccgcccccagcgtgttcatcttcccccccagcgacgagcag

SEQ ID NO: 34698 - RNA, 351 nt, synthetic construct
  misc_feature 1..351: note = derived and/or modified sequence opt4 from anti-HIV_Chain
  source 1..351: mol_type = other RNA
gtggaggagcccggcagcagcgtgaaggtgagctgcaaggccagcggcggcagcagcaccgcctacggctacagctgggtgagacaggcccccggccagggcttcgagtggatgggcagaatcatccccttctacggcatcatcacctacgcccccaagttccagggcagagtgaccatcaccgccgacagaagcaccagcaccgtgtacatggagctgaccagactgaccttcgccgacaccgccctgttcttctgcgccagagactacggcgaccccagaaacggctactacttcgacagctgggaccagggcctgtggctgaccgtgagcagcgccagcaccaagggc

SEQ ID NO: 34699 - RNA, 351 nt, synthetic construct
  misc_feature 1..351: note = derived and/or modified sequence opt4 from anti-HIV_Chain
  source 1..351: mol_type = other RNA
caggtgagactggagcagagcggcgccgccgtgagaacccccggcgccagcgtgaccctgagctgccaggccagcggctacaagttcgtgaactacatcatccactgggtgagacagagacccggcctggccttcgagtgggtgggcatgatcgacccctacagaggcagaccctggagcgcccacagcttcgagggcagactgagcctgagcagagacgtgagcatggagatcctgtacatgaccctgaccagcctgagaagcgacgacaccgccacctacttctgcgccagagccgaggccgagagccagagccacagcagacccatcatcagcaccagcggcgccaga

SEQ ID NO: 34700 - RNA, 351 nt, synthetic construct
  misc_feature 1..351: note = derived and/or modified sequence opt4 from anti-HIV_Chain
  source 1..351: mol_type = other RNA
gtgcacctggaggtgcagctgcagcagagcggccccgagctgaagaagcccggcgagaccgtgaagatcagctgcaaggccagcgtgtacaccttcaccgagtaccccatccactgggtgaagcaggcccccggcaagggcttcaagtggatgggctggatcaacacctacagcggcgagcccacctacgccgacgacttcaagggcagattcgccttcagcctggagaccagcgccagcaccgcctacctgcagatcaacagcctgaagaacgaggacaccgccacctacttctgcgccagcctgggcagagactactggggccagggccagggcaccaccctgaccgtg

SEQ ID NO: 34701 - RNA, 354 nt, synthetic construct
  misc_feature 1..354: note = derived and/or modified sequence opt4 from anti-HIV_Chain
  source 1..354: mol_type = other RNA
ctgagcgtgagcctgggcgagagagccaccatcaactgcaagagcagccagagcatcctgtacagcagcgacaagaagaactacctggcctggtaccagcagaagatcggccagccccccaagctgctgctgtactgggccagcaccagagagagcggcatccccgacagattcagcggcagcggcagcggcagcgacttcaccctgaccatcagcagcctgcagcccgaggacgtggccgtgtactactgccagcagtactacatcagccccttcaccttcggccccggcaccaaggtggacctgaagagaaccgtggccgcccccagcgtgttcatcttcccccccagcgac

SEQ ID NO: 34702 - RNA, 354 nt, synthetic construct
  misc_feature 1..354: note = derived and/or modified sequence opt4 from anti-HIV_Chain
  source 1..354: mol_type = other RNA
cagagcgtgctgacccagccccccagcgccagcggcgcccccggccagagagtgaccatcagctgcagcggcggccccagcaacgtgggcggcaactacgtgtactggtacagacagttccccggcaccgcccccaagctgctgatcctgagagacgaccagagacccagcggcgtgcccgacagattcagcgccagcaagagcggcaacagcgccagcctggccatcagcggcctgagacccgacgacgaggccttctacttctgcgccacctacgacagcgacggcagcatcagactgttcggcggcggcaccgccctgaccgtgctgagccagcccaaggccgcccccagc

SEQ ID NO: 34703 - RNA, 354 nt, synthetic construct
  misc_feature 1..354: note = derived and/or modified sequence opt4 from anti-HIV_Chain
  source 1..354: mol_type = other RNA
aaggcccccgccaccctgagcctgagccccggcgagagagccaccctgagctgcagagccagccagagcgtgggcagcgacctggcctggtaccagcagaagcccggccaggcccccagactgctgatctacgacgccagcaacagagccaccgccatccccgccagattcagcggcagcggcagcggcaccgacttcaccctgagcatcagcagcctggagcccgaggacttcgccgtgtacttctgccagcagagatacgacaagatcaccttcggccagggcaccagactggagatccagagaaccgtggccgcccccagcgtgttcatcttcccccccagcgacgagcag

SEQ ID NO: 34704 - RNA, 354 nt, synthetic construct
  misc_feature 1..354: note = derived and/or modified sequence opt4 from anti-HIV_Chain
  source 1..354: mol_type = other RNA
caggtgcagctggtgcagagcggcgccgaggccaagagacccggcgacagcgtgaaggtgagctgcaaggccagcggctacaccttcaccgagtactacatccactgggtgagacagacccccggccagggcttcgagtggatgggcatcatcacccccggcgccggcaacaccacctacgcccagaagttccagggcagaatcaccgtgaccagagacaccagcgccgccaccgtgtacatggagctgagcaacctgaccagcgaggacaccgccgtgtacttctgcagcagaggcgtgagcttctggggccagggcaccctggtgaccgtgagcagcgccagcaccaagggc

SEQ ID NO: 34705 - RNA, 354 nt, synthetic construct
  misc_feature 1..354: note = derived and/or modified sequence opt4 from anti-HIV_HeavyChain
  source 1..354: mol_type = other RNA
gaggtgaagctgcagcagagcggcgccgagctggtgagacccggcgccagcgtgaagatgagctgcaaggccagcggctacagattcaccagctacaacatgcactgggtgaagcagacccccagacagggcctggagtggatcggcgccatctaccccggcaacggcgacaccagctacaaccagaagttcaagggcaaggccaccctgaccgtggacaagagcagcagcaccgcctacatgcagctgagcagcctgaccagcgaggacagcgccgtgtacttctgcgccagaggcagactgagcctgggcttcgactactggggccagggcagcaccctgaccgtgagcagc

SEQ ID NO: 34706 - RNA, 357 nt, synthetic construct
  misc_feature 1..357: note = derived and/or modified sequence opt4 from anti-HIV_Chain
  source 1..357: mol_type = other RNA
caggtgcagctggtgcagagcggcaccgccgtgaagagacccggcgccagcgtgagagtgagctgccaggccagcggctacaccttcatcgaccacttcatctactggtggagacaggcccccggccagggcctggagtggctgggctggatcaaccccctgaccagccagcccagctaccccagcagattccagggcagactgaccctgaccagagacaccttcgacgagatgctgtacatggacctgagaggcctgagaagcgacgacaccggcatctacttctgcgccagaagacacagcgactactgcgacttcgacatctggggcagcggcacccagatcatcgtgagcagc

SEQ ID NO: 34707 - RNA, 357 nt, synthetic construct
  misc_feature 1..357: note = derived and/or modified sequence opt4 from anti-HIV_Chain
  source 1..357: mol_type = other RNA
caggtgcagctggtgcagagcggcaccgccgtgaagagacccggcgccagcgtgagagtgagctgccaggccagcggctacaccttcaccgactacttcatctactggtggagacaggcccccggccagggcctggagtggctgggctggatcaaccccctgaccagccagcccagctaccccagcagattccagggcagactgaccctgaccagagacaccttcgacgagatgctgtacatggacctgagaggcctgagaagcgacgacaccggcatctacttctgcgccagaagacacagcgactactgcgacttcgacatctggggcagcggcacccagatcatcgtgagcagc

SEQ ID NO: 34708 - RNA, 357 nt, synthetic construct
  misc_feature 1..357: note = derived and/or modified sequence opt4 from anti-HIV_Chain
  source 1..357: mol_type = other RNA
cagagcgtgctgacccagcccagaagcgtgagcggcagccccggccagagcgtgaccatcagctgcaccggcaccagcagcgacgtgggcggctacaactacgtgagctggtaccagcagcaccccggcaaggcccccaagaccatgatcttcgacgtgaccaagagacccagcggcgtgcccgacagattcagcggcagcaagagcggcaacaccgccagcctgaccatcagcggcctgcaggccgaggacgaggccgactactactgcagcagctacgccggcagaaacaccttctacgtgttcggcaccggcaccaccgtgaccgtgcaggtgagccccagccagccccccccc

SEQ ID NO: 34709 - RNA, 357 nt, synthetic construct
  misc_feature 1..357: note = derived and/or modified sequence opt4 from anti-HIV_Chain
  source 1..357: mol_type = other RNA
gagatcgtgctgacccagagccccggcaccctgagcctgagccccggcgagagagccaccctgagctgcagagccagccagagcgtgagcagcaactacctggcctggtaccagcagaagcccggccaggcccccagactgctgatctacggcgccagcagcagagccaccggcatccccgacagattcagcggcagcggcagcggcaccgacttcaccctgagcatcagcagactggagcccgaggacttcgccgtgtactactgccagcagtacggcaccagcagctgcaccttcggccagggcaccaagctggagatcaagagaaccgtggccgcccccagcgtgttcatcttc

SEQ ID NO: 34710 - RNA, 357 nt, synthetic construct
  misc_feature 1..357: note = derived and/or modified sequence opt4 from anti-HIV_Chain
  source 1..357: mol_type = other RNA
ctgagcgccagcgtgggcgacagagtgaccatcacctgcagagccagccagagcatcgacagatacctgaactggtaccagcagaagcccggcaaggcccccaagctgctgatctacgccgccagcagcctgcacaccgacgtgcccagcagattcagcggcagcggcgccggcacctacttcaccctgaccatcaccagcctgcagcccgaggacttcgccacctactactgccagcagagccacagccccagcttcggccaggagagctacagcatcaccttcggccagggcaccagactggagatcaagagaaccgtggccgcccccagcgtgttcatcttcccccccagcgac

SEQ ID NO: 34711 - RNA, 357 nt, synthetic construct
  misc_feature 1..357: note = derived and/or modified sequence opt4 from anti-HIV_Chain
  source 1..357: mol_type = other RNA
aacttcatgctgacccaggcccccagcgccagcggcgcccccggccagagagtgaccatcagctgcagcggcggccccagcaacgtgggcggcaactacgtgtactggtacagacagtaccccggcaccgcccccaagctgctgatcctgagagacgaccagagacccagcggcgtgcccgacagattcagcgccagcaagagcggcaacagcgccagcctggccatcagcgagctgagacccgacgacgaggccttctacttctgcgccacctacgacagcgacggcagcatcagactgttcggcggcggcaccgccctgaccgtgctgagccagcccaaggccgcccccagcgtg

SEQ ID NO: 34712 - RNA, 360 nt, synthetic construct
  misc_feature 1..360: note = derived and/or modified sequence opt4 from anti-HIV_Chain
  source 1..360: mol_type = other RNA
gacatccagatgacccagagccccagcagcctgagcgccagcatcggcgacagagtgaacatcacctgccaggccagcagagacaccggcagcgccctgaactggtaccagcagaaggtgggcagaccccccagactgctgatcagcgccgtgagcaacctgggcgccggcgtgcccagcagattcagcggcagaagaagcggcacccagagcaccctgaccatcaacaccctgcagcccgaggacatcgccacctacttctgccagcactacgagttcttcggccccggcaccaaggtggacatcaagagaaccgtggccgcccccagcgtgttcatcttcccccccagcgacgagcag

SEQ ID NO: 34713 - RNA, 360 nt, synthetic construct
  misc_feature 1..360: note = derived and/or modified sequence opt4 from anti-HIV_Chain
  source 1..360: mol_type = other RNA
cagagcgtgctgacccagcccgccagcgtgagcggcagccccggccagagcatcaccatcagctgcaccggcaccagcaacgacgtgggcggccagaacttcgtgagctggtaccagcagcaccccggcaccgccccccagctgctgatctacgacgtgaccaacagacccgccggcgtgagcagcagattcagcggcagcaagagcggcaacaccgccagcctgaccatcagcggcctgagaaccgaggacgaggccgactactactgcgccagcttcaccatcctgaacggcgtggactacgtgttcggcaccggcaccaaggtgaccgtgctgctgagccccagccagccctacctg

SEQ ID NO: 34714 - RNA, 360 nt, synthetic construct
  misc_feature 1..360: note = derived and/or modified sequence opt4 from anti-HIV_Chain
  source 1..360: mol_type = other RNA
aacttcatgctgacccagcccgccagcgtgagcggcagccccggccagagcatcaccctgagctgcaccggcaccaccagcgacgtgagagacagcaacttcgtgagctggtaccagcaggtgcccggcaaggcccccaagctgatcatctacgacgtgagcgccagacccagcggcgtgagcttcagattcagcggcagcaagagcggcaacaccgccagcctgaccatcagcggcctgcaggccgaggacgaggccctgtactactgcagcagcttcacccccaccaacaccctggtgttcggcggcggcaccaagctgaccgtgctgggccagcccaaggccgcccccagcgtgacc

SEQ ID NO: 34715 - RNA, 360 nt, synthetic construct
  misc_feature 1..360: note = derived and/or modified sequence opt4 from anti-HIV_Chain
  source 1..360: mol_type = other RNA
cagagcgccctgacccagccccccgccgccagcggcgcccccggccagagagtgaccatcagctgcagcggcggcggcagcaacgtgggcggcaacctggtgagctggtaccagcagttccccggcgccgcccccaagctgatcctgcacagagacggccagagacccagcggcgtgcccgacagattcagcgccagcaagagcggcaccagcgccagcctgaccatcagcggcctgagaagcgacgacgaggccacctacttctgcgccgcctacgacagcgccgtgagcctgcccgtgttcggcggcggcaccaagctgaccgtgctgagccagcccaaggccgcccccctggtgacc

SEQ ID NO: 34716 - RNA, 360 nt, synthetic construct
  misc_feature 1..360: note = derived and/or modified sequence opt4 from anti-HIV_Chain
  source 1..360: mol_type = other RNA
cagctggtgctgacccagccccccagcgtgagcggcacccccggccagaacgtgaccatcagctgcagcggcggcggcagccacgtgggcggcaacctggtgagctggtaccagcacttccccggcgccgcccccaagctgctgatccacagagacaaccagagacccagcggcgtgcccgacagattcagcgccctgaagagcggcaacagcgccagcctggccatcagcggcctgagaagcgacgacgaggccttctacttctgcgccgtgtacgacagcagcctgagcctgggcctgttcggcggcggcaccaagctgaccgtgctgagccagcccaaggccgcccccagcgtgacc

SEQ ID NO: 34717 - RNA, 360 nt, synthetic construct
  misc_feature 1..360: note = derived and/or modified sequence opt4 from anti-HIV_Chain
  source 1..360: mol_type = other RNA
gacatccagatgacccagagccccagcagcctgagcgccagcgtgggcgacagagtgagcatccactgccaggccggccagggcatcggcagcagcctgaagtggtaccagcagaagagcggcagagcccccagactgctggtgcacggcgccagcaacctgcagagaggcgtgcccagcagattcagcggcagcggcttccacaccaccttcaccctgaccatcagcagcctgcagcccgacgacgtggccacctactggtgcgccgtgctggagttcttcggccccggcaccaaggtggagatcaagagaaccgtggccgcccccagcgtgttcatcttcccccccagcgacgagcag

SEQ ID NO: 34718 - RNA, 360 nt, synthetic construct
  misc_feature 1..360: note = derived and/or modified sequence opt4 from anti-HIV_Chain
  source 1..360: mol_type = other RNA
gacatccagatgacccagagccccagcagcctgagcgccagcgtgggcgacagagtgaccatcacctgccaggccagccagggcatcggcagcagcctgcagtggtaccagcagaagcccggcagagcccccaagctgctggtgcacggcgccagcaacctgcacagaggcgtgcccagcagattcagcggcagcggcttccacaccagcttcaccctgaccatcagcagcctgcagcccgacgacgtggccacctacttctgcgccgtgctggagttcttcggccccggcaccaaggtggagatcaagagaaccgtggccgcccccagcgtgttcatcttcccccccagcgacgagcag

SEQ ID NO: 34719 - RNA, 360 nt, synthetic construct
  misc_feature 1..360: note = derived and/or modified sequence opt4 from anti-HIV_Chain
  source 1..360: mol_type = other RNA
gacatccagatgacccagagccccagcagcctgagcgccagcgtgggcgacagagtgagcatcaactgccaggccggccagggcatcggcagcagcctgaactggtaccagcagaagagaggcaaggcccccaagctgctggtgcacggcgccagcaccctgcagagaggcgtgcccagcagattcagcggcagcggcttccacaccaccttcaccctgaccatcagcagcctgcagcccgacgacgtggccacctacttctgcgagagcttccagtggttcggccccggcaccaaggtggagatcaagagaaccgtggccgcccccagcgtgttcatcttcccccccagcgacgagcag

SEQ ID NO: 34720 - RNA, 360 nt, synthetic construct
  misc_feature 1..360: note = derived and/or modified sequence opt4 from anti-HIV_Chain
  source 1..360: mol_type = other RNA
tacatccagatgacccagagccccagcagcctgagcgccagcatcggcgacagagtgaccatcacctgccaggccggccagggcatcggcagcagcctgaactggtaccagcagaagcccggcaaggcccccaagctgctggtgcacggcgccagcaacctgcagagaggcgtgagcagcagattcagcggcagcggcttccacaccaccttcaccctgaccatcagcagcctgagacccgaggacgtgggcacctacttctgcgaggtgtacgagttcatcggccccggcaccaaggtggacatcaagagaaccgtggccgcccccagcgtgttcatcttcccccccagcgacgagcag

SEQ ID NO: 34721 - RNA, 360 nt, synthetic construct
  misc_feature 1..360: note = derived and/or modified sequence opt4 from anti-HIV_Chain
  source 1..360: mol_type = other RNA
gacatccagatgacccagagccccagcagcctgcccgccagcgtgggcgacaccgtgaccatcacctgccaggccggccagggcatcggcagcagcctgcagtggtaccagcagagacccggcagagcccccaacctgctggtgtacgacgccagcaacctgcagagaggcgtgcccagcagattcaccggcaccggcttccacaccaccttcaccctgaccatcagaggcctgagacccgaggacttcggcacctacttctgcgccagcctggagttcttcggccccggcaccaaggtggacatcaagagaaccgtggccgcccccagcgtgttcatcttcccccccagcgacgagcag

SEQ ID NO: 34722 - RNA, 360 nt, synthetic construct
  misc_feature 1..360: note = derived and/or modified sequence opt4 from anti-HIV_Chain
  source 1..360: mol_type = other RNA
gacatccagatgacccagagccccagcagcctgagcgccagcgtgggcgacagagtgaccatcacctgccaggccagccagggcatcggcagcagcctgcagtggtaccagcagaagcccggcagagcccccaacctgctggtgcacggcgccagcaacctgcacagaggcgtgcccagcagattcagcggcagcggcttccacaccaccttcagcctgaccatcagcggcctgcagagagacgacttcgccacctacttctgcgccgtgctggagttcttcggccccggcaccaaggtggacatcaagagaaccgtggccgcccccagcgtgttcatcttcccccccagcgacgagcag

SEQ ID NO: 34723 - RNA, 360 nt, synthetic construct
  misc_feature 1..360: note = derived and/or modified sequence opt4 from anti-HIV_Chain
  source 1..360: mol_type = other RNA
gacatccagatgacccagagccccagcagcctgagcgtgagcgtgggcgacagagtgagcatcacctgcagagccacccagggcatcggcaacagcctgaactggtaccagcagaagcccggcaaggcccccaaggtgctgatctacggcaccaccaagctgcacggcggcgtgcccagcagattcagcggcggcggcagcggcagcaccggcaccctgaccatcgacagcctgcagcccgaggacatcgccacctacttctgccagctgttcgagttcttcggccccggcaccaaggtggagatcaagagaaccgtggccgcccccagcgtgttcatcttcccccccagcgacgagcag

SEQ ID NO: 34724 - RNA, 360 nt, synthetic construct
  misc_feature 1..360: note = derived and/or modified sequence opt4 from anti-HIV_Chain
  source 1..360: mol_type = other RNA
gacatccagatgacccagagccccagcagcctgagcgccagcgtgggcgacagagtgaccatcacctgccaggccggccagggcatcggcagcagcctgaactggtaccagcagaagcccggcagagcccccaagctgctggtgtacggcgccagcaacctgcagagaggcgtgcccagcagattcagcggcagcggcttccacaccaccttcaccctgaccatcagcagcctgcagcccgaggacttcgccacctacttctgcagcgtgtacgagttcctgggccccggcaccaaggtggagatcaagagaaccgtggccgcccccagcgtgttcatcttcccccccagcgacgagcag

SEQ ID NO: 34725 - RNA, 360 nt, synthetic construct
  misc_feature 1..360: note = derived and/or modified sequence opt4 from anti-HIV_Chain
  source 1..360: mol_type = other RNA
cccatgttccagcccggccagagcggcggcgtggtggtgcagagcggcgagagcctgcacctgagctgcgaggccagcggcttcaagttcgccagccagatgatgcactgggtgagacacgtgcccggcagaggcctggagtgggtggccctgatcagctgggacggcagcggcaagctgttcgccgacagcgtgagaggcagattcaccatccacagatggaacgacagaaacagcctgtacctggacgtgaagaacgtgagacccgaggacgccgccatctactactgcaccagaaacggcttcgacgtgtggggccagggcatcctggtgaccgtgagcagcgccagcaccaagggc

SEQ ID NO: 34726 - RNA, 363 nt, synthetic construct
  misc_feature 1..363: note = derived and/or modified sequence opt4 from anti-HIV_HeavyChain
  source 1..363: mol_type = other RNA
gaggtgaagctggtggagagcggcggcggcctggtgcagcccggcggcagcctgagactgagctgcgccgccagcggcttcaccttcagcagcttcggcatgcactgggtgagacaggcccccgagaagggcctggagtgggtggcctacatcagcagcggcagcagcaccctgcactacgccgacaccgtgaagggcagattcaccatcagcagagacaacagcaagaacagcctgtacctgcagatgaacctgctgagagccgaggacaccgccgtgtactactgcgccagaggcagcagaaacctgagccacagactgctgagctactggggccagggcaccctggtgaccgtgagcagc

SEQ ID NO: 34727 - RNA, 363 nt, synthetic construct
  misc_feature 1..363: note = derived and/or modified sequence opt4 from anti-HIV_HeavyChain
  source 1..363: mol_type = other RNA
gaggtgcagctggtggagagcggcggcggcctggtgcagcccggcggcagcctgagactgagctgcgccgccagcggcttcaccttcagcagcttcggcatgcactgggtgagacaggcccccggcaagggcctggagtgggtgagctacatcagcagcggcagcagcaccctgcactacgccgacaccgtgaagggcagattcaccatcagcagagacaacagcaagaacagcctgtacctgcagatgaacagcctgagagccgaggacaccgccgtgtactactgcgccagaggcagcagaaacctgagccacagactgctgagctactggggccagggcaccctggtgaccgtgagcagc

SEQ ID NO: 34728 - RNA, 363 nt, synthetic construct
  misc_feature 1..363: note = derived and/or modified sequence opt4 from anti-HIV_Chain
  source 1..363: mol_type = other RNA
gacatccagatgacccagagccccagcagcctgagcgccagcgtgggcgacagagtgaccatcacctgccaggccagccagggcatcagcaacagcctgaactggtaccagcagaagcccggcaaggcccccagactgctgatctacggcaccagcaccctgcagagaggcgtgcccagcagattcagcggcagcggcagcggcaccagattcaccgtgaccatcaacagcctgcagcccgaggacatcgccacctacttctgccagcacaacgagttcttcggcagaggcaccaaggtggacatcaagagaaccgtggccgcccccagcgtgttcatcttcccccccagcgacgagcagctg

SEQ ID NO: 34729 - RNA, 363 nt, synthetic construct
  misc_feature 1..363: note = derived and/or modified sequence opt4 from anti-HIV_Chain
  source 1..363: mol_type = other RNA
gacatccagatgacccagagccccagcagcgtgagcgccagcgtgggcgacagagtgaccatcacctgccaggccagcagagacaccgacaacagcctgacctggtaccagcagaagcccggcagaccccccaagctgctgatctaccacgtggtgaacctgggccccggcgtgcccagcagattcagcggcagcgccagcagcgccacccagagcaccctgatcatcagcgacttccagcccgacgacgtggccacctacttctgccagaactacgagttcttcggccccggcaccaaggtggagatcaagagaaccgtggccgcccccagcgtgttcatcttcccccccagcgacgagcag

SEQ ID NO: 34730 - RNA, 363 nt, synthetic construct
  misc_feature 1..363: note = derived and/or modified sequence opt4 from anti-HIV_Chain
  source 1..363: mol_type = other RNA
gagatcgtgctgacccagagccccggcaccctgagcctgagccccggcgagagagccaccctgagctgcagagccagccagagcgtgagcagcaacaacctggcctggtaccagcagaagcccggccaggcccccagactgctgatgagcggcgccagcagcagagccaccggcatccccgacagattcagcggcagcggcagcggcaccgacttcaccctgaccatcagcagactggagcccgaggacttcgccgtgtaccactgccagcagtacggcagcagcccccccaccttcggccagggcaccaaggtggagatcaagagaaccgtggccgcccccagcgtgttcatcttccccccc

SEQ ID NO: 34731 - RNA, 363 nt, synthetic construct
  misc_feature 1..363: note = derived and/or modified sequence opt4 from anti-HIV_Chain
  source 1..363: mol_type = other RNA
gacatccagatgacccagagccccagcagcctgagcgcctacgtgggcgacagagtgaccatcacctgcagagccagccagaacatcaacacctacctgaactggtaccagcagagacccggcaaggcccccaagctgctgatctacgccgccagcaccctgcagagcggcgtgcccagcagattcagcggcagcggcagcggcaccgacttcaccctgaccatcagcaacctggagaccgaggacttcgccgtgtactactgccagcagacctacagaagcgtgaccttcggccagggcaccaagctggagatcaagagaaccgtggccgcccccagcgtgttcatcttcccccccagcgac

SEQ ID NO: 34732 - RNA, 363 nt, synthetic construct
  misc_feature 1..363: note = derived and/or modified sequence opt4 from anti-HIV_Chain
  source 1..363: mol_type = other RNA
gacatccagatgacccagagccccagcagcctgagcgccagcgtgggcgacagagtgaccatcacctgccaggccggccagggcatcggcagcagcctgcagtggtaccagcagaagcccggcaaggcccccaagctgctggtgcacggcgccagcaacctgcacagaggcgtgcccagcagattcagcggcagcggcttccacaccaccttcagcctgaccatcagcggcctgcagagagacgacttcgccacctacttctgcgccgtggtggagttcttcggccccggcaccaaggtggacatcaagagaaccgtggccgcccccagcgtgttcatcttcccccccagcgacgagcagctg

SEQ ID NO: 34733 - RNA, 363 nt, synthetic construct
  misc_feature 1..363: note = derived and/or modified sequence opt4 from anti-HIV_Chain
  source 1..363: mol_type = other RNA
caggtgcagctggtggagagcggcgccgagctgagaaagcccggcgagagcctggagatcagctgcaaggccagcggctacagcttcagcagccactggatcggctgggccagacagatgcccggcaagggcctggagtggatgggcatcatctaccccggcgacagcaacaccatctacagccccagcttccagggccaggtgaccatcagcgccgacaagagcatcaacaccgcctacctgcagtggagcagcctgaaggccagcgacaccgccatgtacttctgcgccagcaactaccacgactacttctactggggccagggcaccctggtgaccgtgagcagcgccagcaccaagggc

SEQ ID NO: 34734 - RNA, 363 nt, synthetic construct
  misc_feature 1..363: note = derived and/or modified sequence opt4 from anti-HIV_Chain
  source 1..363: mol_type = other RNA
ttcgtgcagctggtggagagcggcggcggcgtggtgcagcccggcaccagcctgagactgagctgcaccaccagcggcttcatcttcagcgactacggcatgcactgggtgagacaggccgccggcaagggcctggagtgggtggccgtgatctggcacgacggcagcaacagattctacgccgacagcgtgaagggcagattcaccatcagcagagacaacagcaagaacgccgtgtacctggagatgaacaacctgagagtggaggacaccgccctgtactactgcgccagaaccagcatggacatcgactactggggccagggcacccccgtgaccgtgagcagcgccagcaccaagggc

SEQ ID NO: 34735 - RNA, 363 nt, synthetic construct
  misc_feature 1..363: note = derived and/or modified sequence opt4 from anti-HIV_Chain
  source 1..363: mol_type = other RNA
gagcccatgttccagcccggccagagcggcggcgtggtggtgcagagcggcgagagcctgcacctgagctgcgaggccagcggcttcaagttcgccagccagatgatgcactgggtgagacacgtgcccggcagaggcctggagtgggtggccctgatcagctgggacggcagcggcaagctgttcgccgacagcgtgagaggcagattcaccatccacagatggaacgacagaaacagcctgtacctggacgtgaagaacgtgagacccgaggacgccgccatctactactgcaccagaaacggcttcgacgtgtggggccagggcatcctggtgaccgtgagcagcgccagcaccaagggc

SEQ ID NO: 34736 - RNA, 366 nt, synthetic construct
  misc_feature 1..366: note = derived and/or modified sequence opt4 from anti-HIV_Chain
  source 1..366: mol_type = other RNA
agccagcacctggtgcagagcggcacccaggtgaagaagcccggcgccagcgtgagaatcagctgccaggccagcggctacagcttcaccgactacgtgctgcactggtggagacaggcccccggccagggcctggagtggatgggctggatcaagcccgtgtacggcgccagaaactacgccagaagattccagggcagaatcaacttcgacagagacatctacagagagatcgccttcatggacctgagcggcctgagaagcgacgacaccgccctgtacttctgcgccagagacggcagcggcgacgacaccagctggcacctggacccctggggccagggcaccctggtgatcgtgagcgcc

SEQ ID NO: 34737 - RNA, 366 nt, synthetic construct
  misc_feature 1..366: note = derived and/or modified sequence opt4 from anti-HIV_Chain
  source 1..366: mol_type = other RNA
gacatccagatgacccagagccccagcagcctgagcgccagcgtgggcgacagagtgaccatcacctgcagagccagccagagcatcagcagatacctgaactggtaccagcagaagcccggcaaggcccccaagctgctgatctacgccgccagcagcctgcagggcggcgtgcccagcagattcagcggcagcggcagcggcaccgacttcaccctgaccatcagcagcctgcagcccgaggacttcgccacctactactgccagcagagcagcagcaagcccttcaccttcggcggcggcaccaaggtggagatcaagagaaccgtggccgcccccagcgtgttcatcttcccccccagcgac

SEQ ID NO: 34738 - RNA, 366 nt, synthetic construct
  misc_feature 1..366: note = derived and/or modified sequence opt4 from anti-HIV_Chain
  source 1..366: mol_type = other RNA
gagatcgtgctgacccagagccccggcaccctgagcctgagccccggcgagagagccaccctgagctgcagagccagccagagcatcagcagcaactacctggcctggtaccagcagaagcccggccaggcccccagactgctgatctacggcgccagcaccagagccaccggcatccccgacagattcagcggcagcggcagcggcaccgacttcaccctgagcatcagcagactggagcccgaggacatcgccgtgtactactgccaccagtacggcagcagccagagattcggccagggcaccaaggtggagatcaagagaaccgtggccgcccccagcgtgttcatcttcccccccagcgac

SEQ ID NO: 34739 - RNA, 366 nt, synthetic construct
  misc_feature 1..366: note = derived and/or modified sequence opt4 from anti-HIV_Chain
  source 1..366: mol_type = other RNA
gagatcgtgatgacccagagccccgccaccctgagcgtgagccccggcgacagagccaccctgagctgcagagccagccagagcgtgagcaccaacctggcctggtaccagcagaagcccggccaggcccccagactgctgatctacggcgccagcaccagagccaccggcatccccgccaccttcagcggcagcggcttcgccaccgagttcaccctgaccatcagcagcctgcagagcgaggacttcgccgtgtactactgccagcagtacaacaactggccccccgccttcggccagggcaccaaggtggagatcaagagaaccgtggccgcccccagcgtgttcatcttcccccccagcgac

SEQ ID NO: 34740 - RNA, 366 nt, synthetic construct
  misc_feature 1..366: note = derived and/or modified sequence opt4 from anti-HIV_Chain
  source 1..366: mol_type = other RNA
gacatccagatgacccagagccccgccagcctgagcgccagcgtgggcgacagagtgaccatcacctgcagagccagccagggcatcagccactacctggcctggtaccagcagaagcccggcaaggtgcccagactgctgatctacgccgccagcagactgcagagcggcgtgaccagcagattcagcggcagcggcagcggcaccgagttcaccctgaccatcagcagcctgctgcccgaggacgccgccgtgtacttctgccagaagtacgacaccgaccccatgaccttcggccagggcaccagactggagatcaagagaaccgtggccgcccccagcgtgttcatcttcccccccagcgac

SEQ ID NO: 34741 - RNA, 366 nt, synthetic construct
  misc_feature 1..366: note = derived and/or modified sequence opt4 from anti-HIV_Chain
  source 1..366: mol_type = other RNA
cagagcgccctgacccagccccccagcgccagcggcgcccccggccagagagtgaccatcagctgcagcggcggccccagcaacgtgggcggcaactacgtgtactggtacagacagttccccggcaccgcccccaacctgctgatcctgagagacgaccagagacccagcggcgtgcccgacagattcagcgccagcaagagcggcaacagcgccagcctggccatcagcggcctgagacccgacgacgaggccttctacttctgcgccacctacgacagcgacggcagcatcagactgttcggcggcggcaccaccctgaccgtgctgagccagcccaaggccgcccccagcgtgaccctgttc

SEQ ID NO: 34742 - RNA, 366 nt, synthetic construct
  misc_feature 1..366: note = derived and/or modified sequence opt4 from anti-HIV_Chain
  source 1..366: mol_type = other RNA
gacatccagatgacccagagccccagcagcctgagcgccagcgtgggcgacagagtgaccatcaactgccaggccggccagggcatcggcagcagcctgaactggtaccagaagaagcccggcagagcccccaagctgctggtgcacggcgccagcaacctgcagagaggcgtgcccagcagattcagcggcagcggcttccacaccaccttcaccctgaccatcagcagcctgcagcccgacgacgtggccacctacttctgcgccgtgttccagtggttcggccccggcaccaaggtggacatcaagagaaccgtggccgcccccagcgtgttcatcttcccccccagcgacgagcagctgaag

SEQ ID NO: 34743 - RNA, 366 nt, synthetic construct
  misc_feature 1..366: note = derived and/or modified sequence opt4 from anti-HIV_Chain
  source 1..366: mol_type = other RNA
gacatccagatgacccagagccccagcagcctgagcgccagcgtgggcgacagagtgaccatcacctgccaggccagccagggcatcggcagcagcctgcagtggtaccagcagaagcccggcagagcccccaacctgctggtgcacggcgccagcaagctgcacagaggcgtgcccagcagattcagcggcagcggcttccacaccaccttcagcctgaccatcagcggcctgcagagagacgacttcgccacctacttctgcgccgtgctggagttcttcggccccggcaccaaggtggagatcaagagaaccgtggccgcccccagcgtgttcatcttcccccccagcgacgagcagctgaag

SEQ ID NO: 34744 - RNA, 366 nt, synthetic construct
  misc_feature 1..366: note = derived and/or modified sequence opt4 from anti-HIV_Chain
  source 1..366: mol_type = other RNA
caggtgcacctggtgcagagcggcgccgaggtgaagaagcccggcgccagcgtgaaggtgagctgcaaggtgagcggctacaccctgagcgagctgagcatccactgggtgagacagggccccggcagaggcctggagtggatggccaacttcgaccccgaggacggcgagaccatctacgccccccagttccagggcagagtgaccctgaccgaggacaccagcaccgacaccgcctacatgcagctgaccagcctgagaagcgaggacaccgccgtgtactactgcgccaccgacagatacaccgacaccggcagatggggccccggcaccctggtgaccgtgagcagcgccagcaccaagggc

SEQ ID NO: 34745 - RNA, 366 nt, synthetic construct
  misc_feature 1..366: note = derived and/or modified sequence opt4 from anti-HIV_Chain
  source 1..366: mol_type = other RNA
caggtgcagctggtggagagcggcggcggcctgatccagcccggcggcagcctgagactgagctgcgaggccagcggcttcgccgtgggcgacatcaactacatgagctgggtgagacaggcccccggcaagggcctggagtgggtgagcgtgctgtacagcggcggcagcagccagtacgccgacagcgtgaagggcagattcaccatcagcagagacaacagcagaaacaccctgtacctgcagatggacaacctgagagccgaggacaccgccgtgtactactgcgccagaggcctgagagtgtacttcgacctgtggggccagggcatcctggtgaccgtgagcagcgccagcaccaagggc

SEQ ID NO: 34746 - RNA, 366 nt, synthetic construct
  misc_feature 1..366: note = derived and/or modified sequence opt4 from anti-HIV_Chain
  source 1..366: mol_type = other RNA
caggtgcagatggtggccagcggcggcggcctggtgaagcccggcggcagcctgagactgagctgcgaggccagcggcttcaccttcagcgactactacatgagctgggtgagacaggcccccggcaagggcctggagtggatcagctacatcaccagcggcggcaacgccctgtactacgccgacagcgtgaagggcagattcaccatcagcagagacaacgccaagaacagcctgtacctgcagatgaacagcctgagagccgaggacaccgccgtgtactactgcgccagagacctgctgcacgcccacgacttcggcagacagggcaccctggtgaccgtgagcagcgccagcaccaagggc

SEQ ID NO: 34747 - RNA, 366 nt, synthetic construct
  misc_feature 1..366: note = derived and/or modified sequence opt4 from anti-HIV_Chain
  source 1..366: mol_type = other RNA
cagctgcagctggtggagagcggcggcggcgtggtgcagcccggcagaagcctgagactgagctgcgccgccagcggcttcaccttcagcacctacaccatgcactgggtgagacaggcccccggcaagggcctggagtgggtggccgtgatcagctacgacggcaccaacaagtactacgccgacagcgtgaagggcagattcaccatcagcagagacaacagcaagaacaccctgtacctgcagatgaacagcctgagaggcgaggacaccgccgtgtactactgcgccagaagccccagctactacttcgactactggggccagggcaccctggtgaccgtgagcgccgccagcaccaagggc

SEQ ID NO: 34748 - RNA, 369 nt, synthetic construct
  misc_feature 1..369: note = derived and/or modified sequence opt4 from anti-HIV_Chain
  source 1..369: mol_type = other RNA
caggtgcacctgagccagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagagtgagcctgaccagacaggccagctgggacttcgacacctacagcttctacatggacctgaaggccgtgagaagcgacgacaccgccatctacttctgcgccagacagagaagcgacttctgggacttcgacgtgtggggcagcggcacccaggtgaccgtgagcagc

SEQ ID NO: 34749 - RNA, 369 nt, synthetic construct
  misc_feature 1..369: note = derived and/or modified sequence opt4 from anti-HIV_Chain
  source 1..369: mol_type = other RNA
caggtgcagctgctgcagagcggcgccgtggtgaccaagcccggcgccagcgtgagagtgagctgcgaggccagcggctacaagatcagagactacttcatccactggtggagacaggcccccggccagggcctgcagtgggtgggctggatcaacccccagaccggccagcccaacatccccagacccttccagggcagagtgaccctgaccagacacgccagctgggacttcgacaccttcagcttctacatggacctgaaggccctgagaagcgacgacaccgccatctacttctgcgccagaagaagaagcgactactgcgacttcgacgtgtggggcagcggcacccacgtgaccgtgagcagc

SEQ ID NO: 34750 - RNA, 369 nt, synthetic construct
  misc_feature 1..369: note = derived and/or modified sequence opt4 from anti-HIV_Chain
  source 1..369: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacacgccagctgggacttcgacaccttcagcttctacatggacctgaagggcctgagaagcgacgacaccgccatctacttctgcgccagacagagaagcgactactgggacttcgacgtgtggggcagcggcacccaggtgaccgtgagcagc

SEQ ID NO: 34751 - RNA, 369 nt, synthetic construct
  misc_feature 1..369: note = derived and/or modified sequence opt4 from anti-HIV_Chain
  source 1..369: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagactgttccagggcagagtgagcctgaccagacacgccagctgggacttcgacaccttcagcttctacatggacctgaaggccgtgagaagcgacgacaccgccgtgtacttctgcgccagacagagaagcgactactgggacttcgacgtgtggggcagcggcacccaggtgaccgtgagcagc

SEQ ID NO: 34752 - RNA, 369 nt, synthetic construct
  misc_feature 1..369: note = derived and/or modified sequence opt4 from anti-HIV_Chain
  source 1..369: mol_type = other RNA
caggtgagactgctgcagagcggcgccgccgtgaccaagcccggcgccagcgtgagagtgagctgcgaggccagcggctacgagatcagagactacttcatccactggtggagacaggcccccggccagggcctgcagtgggtgggctggatcaaccccaagaccggccagcccaacaaccccagacagttccagggcagagtgagcctgaccagacaggccagctgggacttcgacagctacagcttctacatggacctgaaggccctgagaagcgacgacaccggcgtgtacttctgcgccagacagagaagcgactactgggacttcgacgtgtggggcagcggcacccaggtgaccgtgagcagc

SEQ ID NO: 34753 - RNA, 369 nt, synthetic construct
  misc_feature 1..369: note = derived and/or modified sequence opt4 from anti-HIV_Chain
  source 1..369: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacacgccagctgggacttcgacaccttcagcttctacatggacctgaaggccctgagaagcgacgacaccgccgtgtacttctgcgccagacagagaagcgactactgggacttcgacgtgtggggcagcggcacccaggtgaccgtgagcagc

SEQ ID NO: 34754 - RNA, 369 nt, synthetic construct
  misc_feature 1..369: note = derived and/or modified sequence opt4 from anti-HIV_Chain
  source 1..369: mol_type = other RNA
gaggtgcagctggtggagagcggcggcggcctgatccagagaggcggcagcctgagactgagctgcgtggccagcggcttccccgtgagcgacaaccacatgagctgggtgagacaggcccccggcaagggcctggagtgggtgagcatcatctacagcgacggcggcacctactacgccgacagcgtgaagggcagattcaccatcagcagagacaacagcaagaacaccgtgtacctgcagatgaacagcctgagagccaccgacaccgccgtgtactactgcgccagagaccccggcttccactacggcctggacgtgtggggccagggcaccaccgtgaccgtgagcagcgccagcaccaagggc

SEQ ID NO: 34755 - RNA, 369 nt, synthetic construct
  misc_feature 1..369: note = derived and/or modified sequence opt4 from anti-HIV_Chain
  source 1..369: mol_type = other RNA
caggtgcagctgcaggagagcggccccggcctgctgagacccctggagaccctgagcctgacctgcagcgtgagcggcggcagcatcagaggctacttctggagctgggtgagacagcccgccggcagaggcctggagtggatcggcagaatctacagcagcggcaccaccagattcaaccccagcctgaagagcagagtgagactgagcatcgacaccgccaagagcgaggtgagcctgaacatcaccagcgtgaccgccgccgacagcgccagctacttctgcgccggcaccagccccgtgcacggcggcctggacctgtggggcctgggcctgagagtgaccgtgagcagcgccagcaccaagggc

SEQ ID NO: 34756 - RNA, 369 nt, synthetic construct
  misc_feature 1..369: note = derived and/or modified sequence opt4 from anti-HIV_Chain
  source 1..369: mol_type = other RNA
gagatcgtgctgacccagagccccggcaccctgagcctgagccccggcgagagagccaccctgagctgcagagccagccagagcgtgagcagcaacctggcctggtacgcccagaagcccggccaggcccccagactgatcatctacggcgccagcagcagagccagcgccatccccgacagattcagaggcagcggcagcggcaccgacttcaccctgaccatcagcagactggagcccgaggacttcgccgtgtactactgccagcagtacgacgacgcccccatcaccttcggccacggcaccagactggagatcaagagaaccgtggccgcccccagcgtgttcatcttcccccccagcgacgag

SEQ ID NO: 34757 - RNA, 369 nt, synthetic construct
  misc_feature 1..369: note = derived and/or modified sequence opt4 from anti-HIV_Chain
  source 1..369: mol_type = other RNA
gagatcgtgctgacccagagccccggcaccctgagcctgagccccggcgacagagccgccctgagctgcagagccagcgagaccctgagcggcaacagcctggcctggtaccagcagaagagaggccagccccccagactgctgatcttcgccgccagcagcagagccaccggcatccccgagagattcagcggcggcggcagcggcaccgacttcaccctgaccatcaccagactggagcccgaggacttcgccgtgtacttctgccagcagtacgtggacgcccccatcaccttcggccagggcaccagactggagatcaagagaaccgtggccgcccccagcgtgttcatcttcccccccagcgac

SEQ ID NO: 34758 - RNA, 369 nt, synthetic construct
  misc_feature 1..369: note = derived and/or modified sequence opt4 from anti-HIV_Chain
  source 1..369: mol_type = other RNA
gacatccagatgacccagagccccagcagcctgagcgccagcgtgggcgacagagtgaccatcacctgcagagccagccaggacatcaccacctacctggcctggctgcagcagaagcccggcaaggcccccaagagcctgatctacagcgccagcaccgtgcagagcggcgtgcccagcagattcagcggcagcggcagcggcaccgagttcaccctgaccatcagcggcctgcagcccgaggacttcgccacctactactgccagcagtacaactactaccccatcaccttcggcctgggcaccagactggagatcaagagaaccgtggccgcccccagcgtgttcatcttcccccccagcgacgag

SEQ ID NO: 34759 - RNA, 369 nt, synthetic construct
  misc_feature 1..369: note = derived and/or modified sequence opt4 from anti-HIV_Chain
  source 1..369: mol_type = other RNA
gacatccagatgacccagagccccagcagcctgagcgccagcatcggcgacagagtgaccatcacctgcagagccaaccagcacatcagaagcttcctgaactggtaccagcagacccccggcaaggcccccaagctgctgatctacgccgccagcaccctgcagagaggcgtgcccagcagattcagcggcagcggcagcggcaccgacttcaccctgaccatcaccagcctggagagagaggacctggccacctactactgccagcagacctacaccagccccatcaccttcggccagggcaccagactggagatcaagagaaccgtggccgcccccagcgtgttcatcttcccccccagcgacgag

SEQ ID NO: 34760 - RNA, 369 nt, synthetic construct
  misc_feature 1..369: note = derived and/or modified sequence opt4 from anti-HIV_Chain
  source 1..369: mol_type = other RNA
agcgagatcgtgctgacccagagccccgccaccctgagcctgagccccggcgagagcgccaccctgagctgcagagccagccagagcctgagcagcagcctggcctggtaccagcagaagcccggccaggcccccagactgctgatctacgacaccagcgacagagccaccggcatccccgccagattcagcggcagaggcagcggcaccgacttcaccctgaccatcagcagcctggagcccgaggacttcgccgtgtactactgccagcagagaagcaactgggccatcaccttcggccagggcaccagactggagatcaagagaaccgtggccgcccccagcgtgttcatcttcccccccagcgac

SEQ ID NO: 34761 - RNA, 369 nt, synthetic construct
  misc_feature 1..369: note = derived and/or modified sequence opt4 from anti-HIV_Chain
  source 1..369: mol_type = other RNA
caggtgctgagcgtgagcggcacccccggccagagagtgatcatcagctgcagcggcaccagcagcaacgtgggcggcaacctggtgagctggtaccagcacctgcccggcgccgcccccagactgctgatccacagagacgaccagagacccagcggcgtgcccgacagattcagcggcagcaagagcggcaacagcgccagcctggtgatcagcggcctgagaagcgacgacgaggccgactacttctgcgccgcctacgacagcaccttcagcctgcccgtgttcggcggcggcaccagactgaccgtgctgagccagcccaaggccgcccccagcgtgaccctgtacgcccccagcagcgaggag

SEQ ID NO: 34762 - RNA, 369 nt, synthetic construct
  misc_feature 1..369: note = derived and/or modified sequence opt4 from anti-HIV_Chain
  source 1..369: mol_type = other RNA
gacatccagatgacccagagccccagcagcctgagcgccagcgtgggcgacagagtgaccatcacctgccaggccggccagggcatcggcagcagcctgcagtggtaccagcagaagcccggcaaggcccccaagctgctggtgcacggcgccagcaacctgcacagaggcgtgcccagcagattcagcggcagcggcttccacaccaccttcagcctgaccatcagcggcctgcagagagacgacttcgccacctacttctgcgccgtgctggagttcttcggccccggcaccaaggtggagatcaagagaaccgtggccgcccccagcgtgttcatcttcccccccagcgacgagcagctgaagagc

SEQ ID NO: 34763 - RNA, 369 nt, synthetic construct
  misc_feature 1..369: note = derived and/or modified sequence opt4 from anti-HIV_Chain
  source 1..369: mol_type = other RNA
gagatcgtgctgacccagagccccgccaccctgagcctgagccccggcgagagagccaccctgagctgcagagccagccagggcctgaacttcgtggtgtggtaccagcagaagagaggccaggcccccagactgctgatccacgcccccagcgacagagcccccggcgtgcccgacagattcagcgccagaggcagcggcaccgacttcagcctggtgatcagcagcgtggagcccgacgacttcgccatctactactgccaggagtacagcagcaccccctacaacttcggccccggcaccagagtggacagaaagagaaccgtggccgcccccagcgtgttcatcttcccccccagcgacgagcag

SEQ ID NO: 34764 - RNA, 369 nt, synthetic construct
  misc_feature 1..369: note = derived and/or modified sequence opt4 from anti-HIV_Chain
  source 1..369: mol_type = other RNA
gagatcgtgctgacccagagccccaccaccctgagcctgagccccggcgagagagccaccctgagctgcagagccagccagggcgtgaacctggtggtgtggtaccagcagaagagaggccaggcccccagactgctgatctacggccccagcgacagagcccccggcgtgcccgacagattcagcgccagaggcagcggcaccgagttcagcctggtgatcagcagcgtggagcccgacgacttcgccctgtactactgccaggagtacagcagcaccccctacaacttcggcaccggcaccagagtggacagaaagagaaccgtggccgcccccagcgtgttcatcttcccccccagcgacgagcag

SEQ ID NO: 34765 - RNA, 369 nt, synthetic construct
  misc_feature 1..369: note = derived and/or modified sequence opt4 from anti-HIV_Chain
  source 1..369: mol_type = other RNA
gagatcgtgctgacccagagccccgccaccctgagcctgagccccggcgagagagccaccctgagctgcagagccagccagggcgtgaacttcgtggtgtggtaccagcagaagagaggccaggcccccagactgctgatctacggccccagcaacagagcccccggcgtgcccgacagattcagcgccagaggcagcggcaccgagttcagcctggtgatcagcagcgtggagcccgacgacttcgccctgtactactgccaggagtacagcagcaccccctacaacttcggccccggcaccagagtggacagaaagagaaccgtggccgcccccagcgtgttcatcttcccccccagcgacgagcag

SEQ ID NO: 34766 - RNA, 369 nt, synthetic construct
  misc_feature 1..369: note = derived and/or modified sequence opt4 from anti-HIV_Chain
  source 1..369: mol_type = other RNA
gagatcgtgctgacccagagccccgccaccctgagcctgagccccggcgagagagccaccctgagctgcagagccagccagggcctgaacttcgtggtgtggtaccagcagaagagaggccaggcccccagactgctgatccacggccccagccacagagcccccggcgtgcccgacagattcagcgccagaggcagcggcaccgagttcagcctggtgatcagcagcgtggagcccgacgacttcgccatctactactgccaggagtacagcagcaccccctacaacttcggccccggcaccagagtggacagaaagagaaccgtggccgcccccagcgtgttcatcttcccccccagcgacgagcag

SEQ ID NO: 34767 - RNA, 369 nt, synthetic construct
  misc_feature 1..369: note = derived and/or modified sequence opt4 from anti-HIV_Chain
  source 1..369: mol_type = other RNA
gagatcgtgctgacccagagccccgccaccctgagcctgagccccggcgagagagccaccctgagctgcagagccagccagggcctgaacttcgtggtgtggtaccagcagaagggcggccaggcccccagactgctgatccacggccccaccgacagagcccccggcgtgcccgacagattcagcgccagaggcagcggcaccgagttcagcctggtgatcagcagcgtggagcccgacgacttcgccctgtactactgccaggagtacagcagcaccccctacaacttcggccccggcaccagagtggacagaaagagaaccgtggccgcccccagcgtgttcatcttcccccccagcgacgagcag

SEQ ID NO: 34768 - RNA, 369 nt, synthetic construct
  misc_feature 1..369: note = derived and/or modified sequence opt4 from anti-HIV_Chain
  source 1..369: mol_type = other RNA
gagatcgtgctgacccagagccccgccaccctgagcctgagccccggcgagagagccaccctgagctgcagagccagccagggcctgaacttcgtggtgtggtaccagcagaagagaggccaggcccccagactgctgatccacgcccccagcggcagagcccccggcgtgcccgacagattcagcgccagaggcagcggcaccgagttcagcctggtgatcagcagcgtggagcccgacgacttcgccatctactactgccaggagtacagcagcaccccctacaacttcggccccggcaccagagtggacagaaagagaaccgtggccgcccccagcgtgttcatcttcccccccagcgacgagcag

SEQ ID NO: 34769 - RNA, 369 nt, synthetic construct
  misc_feature 1..369: note = derived and/or modified sequence opt4 from anti-HIV_Chain
  source 1..369: mol_type = other RNA
caggtgcagctggtgcagagcggcgccgaggtgaagaagcccggcagcagcgtgaaggtgagctgcaagaccagcggcggcagcttcagcaactacgccttcagctgggtgagacaggcccccggcgagggcctggagtggatgggcagaatcatccccatcttcggcaccgccaagtacacccagaagctgcagggcagagtgaccatcaccgccgacaagttcaccagcaccgtgtacatggagctgagcagcctgagaagcgaggacaccgccatctactactgcgccagcctgcaccagggccccatcggctacaccccctggcaccccccccccagagcccccctgggccagagcgtgtgcggc

SEQ ID NO: 34770 - RNA, 369 nt, synthetic construct
  misc_feature 1..369: note = derived and/or modified sequence opt4 from anti-HIV_Chain
  source 1..369: mol_type = other RNA
caggtgcagctggtggagagcggcggcggcctggtgcagcccggcggcagcctgagaatcagctgcagcgccaccggcttcaccttcagcacccacgccatgcactgggtgagacaggcccccggcaagggcctggagtacgtgagcgccatcaacagcaacggcagaagcgccttctacgccgacagcgtgaagggcagagtgaccatcagcagagacaacagcaagaacaccctgttcctgcagatgaccagcctgagagccgaggacaccgccgtgtactactgcgtgaagggccccctgctgagatacctggacagctggggccagggcaccctggtgaccgtgagcagcgccagcaccaagggc

SEQ ID NO: 34771 - RNA, 369 nt, synthetic construct
  misc_feature 1..369: note = derived and/or modified sequence opt4 from anti-HIV_Chain
  source 1..369: mol_type = other RNA
gaggtgcagctggtggagagcggcggcggcctggtgcagcccggcggcagcctgagaatcagctgcagcgccaccggcttcaccttcagcacccacgccatgcactgggtgagacaggcccccggcaagggcctggagtacgtgagcgccatcaacagcaacggcagaagcgccttctacgccgacagcgtgaagggcagagtgaccatcagcagagacaacagcaagaacaccctgttcctgcagatgaccagcctgagagccgaggacaccgccgtgtactactgcgtgaagggccccctgctgagatacctggacagctggggccagggcaccctggtgaccgtgagcagcgccagcaccaagggc

SEQ ID NO: 34772 - RNA, 369 nt, synthetic construct
  misc_feature 1..369: note = derived and/or modified sequence opt4 from anti-HIV_Chain
  source 1..369: mol_type = other RNA
gaggagagcggccccggcctggtgaagcccagccagaccctgagcctgacctgcagcgtgagcggcgacagcgtgagcagcggcggctacttctggagctggatcagacagcaccccaccaagggcctggagtgcctgggctacgtgtactacaccggcaacacctactacaaccccagcctgaagagcccccccaccatcgaggtggccatggccaacaaccaggtgagcctgaagctgggcagcgtgaccgccgccgacaccgccgtgtactactgcgccagaatcaagagattcagaggcggcaactacttcgacacctggggccacggcctgctggtgaccgtgagcagcgccagcaccaagggc

SEQ ID NO: 34773 - RNA, 369 nt, synthetic construct
  misc_feature 1..369: note = derived and/or modified sequence opt4 from anti-HIV_Chain
  source 1..369: mol_type = other RNA
caggtgcagctgcaggagagcggcagcggcctggtgaagcccagcggcaccctgagcctgacctgcgccgtgagcaacggccccatcagcagcggcaactggtggagctgggtgagacagacccccgagaagggcctggagtggatcggcgaggtgtaccacagcggcagcaccaaccacaaccccagcctgaagagcagagccaccatcctggtggacaagagcaagaaccagttcagcctgaacctgagaagcgtgaccgccgccgacaccgccgtgtactactgcgccagagtgagaggcagctggaacttcgactactggggccagggcatcctggtgaccgtgagcagcgccagcaccaagggc

SEQ ID NO: 34774 - RNA, 369 nt, synthetic construct
  misc_feature 1..369: note = derived and/or modified sequence opt4 from anti-HIV_HeavyChain
  source 1..369: mol_type = other RNA
gaggtgcagctgcagcagagcggcaccgtgctggccagacccggcgccagcgtgaagatgagctgcaaggccagcggctacaccttcaccagctactggatgcactgggtgaagcagagacccggccagggcctggagtggatcggcgccatctaccccggcaacagcgacaccagctacaaccagaagttcaagggcaaggccaagctgaccgccgtgaccagcgccagcaccgcctacatggagctgagcagcctgaccaacgaggacagcgccgtgtactactgcaccagatggccccactactacggcggcagcagatactacttcgactactggggccagggcaccaccctgaccgtgagcagc

SEQ ID NO: 34775 - RNA, 372 nt, synthetic construct
  misc_feature 1..372: note = derived and/or modified sequence opt4 from anti-HIV_Chain
  source 1..372: mol_type = other RNA
gtggtgcagctggtggagagcggcggcggcctggtgcagcccggcggcagcctgagactgagctgcgccgccagcggcttcgccttcagaagctactggatgagctgggtgagacaggcccccggcagaggcctggagtgggtggccaacatcaagcaggacggcagcgagaagtactacgccgacagcgtgaagggcagattcaccatcagcagagacaacaccaagaacagcctgtacctgcagatgaacagcctgagagccgaggacaccgccgtgttctactgcgccagcagaggcgacagatacggccccatcgactactggggccagggcaccctggtgaccgtgagcagcgccagcaccaagggc

SEQ ID NO: 34776 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgagatcaagaagcccggcgagagcctgaagatcagctgcaaggccagcggctacaccttcaacgactactggatcggctgggtgagacagatgcccggcaagggcctggagtggatgggcatcttctaccccgacgacagcgacagcaactacagccccagcttccagggcagagtgaccatcagcgccgacaagagcatcaccaccgcctacctgcagtggagcaccctgaaggccagcgacagcgccatgtacttctgcgccagactgctgggcgacagcggcgccttcgacatctggggccagggcaccatggtgatcgtgagcagcgccagcaccaagggc

SEQ ID NO: 34777 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcggcggcctggtgaagcccggcggcagcctgagactgagctgcgccgccagcggcttcaccttcagcagctacagcatgaactgggtgagacaggcccccggcaagggcctggagtgggtgagcagcatcagcagcagcagcagctacatctactacgccgacagcgtgaagggcagattcaccatcagcagagacaacgccaagaacagcctgtacctgcagatgaacagcctgagagccgaggacaccgccgtgtactactgcgccagagagggcagctactactacggcatggacgtgtggggccagggcaccaccgtgaccgtgagcagcgccagcaccaagggc

SEQ ID NO: 34778 - RNA, 372 nt, synthetic construct
  misc_feature 1..372: note = derived and/or modified sequence opt4 from anti-HIV_Chain
  source 1..372: mol_type = other RNA
gagatcgtgctgacccagagccccgccaccctgagcgtgagccccggcgagagagccaccctgagctgcagagccggccagagcgtgagcagcgacctggcctggtaccagcacaagcccggccaggcccccagactgctgatctacgacgccagcaagagagccaccggcatccccgccagattcagcggcagcggcagcggcaccgacttcaccctgaccatcagcagcctggagcccgaggacttcgccgtgtactactgccagcacagaaccaactggccccccagcatcaccttcggccagggcaccagactggagatcaagagaaccgtggccgcccccagcgtgttcatcttcccccccagcgac

SEQ ID NO: 34779 - RNA, 372 nt, synthetic construct
  misc_feature 1..372: note = derived and/or modified sequence opt4 from anti-HIV_Chain
  source 1..372: mol_type = other RNA
gagatcgtgctgacccagagccccggcaccctgagcctgagccccggcgagagagccaccctgagctgcagagccagccagagcgtgagcagcagatacctggcctggtaccagcagaagcccggccaggcccccagactgatcatctacgacgccagcagcagagccagcggcatccccgacagattcagcggcagcggcagcgagaccgacttcaccctgaccatcaccagactggagcccgaggacttcgccgtgtactactgccagctgtacggcaccagccccaagttcaccttcggccagggcaccaagctggagatcaagagaaccgtggccgcccccagcgtgttcatcttcccccccagcgac

SEQ ID NO: 34780 - RNA, 372 nt, synthetic construct
  misc_feature 1..372: note = derived and/or modified sequence opt4 from anti-HIV_Chain
  source 1..372: mol_type = other RNA
gagatcgtgctgacccagagccccggcaccctgagcctgagccccggcgagagagccaccctgagctgcagagccagccagagcgtgagcaacaactacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacgccaccagcagcctgtacaccttcggccagggcaccaagctggagatcaagagaaccgtggccgcccccagcgtgttcatcttcccccccagcgac

SEQ ID NO: 34781 - RNA, 372 nt, synthetic construct
  misc_feature 1..372: note = derived and/or modified sequence opt4 from anti-HIV_Chain
  source 1..372: mol_type = other RNA
cccgccaccctggccgtgagccccggcgagagagccaccatcagctgcaagagcagccagaacctgctgtacagcgccaacaaccagcacagcctggcctggtaccagcagagacccggccagccccccaagctgctgctgtactgggccagcaccagactgagcggcgtgcccgacagattcagcggcagcggcagcggcaccgacttcaccctgaccatcagcaacctgcaggccgaggacgtggccgtgtactactgccagcagtactacagccccccccccaccttcggccagggcaccaaggtggagatcagaagaaccgtggccgcccccagcgtgttcatcttcccccccagcgacgagcagctg

SEQ ID NO: 34782 - RNA, 372 nt, synthetic construct
  misc_feature 1..372: note = derived and/or modified sequence opt4 from anti-HIV_Chain
  source 1..372: mol_type = other RNA
cagcccgtgctgacccagccccccagcgccagcggcgcccccggccagagagtgaccatcagctgcagcggcggccccagcaacgtgggcggcaactacgtgtactggtacagacagttccccggcaccgcccccaacctgctgatcctgagagacgaccagagacccagcggcgtgcccgacagattcagcgccagcaagagcggcaacagcgccagcctggccatcaccggcctgagacccgacgacgaggccttctacttctgcgccacctacgacagcgacggcagcatcagactgttcggcggcggcaccgccctgaccgtgctgagccagcccaaggccgcccccagcgtgaccctgttccccccc

SEQ ID NO: 34783 - RNA, 372 nt, synthetic construct
  misc_feature 1..372: note = derived and/or modified sequence opt4 from anti-HIV_Chain
  source 1..372: mol_type = other RNA
aacttcatgctgacccagccccccagcgccagcggcgcccccggccagagagtgaccatcagctgcagcggcggccccagcaacgtgggcggcaactacgtgtactggtacagacagttccccggcaccgcccccaacctgctgatcctgagagacgaccagagacccagcggcgtgcccgacagattcagcgccagcaagagcggcaacagcgccagcctggccatcagcggcctgagacccgacgacgaggccttctacttctgcgccacctacgacagcgacggcagcatcagactgttcggcggcggcaccaccctgaccgtgctgagccagcccaaggccgcccccagcgtgaccctgttccccccc

SEQ ID NO: 34784 - RNA, 372 nt, synthetic construct
  misc_feature 1..372: note = derived and/or modified sequence opt4 from anti-HIV_Chain
  source 1..372: mol_type = other RNA
gacatccagatgacccagagcccccccagcctgagcgccagcgtgggcgacagagtgaccatcacctgccaggccagccaggacatcaacaacttcctgaactggtaccagcagaagcccggcaaggcccccagactgctgatctacgacgccagcaacctggagagcggcgtgagcagcagattcagcggcagcagaagcggcaccgacttcaccctgaccatcagcagcctgctgcccgaggacatcgccacctacagctgccagcagtacagcaacctgccctacaccttcagccagggcaccaagctggagatcaagagaaccgtggccgcccccagcgtgttcatcttcccccccagcgacgagcag

SEQ ID NO: 34785 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcaccgccgtgaagagacccggcgccagcgtgagagtgagctgccaggccagcggctacaccttcatcgaccacttcatctactggtggagacaggcccccggccagggcctggagtggctgggctggatcaaccccctgaccagccagcccagctaccccagcagattccagggcagactgaccctgaccagagacaccttcgacgagatgctgtacatggacctgagaggcctgagaagcgacgacaccggcatctacttctgcgccagaagacacagcgactactgcgacttcgacatctggggcagcggcacccagatcatcgtgagcagcgccagcaccaagggc

SEQ ID NO: 34786 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgccaggcctacggctacaagttcaccgaccacctgatctactggtggagacaggcccccggccagggcctggagtggatcggctggatcaagcccgagaccggccagcccagctacagctacaagttccagggcagagtgagcctgaccagagacaccttccaggagatcctgttcatggacctgagaggcctgagaagcgacgacaccgccatctacttctgcgccagaagacacagcgactactgcgacttcgacgtgtggggcagcggcagccaggtgatcgtgagcagcgccagcaccaagggc

SEQ ID NO: 34787 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgccagacctacggctacaagttcaccgaccacctgatctactggtggagacaggcccccggccagggcctggagtggatgggctggatcaagcccgagaccggccagcccagctacagctacagattccagggcagagtgagcctgaccagagacaccttcgaggagatcgtgttcatggacctgagaggcctgagaagcgacgacaccgccatctacttctgcgccagaagacacagcgactactgcgacttcgacgtgtggggcagcggcagccaggtgatcgtgagcagcgccagcaccaagggc

SEQ ID NO: 34788 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgccagacctacggctacaagttcaccgaccacctgatctactggtggagacaggcccccggccagggcctggagtggatcggctggatcaagcccgagaccggccagcccagctacagctacagattccagggcagagtgagcctgaccagagacaccttcgaggagatcgccttcatggacctgagaggcctgagaagcgacgacaccgccatctacttctgcgccagaagacacaccgactactgcgtgttcgacgtgtggggcagcggcagccagatcatcgtgagcagcgccagcaccaagggc

SEQ ID NO: 34789 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcaccgccgtgaagagacccggcgccagcgtgagagtgagctgccaggccagcggctacaccttcaccgactacttcatctactggtggagacaggcccccggccagggcctggagtggctgggctggatcaaccccctgaccagccagcccagctaccccagcagattccagggcagactgaccctgaccagagacaccttcgacgagatgctgtacatggacctgagaggcctgagaagcgacgacaccggcatctacttctgcgccagaagacacagcgactactgcgacttcgacatctggggcagcggcacccagatcatcgtgagcagcgccagcaccaagggc

SEQ ID NO: 34790 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcgtgagaatcagctgccaggcctacggctacaagttcaccgaccacctgatctactggtggagacaggcccccggccagggcctggagtggatcggctggatcaagcccgagaccggccagcccagctacgcctacaagttccagggcagagtgaccctgaccagagacaccttcgaggagatccacttcatggacctgagaggcgtgagaaacgacgacaccgccacctacttctgcgccagaagacacagcgactactgcgacttcgacgtgtggggcagcggcagccaggtgatcgtgagcagcgccagcaccaagggc

SEQ ID NO: 34791 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcgtgagaatcagctgccagacctacggctacaagttcaccgaccacctgatctactggtggagacaggcccccggccagggcctggagtggatcggctggatcaagcccgagaccggccagcccagctacagctacagattccagggcagagtgagcctgaccagagacaccttcgaggagatcgtgttcatggacctgagaggcctgagaagcgacgacaccgccatctacttctgcgccagaagacacagcgactactgcgacttcgacgtgtggggcagcggcagccaggtgctggtgagcagcgccagcaccaagggc

SEQ ID NO: 34792 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgccagacctacggctacaagttcaccgaccacctgatctactggtggagacaggcccccggccagggcctggagtggatcggctggatcaagcccgagaccggccagcccagctacagctacagattccagggcagagtgagcctgaccagagacaccttcgaggagatcgtgttcatggacctgagaggcctgagaagcgacgacaccgccatctacttctgcgccagaagacacagcgactactgcgacttcgacgtgtggggcagcggcagccaggtgctggtgagcagcgccagcaccaagggc

SEQ ID NO: 34793 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcgtgagaatcagctgccagacctacggctacaagttcaccgaccacctgatccactggtggagacaggcccccggccagggcctggagtggatcggctggatcaagcccgacaccggccagcccagctacagcagcagattccagggcagagtgagcctgaccagagacaccttcgaggagatcgtgttcatggacctgagaggcctgagaagcgacgacaccgccatctacttctgcgccagaagacacagcgactactgcgacttcgacgtgtggggcagcggcagccaggtgctggtgagcagcgccagcaccaagggc

SEQ ID NO: 34794 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgccagacctacggctacaagttcaccgaccacctgatctactggtggagacaggcccccggccagggcctggagtggatcggctggatcaagcccgagaccggccagcccagctacagctacagattccagggcagagtgagcctgaccagagacaccttcgaggagatcgtgttcatggacctgagaggcctgagaagcgacgacaccgccatctacttctgcgccagaagacacagcgactactgcgacttcgacgtgtggggcagcggcagccaggtgatcgtgagcagcgccagcaccaagggc

SEQ ID NO: 34795 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgccagacctacggctacaagttcaccgaccacctgatctactggtggagacaggcccccggccagggcctggagtggatcggctggatcaagcccgagaccggccagcccagctacagctacagattccagggcagagtgagcctgaccagagacaccttcgaggagatcgtgttcatggacctgagaggcctgagaagcgacgacaccgccatctacttctgcgccagaagacacagcgactactgcgacttcgacgtgtggggcggcggcagccaggtgatcgtgagcagcgccagcaccaagggc

SEQ ID NO: 34796 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgcctgacctacggctacaagttcaccgaccacctgatctactggtggagacaggcccccggccagggcctggagtggatcggctggatcaagcccgagaccggccagcccagctacagctacagattccagggcagagtgagcctgaccagagacaccttcgaggagatcgtgttcatggacctgagaggcctgagaagcgacgacaccgccatctacttctgcgccagaagacacagcgactactgcgacttcgacgtgtggggcagcggcagccaggtgatcgtgagcagcgccagcaccaagggc

SEQ ID NO: 34797 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccaccctgaagaagcccggcgccagcgtgagaatcagctgccaggcctacggctacaagttcaccgaccacctgatccactggtggagacaggcccccggccagggcctggagtggatcggctggatcaagcccgagaccggccagcccagctacgcctacaagttccagggcagagtgagcctgaccagagacaccttcgaggagatcctgttcatggacctgagaggcctgagaagcgacgacaccgccatctacttctgcgccagaagacacagcgactactgcgacctggacgtgtggggcggcggcacccagctgctggtgagcagcgccagcaccaagggc

SEQ ID NO: 34798 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcgtgagaatcagctgccaggcctacggctacaagttcaccgaccacctgatctactggtggagacaggcccccggccagggcctggagtggatcggctggatcaagcccgagaccggccagcccagctacagctacaagttccagggcagagtgaccctgaccagagacaccttcgaggagatccacttcatggacctgagaggcctgagatacgacgacaccgccacctacttctgcgccagaagacacagcgactactgcgacttcgacgtgtggggcagcggcagccaggtgagcgtgagcagcgccagcaccaagggc

SEQ ID NO: 34799 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgccaggcctacggctacaagttcaccgaccacctgatctactggtggagacaggcccccggccagggcctggagtggatcggctggatcaagcccgagaccggccagcccagctacagctacaagttccagggcagagtgagcctgaccagagacaccttccaggagatcctgttcatgaacctgagaggcctgagaagcgacgacaccgccatctacttctgcgccagaagacacagcgactactgcgacttcgacgtgtggggcagcggcagccagatcctggtgagcagcgccagcaccaagggc

SEQ ID NO: 34800 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcaccgccgtgaagaagcccggcgccagcgtgagagtgagctgccaggccagcggctacaccttcaccgactacttcatctactggtggagacaggcccccggccagggcctggagtggctgggctggatcaaccccagaaccagccagcccagctacccctacagattccagggcagagtgaccctgaccagagacatcttcgaggagatgctgtacatggacctgagaggcctgagaagcgacgacaccggcatctacttctgcgccagaagacacagcgactactgcgacttcgacatctggggcagcggcacccagatcatcgtgagcagcgccagcaccaagggc

SEQ ID NO: 34801 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgccctgaagaagcccggcgccagcctgagaatcagctgccaggcctacggctacaagttcaccgactacctgatccactggtggagacaggcccccggccagggcctggagtggatcggctggatcaagcccgagaccggccagcccagctacagctacaagttccagggcagagtgagcctgaccagagacaccttcgaggagatcctgttcatggacctgagaggcctgagaagcgacgacaccgccatctacttctgcgccagaagacacagcgactactgcgacttcgacgtgtggggcggcggcagccaggtgctggtgagcagcgccagcaccaagggc

SEQ ID NO: 34802 - RNA, 372 nt, synthetic construct
  misc_feature 1..372: note = derived and/or modified sequence opt4 from anti-HIV_Chain
  source 1..372: mol_type = other RNA
gaggtgcagctgctggagagcggcggcgccctggtgcagcccggcggcagcctgagactgagctgcgccgccagcggcttcaccttcagcaccagcagcatgagctgggtgagacaggcccccggcaagggcctggagtgggtgagcgccatcggcagcggcagaggcagcaccttctacgccgacagcgtgaagggcagattcaccatcagcagagacaacagcaagaacaccctgagcctgcagatgaacagcctgaccgccgaggacaccgccacctactactgcaccaagaccggcggcctgctgagattccccgaggtgtggggcaagggcaccaccgtgaccgtgagcagcgccagcaccaagggc

SEQ ID NO: 34803 - RNA, 372 nt, synthetic construct
  misc_feature 1..372: note = derived and/or modified sequence opt4 from anti-HIV_Chain
  source 1..372: mol_type = other RNA
gaggtgcagctggtggagagcggcggcggcctggtgaagcccggcggcagcctgagactgagctgcgccgacagcggcttcaccttcagaagctacagcatgcactgggtgagacaggcccccggcaagggcctggcctgggtgagcagcatcagcagcaccagcaactacatctactacgccgacagcgtgaagggcagattcaccatcagcagagacaacgccaagaacagcctgtacctgcagatgaacagcctgagagccgaggacaccgccgtgtactactgcgccagaaccttcatcaccgccagctggttcgacagctggggccagggcaccctggtgaccgtgagcagcgccagcaccaagggc

SEQ ID NO: 34804 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgaggtgaagaagcccggcgccagcgtgaaggtgagctgcaaggccagcggctacaccttcaccaactacggcgtgagctgggtgagacaggcccccggccagggcctggagtggatgggctggatcagcccctacagcggcaacaccaactacgcccagagactgcaggacagagtgaccatgaccaccgacaccagcaccaacaccgcctacatggagctgagaagcctgagaagcgacgacaccgccgtgtactactgcgccgccagaagctactactactacagcatggacgtgtggggccagggcaccaccgtgaccgtgagcagcgccagcaccaagggc

SEQ ID NO: 34805 - RNA, 372 nt, synthetic construct
  misc_feature 1..372: note = derived and/or modified sequence opt4 from anti-HIV_Chain
  source 1..372: mol_type = other RNA
caggtgcagctggtgcagagcggcgccgagctgaagaagcccggcagcagcgtgaaggtgagctgcaaggccagcggcggcaccttcagcaactacgccatcaactgggtgagacaggcccccggccagggcttcgagtggatgggcggcatcatccccctgttcgccacccccacctacgcccagaagttccagggcagagtgagaatcaccgccgacgacagcaccagcaccgcctacatggagctgagcagcctgagaagcgacgacaccgccgtgtacttctgcgccagacccaacgtggtgagaagcgccctggactactggggccagggcaccctggtgaccgtgagcagcgccagcaccaagggc

SEQ ID NO: 34806 - RNA, 372 nt, synthetic construct
  misc_feature 1..372: note = derived and/or modified sequence opt4 from anti-HIV_Chain
  source 1..372: mol_type = other RNA
caggtgcagctggtggagagcggcggcggcgtggtgcagcccggcaagagcctgagactgagctgcgccgccagcggcttcaccttcagcacccacgccatgcactgggtgagacaggcccccggcaagggcctggactgggtggccgtgatcagccacgacggcgacaaccagtactacgccgacgccgtgaagggcagattcaccatcagcagagacgacagcagagacaccgtgttcctgcagatgaacagcctgagaaccgaggacaccggcgtgtactactgcgccgccgacagcagcggcagcaactggttcgactactggggccagggcatcctggtgaccgtgagcagcgccagcaccaagggc

SEQ ID NO: 34807 - RNA, 375 nt, synthetic construct
  misc_feature 1..375: note = derived and/or modified sequence opt4 from anti-HIV_Chain
  source 1..375: mol_type = other RNA
caggtgagactgagccagagcggcggccagatgaagaagcccggcgagagcatgagactgagctgcagagccagcggctacgagttcctgaactgccccatcaactggatcagactggcccccggcagaagacccgagtggatgggctggctgaagcccagaggcggcgccgtgaactacgccagaaagttccagggcagagtgaccatgaccagagacgtgtacagcgacaccgccttcctggagctgagaagcctgaccagcgacgacaccgccgtgtacttctgcaccagaggcaagtactgcaccgccagagactactacaactgggacttcgagcactggggcagaggcgcccccgtgaccgtgagcagc

SEQ ID NO: 34808 - RNA, 375 nt, synthetic construct
  misc_feature 1..375: note = derived and/or modified sequence opt4 from anti-HIV_Chain
  source 1..375: mol_type = other RNA
gaggtgcagctggtgcagagcggcagcgacgtgagaaagcccggcgccaccgtgaccgtgagctgcaaggccgacgaggacgaggacgacttcaccgcctacaactacttcatgcactgggtgagacaggcccccggccacggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgaccgtgagcagc

SEQ ID NO: 34809 - RNA, 375 nt, synthetic construct
  misc_feature 1..375: note = derived and/or modified sequence opt4 from anti-HIV_Chain
  source 1..375: mol_type = other RNA
caggtgcagctggtgcagagcggcggcggcctggtgcagcccggcgagagcctgagactgagctgcaccgccagcggcttcaccttcagcagctacaacatgaactgggtgagacaggcccccggcaagggcctggagtggatcagctacatcagcgacaagagcaagaacaagtactacgccgacagcgtgagaggcagattcaccatcagcagagacaacgcccagaacagcctgttcctgcagatgagcagcctgagagacgaggacaccgccgtgtactactgcaccagagagggcccccagagaagcttctacttcgactactggggccagggcatccaggtgaccgtgagcagcgccagcaccaagggc

SEQ ID NO: 34810 - RNA, 375 nt, synthetic construct
  misc_feature 1..375: note = derived and/or modified sequence opt4 from anti-HIV_Chain
  source 1..375: mol_type = other RNA
gaggtgcagctggtggagagcggcgccgaggtgaagaagcccggcagcagcgtgaaggtgagctgcaaggccagcggcggcaccttcagcagctacagcatcagctgggtgagacaggcccccggccagggcctggagtggatgggcggcatcatccccatcttcgccaccacccactacggccagaagttccagggcagaatcaagatcaccgccgacaagagcaccagcaccgcctacatggagctgagcagactgagaagcgaggacaccgccgtgtactactgcgccagagacagagagttctacttctacggcatggacgtgtggggccagggcaccaccgtgaccgtgagcagcgccagcaccaagggc

SEQ ID NO: 34811 - RNA, 375 nt, synthetic construct
  misc_feature 1..375: note = derived and/or modified sequence opt4 from anti-HIV_Chain
  source 1..375: mol_type = other RNA
cagctgcagctgcaggagagcggccccggcctggtgaagccctgggagaccctggtgctgacctgcagcgtgagcggcggcagcatcagcagcggcgactactactggggctggatcagacagagccccggcaagggccccgagtggatcggcaacatcttctacagcagcggcaacacctactacaacaccagcctgaagagcagagtgaccatcagcgtggacgtgagcaagaacagattcagcctgaagctgaccagcatgaccgccgccgacaccgccgtgtactactgcggcagactgagcaacaagggctggttcgacccctggggccagggcaccctggtgagcgtgagcagcgccagcaccaagggc

SEQ ID NO: 34812 - RNA, 375 nt, synthetic construct
  misc_feature 1..375: note = derived and/or modified sequence opt4 from anti-HIV_Chain
  source 1..375: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcgacaccgacttcaccctgaccatcagcagcctggagcccgaggacttcgccgtgtactactgccagcagagaggcatctggcccctgcagatcaccttcggccagggcaccagactggagatcaagagaaccgtggccgcccccagcgtgttcatcttcccccccagcgacgag

SEQ ID NO: 34813 - RNA, 375 nt, synthetic construct
  misc_feature 1..375: note = derived and/or modified sequence opt4 from anti-HIV_Chain
  source 1..375: mol_type = other RNA
agcgagatcgtgctgacccagagccccggcaccctgagcctgagccccggcgagagagccaccctgagctgcagagccagccagagcgtgagcagcagctacctggcctggtaccagcagaagcccgtgcaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcaccctgcaccccagaaccttcggccagggcaccaaggtggagatcaagagaaccgtggccgcccccagcgtgttcatcttcccccccagcgac

SEQ ID NO: 34814 - RNA, 375 nt, synthetic construct
  misc_feature 1..375: note = derived and/or modified sequence opt4 from anti-HIV_Chain
  source 1..375: mol_type = other RNA
agccaggccgtggtgacccagccccccagcgtgagcggcgcccccggccagagagtgaccatcagctgcagcggcggccccagcaacgtgggcggcaacctggtgtactggtacaagcagttccccggcaccgcccccaagctgctgatcagaagagacgaccagagacccagcggcgtgcccgacagattcagcggcagcaagagcggcaacagcgccagcctggccatcagcggcctgagacccgacgacgaggccttctacttctgcgccacctacgacagccacggcagcatcagactgttcggcggcggcaccctgctgaccgtgctgagccagcccaaggccgcccccagcgtgaccctgttccccccc

SEQ ID NO: 34815 - RNA, 375 nt, synthetic construct
  misc_feature 1..375: note = derived and/or modified sequence opt4 from anti-HIV_Chain
  source 1..375: mol_type = other RNA
gacatccagatgacccagagccccagcaccctggccgccagcatcggcggcaccgtgagagtgagctgcagagccagccagagcatcaccggcaactgggtggcctggtaccagcagagacccggcaaggcccccagactgctgatctacagaggcgccgccctgctgggcggcgtgcccagcagattcagcggcagcgccgccggcaccgacttcaccctgaccatcggcaacctgcaggccgaggacttcggcaccttctactgccagcagtacgacacctaccccggcaccttcggccagggcaccaaggtggaggtgaagagaaccgtggccgcccccagcgtgttcatcttcccccccagcgacgagcag

SEQ ID NO: 34816 - RNA, 375 nt, synthetic construct
  misc_feature 1..375: note = derived and/or modified sequence opt4 from anti-HIV_Chain
  source 1..375: mol_type = other RNA
gagatcgtgatgacccagagccccgacaccctgagcgtgagccccggcgagagagccaccctgagctgcagagccagccagagcgtgaacagcaacctggcctggtaccagcagaagcccggccaggcccccagactgctgatctacggcgccagcaccagagccaccgccgtgcccgccagattcagcggcagcggcagcggcaccgagttcaccctgaccatcagcagcctgcagagcgaggacagcgccgtgtactactgccagcagtactaccagtggctgagctacaccttcggccagggcaccaagctggagatcaagagaaccgtggccgcccccagcgtgttcatcttcccccccagcgacgagcag

SEQ ID NO: 34817 - RNA, 375 nt, synthetic construct
  misc_feature 1..375: note = derived and/or modified sequence opt4 from anti-HIV_Chain
  source 1..375: mol_type = other RNA
agacaggtgcagctggtgcagagcggcgccgccctgaagaagcccggcgccagcctgagaatcagctgccaggcctacggctacaagttcaccgaccacctgatctactggtggagacaggcccccggccagggcctggagtggatcggctggatcaagcccgagaccggccagcccagctacagctacaagttccagggcagagtgagcctgaccagagacaccttccaggagatcctgttcatggacctgagaggcctgagaagcgacgacaccgccatctacttctgcgccagaagacacagcgactactgcgacttcgacgtgtggggcagcggcagccagatcctggtgagcagcgccagcaccaagggc

SEQ ID NO: 34818 - RNA, 375 nt, synthetic construct
  misc_feature 1..375: note = derived and/or modified sequence opt4 from anti-HIV_Chain
  source 1..375: mol_type = other RNA
caggtgcagctggtgcagagcggcgccgccctgaagaagcccggcgccagcgtgagaatcagctgccaggcctacggctacaagttcaccgactacctgatccactggtggagacaggcccccggccagggcctggagtggatcggctggatcaagcccgagaccggccagcccagctacagctacaagttccagggcagagtgaccctgaccagagacaccttcgaggagatcctgttcatggacctgagaggcctgagaagcgacgacaccgccatctacttctgcgccagaagacacagcgactactgcgacttcgacgtgtggggcagcggcagccaggtgatcgtgagcagcgccagcaccaagggcgcc

SEQ ID NO: 34819 - RNA, 375 nt, synthetic construct
  misc_feature 1..375: note = derived and/or modified sequence opt4 from anti-HIV_Chain
  source 1..375: mol_type = other RNA
gaggtgcagctggtggagagcggcggcggcctggtgaagcccggcggcagcctgagactgagctgcgccgccagcggcttcagcttcagcgagcactacatgagctggatcagactggcccccggcaagggcctggagtggctgagctacatcagcagcagcaccagaaccacctacagcgccgacagcgtgagaggcagattcaccatcagcagagacaccgccaagcagctgctgttcctgcacatgagcagcctgagagccgaggacaccgccgtgtactactgcgtgagactgtacggcggcatcaacggctggttcgaccagtggggccagggcaccctggtgagcgtgagcagcgccagcaccaagggc

SEQ ID NO: 34820 - RNA, 375 nt, synthetic construct
  misc_feature 1..375: note = derived and/or modified sequence opt4 from anti-HIV_Chain
  source 1..375: mol_type = other RNA
caggtgcagctggtgcagagcggccccggcctggtgaagcccagcgagaccctgagcctgacctgcagcgtgagcaacggcagcatcagcagcggcggctactactggagctggctgagacagttccccggcaagggcctggagtggatcggcagcatccactacaccggcagaaccttctacaaccccagcctgatgggcagaaccgccctgagcatggacaccagcaacaaccagttcagcctgaaggtgagcagcgtgaccgccgccgacaccgccctgtactactgcgccagagagctgcagtggatgttcgtggtggacccctggggccagggcaccctggtgaccgtgagcagcgccagcaccaagggc

SEQ ID NO: 34821 - RNA, 375 nt, synthetic construct
  misc_feature 1..375: note = derived and/or modified sequence opt4 from anti-HIV_Chain
  source 1..375: mol_type = other RNA
caggtgcagctgcaggagagcggccccggcctggtgaagcccagcgagaccctgagcctgacctgcagcgtgagcaacggcagcatcagcagcggcggctactactggagctggctgagacagttccccggcaagggcctggagtggatcggcagcatccactacaccggcagaaccatgtacaaccccagcctgatgggcagacccgccctgagcatggacaccagcaacaaccagttcagcctgaagctgagaagcgtgaccgccgccgacaccgccctgtacttctgcgccagagacctgcagtggatcttcgtggtggacccctggggccagggcaccctggtgaccgtgagcagcgccagcaccaagggc

SEQ ID NO: 34822 - RNA, 375 nt, synthetic construct
  misc_feature 1..375: note = derived and/or modified sequence opt4 from anti-HIV_Chain
  source 1..375: mol_type = other RNA
gaggtgcagctgctggagagcggcggcggcctggtgcagcccggcggcagcctgagactgagctgcgccgtgagcggcttcaccttcggcggccacgccgtgagctgggtgagacaggcccccggcaagggcctggagtggctgagccagatcagcggcaccggcagcagaaccgactacgccgacgccgtgaagggcagattcaccgtgagcagagacaacagcaagaagaccgtgtacctgcagatgaacagcctgagagtggaggacaccgccctgttctactgcgccaccagaagccccggcggcggctacgccttcgacatctggggccagggcgccatggtgaccgtgagcagcgccagcaccaagggc

SEQ ID NO: 34823 - RNA, 375 nt, synthetic construct
  misc_feature 1..375: note = derived and/or modified sequence opt4 from anti-HIV_Chain
  source 1..375: mol_type = other RNA
caggtgcagctggtgcagagcggcgccgaggtgaagaagcccggcagcagcgtgaaggtgagctgcaaggtgagcttcttcagcaactacggcatcagctgggtgagacagagacccggccagggcctggagtggatgggcagaatcatccccgccatcgacgacatgacctacgcccagaccttcagaggcagagtgaccttcagcgccgacaagttcaccaccaccgcctacatggagctgaccggcctgaccttcgaggacaccgccacctacttctgcgccagagacccccaggtgaacagaagaggcaactgcttcgaccactggggccagggcaccctggtgaccgtgagcagcgccagcaccaagggc

SEQ ID NO: 34824 - RNA, 375 nt, synthetic construct
  misc_feature 1..375: note = derived and/or modified sequence opt4 from anti-HIV_Chain
  source 1..375: mol_type = other RNA
caggtgcagctgcaggagagcggccccggcctggtgaagcccagcgagaccctgagcctgacctgcaccgtgagcggcggcagcatcagctactactactggagctggatcagacagccccccggcaagggcctggagtggatcggcgacatctactacagcggcaccaccgactacaaccccagcctgaagagcagagtgaccatcagcgtggacaccagcaagaaccagttcagcctgaagctgagcagcgtgaccgccgccgacaccgccgtgtactactgcgccagaagaagaggccagagactgctggcctacttcgactactggggccagggcagcctggtgaccgtgagcagcgccagcaccaagggc

SEQ ID NO: 34825 - RNA, 375 nt, synthetic construct
  misc_feature 1..375: note = derived and/or modified sequence opt4 from anti-HIV_Chain
  source 1..375: mol_type = other RNA
caggtgcagctgcaggagagcggccccggccccgtgaagcccagcgagaccctgagcctgacctgcaccgtgagcggcggcagcatgatcagctactactggagctggatcagacagccccccggcaagggcctggagtggatcggctacatcttcaccaacggcagaaccacctacagccccagcctgagaagcagagtgaccatcagcctggacaccagcaccaaccacttcagcctgagactgaagagcgtgaccgccgccgacaccgccatctactactgcgccagactggacggcgaggccttcagatactacctggacctgtggggccagggcaacctggtgaccgtgagcagcgccagcaccaagggc

SEQ ID NO: 34826 - RNA, 375 nt, synthetic construct
  misc_feature 1..375: note = derived and/or modified sequence opt4 from anti-HIV_Chain
  source 1..375: mol_type = other RNA
caggtgcagctggtgcagagcggcgccgaggtgaagaagcccggcgccagcgtgaaggtgagctgcaagcccagcagcaacaccttcaccagccactacatccactgggtgagacaggcccccggccagggcctggagtggatgggcatgatcaaccccggcggcagcaccagatacgcccccaagttccagggcagagtgaccctgaccagagacaccagcaccagaaccgtgtacatggagctgagcagcctgagaagcgaggacaccgccgtgtactactgcgccagaccccagtacaacctgggcagagaccccctggacgtgtggggcctgggcaccatggtgaccgtgagcagcgccagcaccaagggc

SEQ ID NO: 34827 - RNA, 375 nt, synthetic construct
  misc_feature 1..375: note = derived and/or modified sequence opt4 from anti-HIV_Chain
  source 1..375: mol_type = other RNA
caggtgcagctgcagcagtggggcgccggcctgctgaagcccagcgagaccctgagcctgacctgcgccgtgtacggcggcagcttcagcggctactactggagctggatcagacagccccccggcaagggcctggagtggatcggcgagatcaaccacagcggcagcaccaactacaaccccagcctgaagagcagagtgaccatcagcgtggacaccagcaagaaccagttcagcctgaagctgagcagcgtgaccgccgccgacaccgccgtgtactactgcgccagactgcccatcggcagcggctggtacggcagagactactggggccagggcaccctggtgaccgtgagcagcgccagcaccaagggc

SEQ ID NO: 34828 - RNA, 375 nt, synthetic construct
  misc_feature 1..375: note = derived and/or modified sequence opt4 from anti-HIV_Chain
  source 1..375: mol_type = other RNA
caggtgcagctggtgcagagcggcgccgaggtgaagaagcccggcgccagcgtgaaggtgagctgcaaggccagcggcaacaccttcaccagctacggcatcacctgggtgagacaggcccccggccagggcctggagtggatgggctggatcagcgcctacaacggcaacaccaactacgcccagaagctgcaggacagactgaccatgaccaccgacaccagcaccagcaccgcctacatggagctgagaagcctgagaagcgacgacaccgccgtgtactactgcgccttcagcagacactacggcagcggcaactacgactactggggccagggcaccctggtgaccgtgagcagcgccagcaccaagggc

SEQ ID NO: 34829 - RNA, 375 nt, synthetic construct
  misc_feature 1..375: note = derived and/or modified sequence opt4 from anti-HIV_Chain
  source 1..375: mol_type = other RNA
cagttcagactggtgcagagcggccccgaggtgaagaaccccggcagcagcgtgaccgtgagctgcaaggccagcggcggcaccttcagcggcctgggcatcaactgggtgagacaggcccccggccagggcctggagtggctgggcgacatcaagaccatgtacggcaccaccaactacgcccccaagttccagggcagagtgaccatcaccgccgacgagagcaccagcaccagctacatggagctgagcggcctgagaagcgaggacaccgccgtgttctactgcgtgagagagctgttcggccaccaccccgccttcggcgtgtggggccagggcaccagcgtgatcgtgagcagcgccagcaccaagggc

SEQ ID NO: 34830 - RNA, 375 nt, synthetic construct
  misc_feature 1..375: note = derived and/or modified sequence opt4 from anti-HIV_Chain
  source 1..375: mol_type = other RNA
agagtgcagctggtgcagagcggcgccgaggtgaagaagcccggcagcagcgtgaccgtgagctgcaaggccagcggcggcagcttcagcagctacgccatcagctgggtgagacaggcccccggccagggcctggagtgggtgggcggcgtgaaggtgatgttcggcaccgtgcactacagccagaaggtgcagggcagagtgaccatcaccgccgacgacagcaccggcaccagctacctggagctgagcggcctgagaagcgccgacaccgccgtgtactactgcgccagaaacgccggcgcctacttctaccccttcgacatctggggccagggcaccctgatcatcgtgagcagcgccagcaccaagggc

SEQ ID NO: 34831 - RNA, 375 nt, synthetic construct
  misc_feature 1..375: note = derived and/or modified sequence opt4 from anti-HIV_Chain
  source 1..375: mol_type = other RNA
caggtgcagctgcaggagagcggccccggcctggtgaagcccagcgagaccctgagcctgacctgcaccgtgagcggcggcagcatcagcagcagaagctactactggggctggatcagacagccccccggcaagggcctggagtgggtgggcagcatctactacaccggcagcacctactacagccccagcctgaagagcagagtgaccatcagcgtggacaccagccagaaccagttcagcctgaagctgaacagcgtgaccgccgccgacaccgccgtgtactactgcgccagacagaagggcagcggcaccagcctgctgtactggggccagggcaccctggtgaccgtgagcagcgccagcaccaagggc

SEQ ID NO: 34832 - RNA, 375 nt, synthetic construct
  misc_feature 1..375: note = derived and/or modified sequence opt4 from anti-HIV_Chain
  source 1..375: mol_type = other RNA
caggtgcagctggtgcagagcggcaccgaggtgaagaagcccggcagcagcgtgaaggtgagctgcaaggccagcggcggcaccttcagcgacagcgacatcgcctgggtgagacaggcccccggccagggcctggagtggatgggcggcatcacccccatgttcgacatggccaagagcgcccagaagttcagaggcagactgatcatcaccgccgacaagagcaccggcaccgcctacatggagctgagcagcctgagatacgaggacgccgccgtgtacttctgcgccagaagcagcggcaacttcgagttcgccttcgagatctggggccagggcaccaagatcatcgtgagcctggccagcaccaagggc

SEQ ID NO: 34833 - RNA, 375 nt, synthetic construct
  misc_feature 1..375: note = derived and/or modified sequence opt4 from anti-HIV_Chain
  source 1..375: mol_type = other RNA
gtggtgcagctggtgcagagcggcaccgaggtgaagaagcccggcagcagcgtgaaggtgagctgcaaggccagcggcggcaccttcagcggcagcgacatcagctgggtgagacaggcccccggccagggcctggagtggatgggcggcatcatccccatgttcgacatcgaggaccacgcccagaagttcagaggcagactgaccatcaccgccgacaagagcaccggcgccgcctacatggagctgagcagcctgagaagcgaggacgccgccgtgtactactgcgccagaagcagcggcaactacgacttcgccttcgacatctggggccagggcaccagactgatcgtgagcagcgccagcaccaagggc

SEQ ID NO: 34834 - RNA, 375 nt, synthetic construct
  misc_feature 1..375: note = derived and/or modified sequence opt4 from anti-HIV_Chain
  source 1..375: mol_type = other RNA
gtggtgcagctggtggagagcggcaccgaggtgaagaagcccggcagcagcgtgaaggtgagctgcaaggccagcggcggcaccttcagcggcagcgacatcagctgggtgagacaggcccccggccagggcctggagtggatgggcggcatcatccccatgttcgacatcgagaaccacgccgagaagttcagaggcagactgaccatcaccgccgtgaagagcaccggcgccgcctacatggagctgagcagcctgagaagcgaggacgccgccgtgtactactgcgccagaagcagcggcaactacgacttcgcctacgacatctggggccagggcaccagagtgatcgtgagcagcgccagcaccaagggc

SEQ ID NO: 34835 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcagcgccatgaagaagcccggcgccagcgtgagagtgagctgctggaccagcgaggacatcttcgacaccaccgagctgatccactgggtgagacaggcccccggccagggcctggagtggatcggctgggtgaaggccgtgagcggcgccgtgaactacggcagcctggacttcagacacagagtgagcctgaccagagacagagacctgagcaccgcccacatggacatcagaggcctgacccaggacgacaccgccacctacttctgcgccagacagaagttcgccagaggcgaccagggctggttcttcgacctgtggggcagaggcaccctgatcgtggtgagcagcgcc

SEQ ID NO: 34836 - RNA, 378 nt, synthetic construct
  misc_feature 1..378: note = derived and/or modified sequence opt4 from anti-HIV_Chain
  source 1..378: mol_type = other RNA
caggtgcagctgcaggagagcggccccggcctggtgaagcccagcgagaccctgagcctgacctgcaccgtgagcggcggcagcatcagcaaccactactggagctggatcagacagccccccggcaagggcctggagtggatcggctacatctaccacagcggcaacatcaactacaagagcagcctgaagagcagagccaccatcagcatcgacaccagcaacaaccagttcagcctgaagctgagcagcgtgatcgccgccgacaccgccgtgtactactgcgccagaaacttcggccccggcagccccaactacggcatggacgtgtggggccagggcaccaccgtgaccgtgagcagcgccagcaccaagggc

SEQ ID NO: 34837 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcggcggcgtggtgcagcccggcagaagcctgagactgagctgcgccgccagcggcttcaccttcagccaccacggcatccactgggtgagacaggcccccggcgagggcctggagtgggtggccgtgatcagcgaggacggcaccaacatccactacgaggacagcgtgagaggcagattcaccatcagcagagacaacagcaagaacaccgtggacctgcagatgaacagcctgagagccgaggacaccgccgtgtactactgcgccagcctgatcagcatgagagacggcgacgccttcgacctgtggggccagggcaccagagtgaccgtgagcagcgccagcaccaagggc

SEQ ID NO: 34838 - RNA, 378 nt, synthetic construct
  misc_feature 1..378: note = derived and/or modified sequence opt4 from anti-HIV_Chain
  source 1..378: mol_type = other RNA
caggtgcagctggtggagagcggcggcggcctgggccagcccggcggcagcctgagactgagctgcgccgccagcggcttcaccttcagaaactacgccatgagctgggtgagacaggccgccggcaagggcctggagtgggtgagcggcgtgagcggcggcggcgacaccacctactacggcgacagcgtgaagggcagattcaccatcagcagagacaacagcaagaacaccctgtacctgcagatgaacaacctgagagccgaggacaccgccgtgtactactgcgccaaggacaagggcgtgtggggcagcagcgacttcgactactggggccagggcaccctggtgaccgtgagcagcgccagcaccaagggc

SEQ ID NO: 34839 - RNA, 378 nt, synthetic construct
  misc_feature 1..378: note = derived and/or modified sequence opt4 from anti-HIV_Chain
  source 1..378: mol_type = other RNA
gaggtgcagctggtggagagcggcggcggcgtggtgcagcccggcagaagcctgagactgagctgcgccgccagcggcttcaccttcagccaccacggcatccactgggtgagacaggcccccggcgagggcctggagtgggtggccgtgatcagcgaggacggcaccaacatccactacgaggacagcgtgagaggcagattcaccatcagcagagacaacagcaagaacaccgtggacctgcagatgaacagcctgagagccgaggacaccgccgtgtactactgcgccagcctgatcagcatgagagacggcgacgccttcgacctgtggggccagggcaccagagtgaccgtgagcagcgccagcaccaagggc

SEQ ID NO: 34840 - RNA, 378 nt, synthetic construct
  misc_feature 1..378: note = derived and/or modified sequence opt4 from anti-HIV_Chain
  source 1..378: mol_type = other RNA
agaggccccgtgaccctggccgtgagcctgggcgagagagccaccatcacctgcaagagcagccagagcgtgctggtgcacagcaacaacaagaactacctgagctggtaccagcagaagcccggccagccccccaagctgctgatctactgggccagcaccagagagagcggcgtgcccgagagattcagcggcagcggcagcggcaccgacttcaccctgagcatcagcagcctgcaggccgaggacgtggccgtgtactactgccaccagtacttcagcacccccagaaccttcggccagggcaccaaggtggagatcaagggcaccgtggccgcccccagcgtgttcatcttcccccccagcgacgagcagctg

SEQ ID NO: 34841 - RNA, 378 nt, synthetic construct
  misc_feature 1..378: note = derived and/or modified sequence opt4 from anti-HIV_Chain
  source 1..378: mol_type = other RNA
agcgagatcgtgatgacccagagccccgccaccctgagcatgagccccggcgagagagccaccctgagctgcagagccagcctgagcgtgaacaccaacctggcctggtaccagcagaagcccggccaggcccccagactgctgatctacggcgccagcaccagagccaccggcatccccgccagattcagcggcagcggcagcggcaccgagttcaccctgaccatcagcagcctgcagagcgaggacttcgccctgtactactgccagcagtacaaccactggccccagaccttcggccagggcaccaaggtggagatcaagagaaccgtggccgcccccagcgtgttcatcttcccccccagcgacgagcagaag

SEQ ID NO: 34842 - RNA, 378 nt, synthetic construct
  misc_feature 1..378: note = derived and/or modified sequence opt4 from anti-HIV_Chain
  source 1..378: mol_type = other RNA
agcgagatcgtgctgacccagagccccgccaccctgagcctgagccccggcgagagagccaccctgagctgcagagccagccagagcatcaacaactacctggcctggtaccagcagaagcccggccaggcccccagactgctgatctacgacgccagcaacagagccaccggcatccccgccagattcagcggcggcggcagcggcaccgacttcaccctgaccatcagcagcctggagcccgaggacttcgccgtgtactactgccagcagagagccaactggagactgctgaccttcggcggcggcaccaaggtggagatcaagagaaccgtggccgcccccagcgtgttcatcttcccccccagcgacgagcag

SEQ ID NO: 34843 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcggcgccgtgaagaagcccggcgccagcgtgaaggtgagctgcgagacctacggctacaccttcaccgaccacttcatgcactggtggagacaggcccccggccagggcctggagtggatgggctggatcaacccctacagcagcgccgtgagctacagccccagataccagggcagagtgaccatgaccagagacaccttcctggagaccgtgtacatggagctgagaggcctgaagttcgacgacaccgccatctactactgcgccacccccaagagcggcagagactactggagcttcgacctgtggggccagggcaccctggtgaccgtgagcagcgccagcaccaagggc

SEQ ID NO: 34844 - RNA, 378 nt, synthetic construct
  misc_feature 1..378: note = derived and/or modified sequence opt4 from anti-HIV_Chain
  source 1..378: mol_type = other RNA
agccaggtgcagctggtggagagcggccccggcctggtgaagcccagcgagaccctgagcctgacctgcagcgtgagcaacggcagcatcagcagcggcggctactactggagctggctgagacagttccccggcaagggcctggagtggatcggcagcatccactacaccggcagaaccatgtacaaccccagcctgatgggcagacccgccctgagcatggacaccagcaacaaccagttcagcctgaagctgagcagcgtgaccgccgccgacaccgccctgtacttctgcgccagagacctgcagtggatcttcgtggtggacccctggggccagggcaccctggtgaccgtgagcagcgccagcaccaagggc

SEQ ID NO: 34845 - RNA, 378 nt, synthetic construct
  misc_feature 1..378: note = derived and/or modified sequence opt4 from anti-HIV_Chain
  source 1..378: mol_type = other RNA
agcgtggtgcagctggtggagagcggccccggcctggtgaagcccagcgagaccctgagcctgacctgcagcgtgagcaacggcagcatcagcagcggcggctactactggagctggctgagacagttccccggcaagggcctggagtggatcggcagcatccactacaccggcagaaccatgtacaaccccagcctgatgggcagacccgccctgagcatggacaccagcaacaaccagttcagcctgaagctgagaagcgtgaccgccgccgacaccgccctgtacttctgcgccagagacctgcagtggatcttcgtggtggacccctggggccagggcaccctggtgaccgtgagcagcgccagcaccaagggc

SEQ ID NO: 34846 - RNA, 378 nt, synthetic construct
  misc_feature 1..378: note = derived and/or modified sequence opt4 from anti-HIV_Chain
  source 1..378: mol_type = other RNA
agcggcggcagactggtgcagcccggcggcagcctgagactgagctgcagcgccagcggcttcaccctgagcaacagcgccatgagctgggtgagacaggcccccggcaagggcctggagtgggtgagcagcatcctgagcagcggcgtgggcaccttctacgccgacagcgtgaagggcagattcaccgtgagcagagacaacagcagaaacaccctgtacctgcagatgaagagcctgagagccgaggacaccgccctgtactactgcgccaaggtgcagatccagcagctgaacttcggcgtgatcaccgacgccggcctggacgtgtggggcaagggcaccaccctgatcgtgagcagcgccagcaccaagggc

SEQ ID NO: 34847 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcgccgccgtgaagaagcccggcgccagcgtgaaggtgagctgcgaggcctacggctacaagttcaccgaccacttcatgcactggtggagacaggcccccggccagggcctggagtggatgggctggatcaacccctacaccagcgccgtgaactacagccccaagtaccagggcagagtgaccatgaccagagacaccttcctggagaccgtgtacatggagctgagaggcctgagagtggacgacaccgccatctactactgcgccacccccaagagcggcagagactactggagcttcgacctgtggggccagggcaccctggtgaccgtgagcagcgccagcaccaagggc

SEQ ID NO: 34848 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcgccgccgtgaagaagcccggcgccagcgtgaaggtgagctgcgagacctacggctacaagttcaccgaccacttcatgcactggtggagacaggcccccggccagggcctggagtggatgggctggatcaacccctacagcagcgccgtgagctacagccccagataccagggcagagtgaccatgaccagagacaccttcctggagaccgtgtacatggagctgagaggcctgagattcgacgacaccgccatctactactgcgccacccccaagagcggcagagactactggagcttcgacctgtggggccagggcaccctggtgaccgtgagcagcgccagcaccaagggc

SEQ ID NO: 34849 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcgccgccgtgaagaagcccggcgccagcgtgaaggtgagctgcgagacctacggctacaccttcaccgaccacttcatgcactggtggagacaggcccccggccagggcctggagtggatgggctggatcaacccctacagcagcgccgtgagctacagccccagataccagggcagagtgaccatgaccagagacaccttcctggagaccgtgtacatggagctgagaggcctgaagttcgacgacaccgccatctactactgcgccacccccaagagcggcagagactactggagcttcgacctgtggggccagggcaccctggtgaccgtgagcagcgccagcaccaagggc

SEQ ID NO: 34850 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcgccgaggtgaagaagcccggcagcagcgtgaaggtgagctgcaagaccagcggcgtgagattcagcagcaacgccatcagctgggtgagacaggcccccggccagggcctggagtggatgggcagaaccacccccatgctgggcggcgccaaccacgcccccagcttcaagggcagagtgaccatcagcgccgacgagagcaccagaaccgtgtacatggagatgagcagcctgagatacgaggacaccgccgtgtactactgcgccagcggcagaagagagggcctgaacttcctgctggactactggggccagggcaccctggtgaccgtgagcagcgccagcaccaagggc

SEQ ID NO: 34851 - RNA, 378 nt, synthetic construct
  misc_feature 1..378: note = derived and/or modified sequence opt4 from anti-HIV_Chain
  source 1..378: mol_type = other RNA
caggtgcagctgcaggagagcggccccggcctggtgaagcccagcgagaccctgagcctgacctgcaccgtgagcggcggcagcatcagcacctactactggagctggatcagacagccccccggcaagggcctggagtggatcggctacatcagctacagcggcagcaccaactacaaccccagcctgaagagcagagtgaccatcagcgtggacaccagcaagaaccagttcagcctgaagctgagcagcgtgaccgccgccgacaccgccgtgtactactgcgccagacacaagagcgtgctgctgtggttcagagagctggactactggggccagggcaccctggtgaccgtgagcagcgccagcaccaagggc

SEQ ID NO: 34852 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcgccgaggtgaagaagcccggcgccgccgtgaagatcagctgcaaggccagcagattcaccttcagcagctactacatccactgggtgagacaggcccccggccagggcctggagtggatgggcatcatcaaccccagcggcggcagcaccagcaacgcccagaagttccaggacagagtgaccctgaccagagacatgagcaccggcaccgtgtacatggagctgagcagactgaccagcgaggacaccgccgtgtactactgcgccacccccgagcccagcagcatcgtggcccccctgtactactggggccagggcaccctggtgaccgtgagcagcgccagcaccaagggc

SEQ ID NO: 34853 - RNA, 378 nt, synthetic construct
  misc_feature 1..378: note = derived and/or modified sequence opt4 from anti-HIV_Chain
  source 1..378: mol_type = other RNA
caggtgcagctggtgcagagcggcgccgagatgaagaagcccggcgccagcgtgaaggtgagctgcaaggccagcggccacaccttcaccaactactacatgcactgggtgagacaggcccccggccagggcctggagtggatgggcatgatcaaccccaccggcgacagcaccagatacgcccagagattccagggcagagtgaccatgaccagagacaccagcaccagaaccgtgtacatggagctgagcagcctgagaagcgacgacaccgccgtgtactactgcgccagagcccaccacgacttctggagagcccccgtggacgtgtggggcaagggcaccaccgtgaccgtgagcagcgccagcaccaagggc

SEQ ID NO: 34854 - RNA, 378 nt, synthetic construct
  misc_feature 1..378: note = derived and/or modified sequence opt4 from anti-HIV_Chain
  source 1..378: mol_type = other RNA
caggtggtgctgatccagagcggcgccgaggtgaagagacccggcagcagcgtgaaggtgagctgcaaggccagcggcggcagcttccccatcacctgggtgagacaggcccccggccacggcctggagtggatgggcggcatcaaccccttcttcggcaccaccaactacgcccagaagttccagggcagagtgagcatcaccgccgacgagagcaccagcaccacctacctgcacctgagcgacctgagaagcgaggacaccgccgtgtacttctgcgccagagagaacagagagaagtggctggtgctgagaagctggttcgccccctggggccagggcaccctggtgaccgtgagcagcgccagcaccaagggc

SEQ ID NO: 34855 - RNA, 378 nt, synthetic construct
  misc_feature 1..378: note = derived and/or modified sequence opt4 from anti-HIV_Chain
  source 1..378: mol_type = other RNA
agccagcagctggtgcagagcggcgcccaggtgaagaagcccggcgccagcgtgagagtgagctgccaggccagcggctacaccttcaccaaccacttcctgcactggtggagacaggcccccagacagggcctggagtggatgggctggatcaaccccgtgcacggcggcagaaactacgccagaagattccagggcagaatcaacttcggcagagacgtgtaccaggagaccgcctacatggagctgagcggcctgagaaacgacgacaccgccacctacttctgcgccagaggcggcggcgacggcagaaactggcacctgcacccctggggccagggcaccctggtgatcgtgagcgccgccagcaccaagggc

SEQ ID NO: 34856 - RNA, 378 nt, synthetic construct
  misc_feature 1..378: note = derived and/or modified sequence opt4 from anti-HIV_Chain
  source 1..378: mol_type = other RNA
gaggtgcaggtggtggagagcggcggcggcctggtgcagcccggcggcagcctgagactgagctgcgtggccagcggcttcaccttcagcgagtactggatgagctgggtgagacaggcccccggcaagggcctggagtgggtggccaccatcaagagagacggcagcgaggagagctacgtggacagcgtgaagggcagattcaccatcagcagagacaacgccaagaacagcctgtacctgcagatgaacagcctgagagccgaggacaccgccgtgtactactgcgccagagtgagagaccccaactacaacctgcacttcgacagctggggccagggcaccctggtgaccgtgagcagcgccagcaccaagggc

SEQ ID NO: 34857 - RNA, 378 nt, synthetic construct
  misc_feature 1..378: note = derived and/or modified sequence opt4 from anti-HIV_Chain
  source 1..378: mol_type = other RNA
ctggtgcagctggtggagagcggcggcggcgtggtgcagcccggcaagagcctgagactgagctgcgccaccagcggcttcaccttcagcacctacggcatgcactgggtgagacaggcccccggcaagggcctggagtgggtggccgtgatctggtacgacggcagctacaagtactacgccgacagcgtgaagggcagattcaccatcagcagagacaacagcaagaacaccctgttcctgcagatgaacagcctgagagccgaggacaccgccatgtactactgcggcagagagatggccgtgggcggcaccaaggccctggaccactggggccagggcaccctggtgaccgtgagcagcgccagcaccaagggc

SEQ ID NO: 34858 - RNA, 378 nt, synthetic construct
  misc_feature 1..378: note = derived and/or modified sequence opt4 from anti-HIV_Chain
  source 1..378: mol_type = other RNA
gagttccagctggtgcagagcggcggcggcctggtgaagcccggcggcagcctgagactgagctgcaccggcagcaccttcagcttcagcagcgacgacatgaactgggtgagacaggcccccggcaagggcctggagtgggtgagcagcatgagcgacagcggcagccacatctactacgccgacttcgtgaagggcagattcaccatcagcagagacaacgccaagaagagcctgtacctgcagatgaacagcctgagagccgaggacaccgccgtgtactactgcgcccagagcagacccccccagagactgtacggcatggacgtgtggggccagggcaccaccgtgaccgtgagcagcgccagcaccaagggc

SEQ ID NO: 34859 - RNA, 381 nt, synthetic construct
  misc_feature 1..381: note = derived and/or modified sequence opt4 from anti-HIV_Chain
  source 1..381: mol_type = other RNA
gaggtgcagctggtggagagcggcggcggcgtggtgcagcccggcggcagcctgagactgagctgcgccgccagcggcttcatgttcaagaactacgccatgcactgggtgagacagccccccggcaagggcctggagtgggtggccgtgatctggtacggcggcagagaccagaactacgccgacagcgtgaagggcagattcaccatcagcagagacgacagcgacaacaccctgtacctgcagatgaacagcctgagagccggcgacaccgccgtgtacttctgcgccagaaacagccaggtgggcagactgatgcccgccgccggcgtgtggggccagggcaccctggtgaccgtgagcagcgccagcaccaagggc

SEQ ID NO: 34860 - RNA, 381 nt, synthetic construct
  misc_feature 1..381: note = derived and/or modified sequence opt4 from anti-HIV_Chain
  source 1..381: mol_type = other RNA
cagggccacctggtgcagagcggcggcggcgtgaagaagctgggcaccagcgtgaccatcagctgcctggccagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcacc

SEQ ID NO: 34861 - RNA, 381 nt, synthetic construct
  misc_feature 1..381: note = derived and/or modified sequence opt4 from anti-HIV_Chain
  source 1..381: mol_type = other RNA
caggtgcagctgctggagagcggcggcggcctggtgcagagaggcggcagcctgagactgagctgcaccgccagcggcttcgtgttcaacaactactggatgacctgggtgagacaggcccccggcaacggcctggagtgggtggccaacatcgaccaggacggcagcgagaagcactacctggacagcgtgaagggcagattcaccatcagcagagacaacgccaagaacagcctgtacctgcagatgaacagcctgagagccgaggacaccgccatctactactgcgccagagtgagattcaaggtgaccgcctggcacagattcgacagctggggccagggcgacctggtgaccgtgagcagcaccagcaccaagggc

SEQ ID NO: 34862 - RNA, 381 nt, synthetic construct
  misc_feature 1..381: note = derived and/or modified sequence opt4 from anti-HIV_Chain
  source 1..381: mol_type = other RNA
cagagcgccctgacccagccccccagcgccagcggcacccccggccagagagtgaccatcagctgcagcggcagctaccacaacatcggcagcaacgccgtgaactggtaccagcagctgcccggcaccgcccccaagctgctgatctacagcaacgaccagagacccagcggcgtgcccgacagattcagcggcagcaagagcggcaccagcgccagcctggccatcagcggcctgcagagcgaggacgaggccgactactactgcgccgcctgggacgacagcctgcacgtgttcggcaccggcaccaaggtgaccgtgctgggccagcccaaggccaaccccaccgtgaccctgttcccccccagcagcgaggagctg

SEQ ID NO: 34863 - RNA, 381 nt, synthetic construct
  misc_feature 1..381: note = derived and/or modified sequence opt4 from anti-HIV_Chain
  source 1..381: mol_type = other RNA
cagagcgtgctgacccaggtgctgagcgtgagcggcacccccggccagagagtgatcatcagctgcagcggcaccagcagcaacgtgggcggcaacctggtgagctggtaccagcacctgcccggcgccgcccccagactgctgatccacagagacgaccagagacccagcggcgtgcccgacagattcagcggcagcaagagcggcaacagcgccagcctggtgatcagcggcctgagaagcgacgacgaggccgactacttctgcgccgcctacgacagcaccttcagcctgcccgtgttcggcggcggcaccagactgaccgtgctgagccagcccaaggccgcccccagcgtgaccctgttcccccccagcagcgag

SEQ ID NO: 34864 - RNA, 381 nt, synthetic construct
  misc_feature 1..381: note = derived and/or modified sequence opt4 from anti-HIV_Chain
  source 1..381: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaacccctgccagttccagggcagagtgagcctgaccagacacgccagctgggacttcgacaccttcagcttctacatggacctgaaggccctgagaagcgacgacaccgccgtgtacttctgcgccagacagagaagcgactactgggacttcgacgtgtggggcagcggcacccaggtgaccgtgagcagcgccagcaccaag

SEQ ID NO: 34865 - RNA, 381 nt, synthetic construct
  misc_feature 1..381: note = derived and/or modified sequence opt4 from anti-HIV_Chain
  source 1..381: mol_type = other RNA
caggtgcagctggtgcagagcggcggcgaggtgagaaagcccggcagcagcgtgaaggtgccctgcaagatcagcggcaacgccttcagcaactacggcgtgaactgggtgagacaggcccccggccagggcctggagtgggtgggcagaatcatccccgtgatcggcgtggcccagcacgcccccaagttccagggcagagtgaccatcaccgccgacaagagcaccaccaccgcctacctggagctgagcagcctgagaagcgacgacaccgccgtgtacttctgcgccaaggaccacggcgaccccagaaccggctactacttcgactactggggccagggcgccctggtgaccgtgagcagcgccagcaccaagggc

SEQ ID NO: 34866 - RNA, 381 nt, synthetic construct
  misc_feature 1..381: note = derived and/or modified sequence opt4 from anti-HIV_Chain
  source 1..381: mol_type = other RNA
caggtgcagctgggccagagcggcaccgaggtgaagaagcccggcttcagcgtgaaggtgagctgcaaggccagcggcggcagcagcaccgcctacggctacagctgggtgagacaggcccccggccagggcttcgagtggatgggcagaatcatccccttctacggcatcatcacctacgcccccaagttccagggcagagtgaccatcaccgccgacagaagcaccagcaccgtgtacatggagctgaccagcctgaccttcgccgacaccgccctgttcttctgcgccagagacttcggcgaccccagaaacggctactacttcgacagctgggaccagggcctgtggctgaccgtgagcagcgccagcaccaagggc

SEQ ID NO: 34867 - RNA, 381 nt, synthetic construct
  misc_feature 1..381: note = derived and/or modified sequence opt4 from anti-HIV_Chain
  source 1..381: mol_type = other RNA
caggtgcagctggtgcagagcggcgccgaggtgaagaagcccggcagcagcgtgaaggtgagctgcaaggccagcggcggcaccttcagcaactacgccatcagctgggtgagacaggcccccggccagggcctggagtggatgggcggcatcatccccatcttcgaggccgccagctacgcccagaagttccaggacagactgaccatcaccaccgacgagagcaccaccaccgcctacatggacctgagcagcctgagaagcgaggacaccgccatctactactgcgccagagcccagggcgacatcctgaccgagggctacttcgactactggggccagggcaccctggtgaccgtgagcagcgccagcaccaagggc

SEQ ID NO: 34868 - RNA, 381 nt, synthetic construct
  misc_feature 1..381: note = derived and/or modified sequence opt4 from anti-HIV_Chain
  source 1..381: mol_type = other RNA
caggtgcagctgcaggagagcggccccggcctggtgaagcccagcgagaccctgagcctgacctgcaccgtgagcggcggcagcatcagcagcgccggctactactggagctggatcagacagcaccccgagaagggcctggagttcatcggctacatctactacctgggcaccacctactacaaccccagcctgaagagcagagtgagcatcagcatcgacaccagcaacaaccagttcagcctggagctgagcagcgtgagcgccgccgacaccgccatctactactgcgccagagactacaccgccagcggcagacacttcttcgactactggggccagggcaccctggtgaccgtgagcagcgccagcaccaagggc

SEQ ID NO: 34869 - RNA, 381 nt, synthetic construct
  misc_feature 1..381: note = derived and/or modified sequence opt4 from anti-HIV_Chain
  source 1..381: mol_type = other RNA
caggtgcagctggtgcagagcggcgccgaggtgaagaagcccggcgccagcgtgaaggtgagctgcaaggcccccggctacaccttcatcggccactacatgcactggatcagacaggcccccggccagggcctggagtggatgggctggatcaaccccaacagcggcgacaccaactacgcccagaccttccagggcagagtgaccatgaccagagacaccagcatcagcaccgcctacatggagctgaccagactgagaagcgacgacaccgccgtgtactactgcgccagagacctgagacccatgagaggcaactgggccatgcacgtgtggggcgagggcaccaccgtgaccgtgagcagcgccagcaccaagggc

SEQ ID NO: 34870 - RNA, 381 nt, synthetic construct
  misc_feature 1..381: note = derived and/or modified sequence opt4 from anti-HIV_Chain
  source 1..381: mol_type = other RNA
caggtgcagctgcaggagagcggccccggcctggtgaagcccagcgagaccctgagcctgacctgcaccgtgttcggcgccagcatcagaagcttctactggcactggatcagacagagccccggcaagggcctggagtggctgggcagcgtgttcgacaacggcctgaccacctacaaccccagcctgaagaacagactgagcatcagcgaggaccccagcagaaaccagatcagcctgaacctgagaagcatgaccgccgccgacaccgccgtgtactactgcgccagagccgactacgacctgctgaccagcagctaccacttcgacagctggggccagggcaccctggtgaccgtgagcagcgccagcaccaagggc

SEQ ID NO: 34871 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagcccggcgccagcgtgagagtgagctgccaggccagcggctacaccttcaccgactacgtgctgcactggtggagacaggcccccggccagggcctggagtggatgggctggatcaagcccgtgtacggcgccagaaactacgcccacagattccagggcagaatcaacttcgacagagacgtgtacagagagatcgcctacatggacctgagcggcctgagaagcgacgacaccgccgtgtacttctgcgccagagacggcagcggcgacgccaccagctggcacctgcacccctggggccagggcaccctggtgatcgtgagcagcgccagcaccaagggc

SEQ ID NO: 34872 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagcccggcgccagcgtgagagtgagctgccaggccagcggctacaccttcaccaactacatcctgcactggtggagacaggcccccggcagaggcctggagtggatgggcctgatcaagcccgtgtacggcgccgtgaactacgccagacagttccagggcagaatccagctgaccagagacatctacagagagatcgccttcctggacctgagcggcctgagacccgacgacaccgccgtgtactactgcgccagagacgagagcggctacgacctgaactggcacctggacagctggggccagggcacccaggtgatcgtgagccccgccagcaccaagggc

SEQ ID NO: 34873 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcgcccaggtgaagaagcccggcgccagcctgagagtgagctgccaggccagcggctacaccttcatgaactacctgctgcactggtggagacaggcccccggccagggcctggagtggatgggctggatcaaccccgtgtacggcgccgtgaactacgcccacagattccagggcagactgaccttcagcagagacgtgtacagagagatcgcctacatggacctgaacggcctgagaagcgacgacaccgccgtgtacttctgcgccagagacggcagcggcgacgacagaaactggcacctggacccctggggccagggcaccctggtgatcgtgagcagcgccagcaccaagggc

SEQ ID NO: 34874 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagcccggcgccagcgtgagaatcagctgccaggccagcggctacaccttcaccgactacgtgctgcactggtggagacaggcccccggccagggcctggagtggatgggctggatcaagcccgtgtacggcgccagaaactacgccagaagattccagggcagaatcaacttcgacagagacatctacagagagatcgccttcctggacctgagcggcctgagaagcgacgacaccgccagatacttctgcgccagagacggcagcggcgacgacaccagctggcacctgcacccctggggccagggcaccctggtgatcgtgagcgccgccagcaccaagggc

SEQ ID NO: 34875 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagaccggcgccagcgtgagagtgagctgccaggccagcggctacgacttcaccaagtacctgatccactggtggagacaggcccccggccagggcctggagtggatgggctggatgaagcccgtgtacggcgccaccaactacgcccacagattccagggcagaatcagcttcaccagagacatctacagagagatcgccttcatggacctgaacggcctgagaagcgacgacaccgccgtgtacttctgcgccagagacggcggcggcgacgacagaacctggctgctggacgcctggggccagggcaccctggtgatcgtgagcagcgccagcaccaagggc

SEQ ID NO: 34876 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagcccggcgccagcgtgagagtgagctgccaggccagcggctacaccttcatgaactacatcatccactggtggagacaggcccccggccagagactggagtggatgggctggatcaaccccgtgttcggcgccagaaactacgcccacagattccagggcagaatcaacttcgacagagacatcaacagagagaccttccagatggacctgaccggcctgagaagcgacgacaccgccgtgtactactgcgccagagacggcagcggcgacgccagagactggcacctgcacccctggggccagggcaccctggtgatcgtgagcagcgccagcaccaagggc

SEQ ID NO: 34877 - RNA, 381 nt, synthetic construct
  misc_feature 1..381: note = derived and/or modified sequence opt4 from anti-HIV_Chain
  source 1..381: mol_type = other RNA
agccagcacctggtgcagagcggcacccaggtgaagaagcccggcgccagcgtgagagtgagctgccaggccagcggctacaccttcaccaactacatcctgcactggtggagacaggcccccggccagggcctggagtggatgggcctgatcaagcccgtgttcggcgccgtgaactacgccagacagttccagggcagaatccagctgaccagagacatcaacagagagatcgccttcctggacctgagcggcctgagaagcgacgacaccgccgtgtactactgcgccagagacgagagcggcgacgacctgaagtggcacctgcacccctggggccagggcacccaggtgatcgtgagccccgccagcaccaagggc

SEQ ID NO: 34878 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagcccggcgccagcgtgagagtgagctgccaggccagcggctacaccttcatgaactacatcatccactggtggagacaggcccccggccagagactggagtggatgggctggatcaaccccgtgttcggcgccagaaactacgcccacagattccagggcagaatcaacttcgacagagacatcaacagagagaccttccagatggagctgaccggcctgagaagcgacgacaccgccgtgtactactgcgccagagacggcagcggcgacgccagagactggcacctggacccctggggccagggcaccctggtgatcgtgagcagcgccagcaccaagggc

SEQ ID NO: 34879 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagcccggcgccagcgtgagaatcagctgccaggccagcggctacaccttcaccgactacgtgctgcactggtggagacaggcccccggccagggcctggagtggatgggctggatcaagcccgtgtacggcgccagaaactacgccagaagattccagggcagaatcaacttcgacagagacatctacagagagatcgcctacatggacctgagcggcctgagaagcgacgacaccgccagatacttctgcgccagagacggcagcggcgacgacaccagctggcacctgcacccctggggccagggcaccctggtgatcgtgagcgccgccagcaccaagggc

SEQ ID NO: 34880 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagcccggcgccagcgtgagaatcagctgccaggccagcggctacagcttcaccgactacgtgctgcactggtacagacaggcccccggccagggcctggagtggatgggctggatcaagcccgtgtacggcgccagaaactacgccagaagattccagggcagaatcaacttcgacagagacatctacagagagatcgccttcatggacctgagcggcctgagaagcgacgacaccgccctgtacttctgcgccagagacggcagcggcgacgacaccagctggtacctggacccctggggccagggcaccctggtgatcgtgagcgccgccagcaccaagggc

SEQ ID NO: 34881 - RNA, 381 nt, synthetic construct
  misc_feature 1..381: note = derived and/or modified sequence opt4 from anti-HIV_Chain
  source 1..381: mol_type = other RNA
agccagcagctggtgcagagcggcacccaggtgaagaagcccggcgccagcgtgagaatcagctgccaggccagcggctacagcttcaccgactacgtgctgcactggtggagacaggcccccggccagggcctggagtggatgggctggatcaagcccgtgtacggcgccagaaactacgccagaagattccagggcagaatcaacttcgacagagacatctacagagagatcgccttcatggacctgagcggcctgagaagcgacgacaccgccctgtacttctgcgccagagacggcagcggcgacgacaccagctggcacctggacccctggggccagggcaccctggtgatcgtgagcgccgccagcaccaagggc

SEQ ID NO: 34882 - RNA, 381 nt, synthetic construct
  misc_feature 1..381: note = derived and/or modified sequence opt4 from anti-HIV_Chain
  source 1..381: mol_type = other RNA
agccagcacctggtgcagagcggcacccaggtgaagaagcccggcgccagcgtgagagtgagctgccaggccagcggctacaccttcaccaactacatcctgcactggtggagacaggcccccggccagggcctggagtggatgggcctgatcaagcccgtgttcggcgccgtgaactacgccagacagttccagggcagaatccagctgaccagagacatctacagagagatcgccttcctggacctgagcggcctgagaagcgacgacaccgccgtgtactactgcgccagagacgagagcggcgacgacctgaagtggcacctgcacccctggggccagggcacccaggtgatcgtgagccccgccagcaccaagggc

SEQ ID NO: 34883 - RNA, 381 nt, synthetic construct
  misc_feature 1..381: note = derived and/or modified sequence opt4 from anti-HIV_Chain
  source 1..381: mol_type = other RNA
caggtgcagctggtggagagcggcggcggcgtggtgcagcccggcaagagcctgagactgagctgcgccatcagcggcttcctgttcaacaactacggcggccagtgggtgagacaggcccccggcaagggcctggagtgggtggccgccatcagctacgacggcaacaacagatactacgccgacagcgccaagggcagattcctgatcagcagagacacccccaagaacatcctgtacctgcagatctacagcctgagactggacgacaccgccgtgtactactgcgccagagacagcgtgagcaagagctacagcgccccccccgagttctggggccagggcaccgtggtgaccgtgagcagcgccagcaccaagggc

SEQ ID NO: 34884 - RNA, 381 nt, synthetic construct
  misc_feature 1..381: note = derived and/or modified sequence opt4 from anti-HIV_Chain
  source 1..381: mol_type = other RNA
caggtgcacctggaggagagcggccccggcctggtgaagaccagccagaccctgagcctgacctgcagcgtgagcagctacagcatcagcagaagcggctacttctggacctggatcagacagagacccggcaagggcctggagtggatcggctacatctacttcaacggcagaaccacctacaaccccagcctgaagagcagaatcaccatcagcagagacaccagccacagccagttcagcctgaccctgaacagcctgagcgccgccgacaccgccgtgtactactgcggcagatgccaggacggcctggccagcagacccatcgacttctggggccagggcaccctggtgaccgtgagcagcgccagcaccaagggc

SEQ ID NO: 34885 - RNA, 381 nt, synthetic construct
  misc_feature 1..381: note = derived and/or modified sequence opt4 from anti-HIV_Chain
  source 1..381: mol_type = other RNA
caggtgcagctggtggagagcggcggcggcgtggtgcagcccggcagaagcctgagactgagctgcgccaccagcggcttcaccagcaagaactacggcgtgcactgggtgagacaggcccccggcaagggcctggagtgggtggccgtgatctggtacgacggcagcaacaagttctacgccgacagcgtgaagggcagattcaccatcagcagagacagaagcaagaacatggtgtacctgcagatgaacagcctgagagtggaggacaccgccatctactactgcgccagagacagcgtggccttcgtgctggagggccccatcgactactggggccagggcaccctggtgaccgtgagcagcgccagcaccaagggc

SEQ ID NO: 34886 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcggcggcgtgaagaagcccggcaccagcgccagcttcagctgcagaaccagcgacgacatctacgacaacgagttcttcgacagcgccttcatgcactgggtgagactgatccccggccagagacccgagtggatgggctggatgaaccccagaagcggcgccgtgaactacgccagacagctgcagcccagagtgagcatgtacagagacagagacctgagcaccgcctacatggagttcaagagcctgaccagcgccgacaccggcacctacttctgcgccagaaagaagagaggcgacggcttcaacctgtacttcgacctgtggggcagaggcagccaggtgatcgtgagcagcgcc

SEQ ID NO: 34887 - RNA, 384 nt, synthetic construct
  misc_feature 1..384: note = derived and/or modified sequence opt4 from anti-HIV_Chain
  source 1..384: mol_type = other RNA
cagggccacctggtgcagagcggcggcggcgtgaagaagctgggcaccagcgtgaccatcagctgcctggccagcgaggacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcaccagc

SEQ ID NO: 34888 - RNA, 384 nt, synthetic construct
  misc_feature 1..384: note = derived and/or modified sequence opt4 from anti-HIV_Chain
  source 1..384: mol_type = other RNA
cagagcgccctgacccagccccccagcgtgagcggcgcccccggccagagagtgaccatcagctgcagcggcggccccagcaacgtgggcggcaactacgtgtactggtacagacagttccccggcaccgcccccaagctgctgatcctgagagacgaccagagacccagcggcgtgcccgacagattcagcgccagcaagagcggcaacagcgccagcctggccatcagcggcctgagacccgacgacgaggccttctacttctgcgccacctacgacagccagggcagcttcagagtgttcggcggcggcaccgccctgaccgtgctgagccagcccaaggccgcccccagcgtgaccctgtacccccccagcagcgaggag

SEQ ID NO: 34889 - RNA, 384 nt, synthetic construct
  misc_feature 1..384: note = derived and/or modified sequence opt4 from anti-HIV_Chain
  source 1..384: mol_type = other RNA
aacttcatgctgacccagccccccagcgccagcggcacccccggccagagagtgaccatcagctgcagcggcggcggcagcaacatcggcggcaacctggtgagctggtaccagcacttccccggcgccgcccccaagctgctgatctacagaaacgaccagagacccagcggcgtgcccgacagattcagcggcagcaagagcggcaccagcgccagcctggccatcagcggcctgagaagcgacgacaaggccacctacttctgcgccgcctacgacagcaccctgagcctgagactgttcggcggcggcaccaccctgaccgtgctgagccagcccaaggccgcccccagcgtgaccctgttcccccccagcagcgaggag

SEQ ID NO: 34890 - RNA, 384 nt, synthetic construct
  misc_feature 1..384: note = derived and/or modified sequence opt4 from anti-HIV_Chain
  source 1..384: mol_type = other RNA
aacttcatgctgacccagccccccagcgtgagcgccacccccggccagaccgtgaccatcagctgcagcggcagcggcagcaacgtgggcggcaaccacgtgtactggtacagacagctgcccggcgccgcccccaccctggtgatcagcaagaccgaccacagacccagcagagtgcccgacagattcagcggcagcaagagcggcaacagcgccagcctggccatcagcggcctgagacccgacgacgaggccgtgtacttctgcgccacctacgacaccggcctgagcctgagactgttcggcggcggcaccagactgaccgtgctgagccagcccaaggccgcccccagcgtgacccagttcccccccagcagcgaggag

SEQ ID NO: 34891 - RNA, 384 nt, synthetic construct
  misc_feature 1..384: note = derived and/or modified sequence opt4 from anti-HIV_Chain
  source 1..384: mol_type = other RNA
cagagcgccctgacccagccccccagcgccagcggcgcccccggccagagagtgaccatcagctgcagcggcggccccagcaacgtgggcggcaactacgtgtactggtacagacagttccccggcaccgcccccaagctgctgatcctgagagacgaccagagacccagcggcgtgcccgacagattcagcgccagcaagagcggcaacagcgccagcctggccatcagcggcctgagacccgacgacgaggccctgtacttctgcgccacctacgacagcgacggcagcatcagactgttcggcggcggcaccgccctgaccgtgctgagccagcccaaggccgcccccagcgtgaccctgttcccccccggctgggaggag

SEQ ID NO: 34892 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagactgttccagggcagagtgagcctgaccagacacgccagctgggacttcgacaccttcagcttctacatggacctgaaggccgtgagaagcgacgacaccgccgtgtacttctgcgccagacagagaagcgactactgggacttcgacgtgtggggcagcggcacccaggtgaccgtgagcagcgccagcaccaagggc

SEQ ID NO: 34893 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgtggtgaccaagcccggcgccagcgtgagagtgagctgcgaggccagcggctacaagatcagagactacttcatccactggtggagacaggcccccggccagggcctgcagtgggtgggctggatcaacccccagaccggccagcccaacatccccagacccttccagggcagagtgaccctgaccagacacgccagctgggacttcgacaccttcagcttctacatggacctgaaggccctgagaagcgacgacaccgccatctacttctgcgccagaagaagaagcgactactgcgacttcgacgtgtggggcagcggcacccacgtgaccgtgagcagcgccagcaccaagggc

SEQ ID NO: 34894 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacaggccagctgggacttcgacaccatcagcttctacatggacctgaaggccctgagactggacgacaccgccgtgtacttctgcgccagacagagaagcgactactgggacttcgacgtgtggggcagcggcacccaggtgaccgtgagcagcgccagcaccaagggc

SEQ ID NO: 34895 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacacgccagctgggacttcgacaccttcagcttctacatggacctgaaggccctgagaagcgacgacaccgccgtgtacttctgcgccagacagagaagcgactactgggacttcgacgtgtggggcagcggcacccaggtgaccgtgtacagcgccagcaccaagggc

SEQ ID NO: 34896 - RNA, 384 nt, synthetic construct
  misc_feature 1..384: note = derived and/or modified sequence opt4 from anti-HIV_Chain
  source 1..384: mol_type = other RNA
caggtgcagctgctgcccttcggcggcgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaacccctgccagttccagggcagagtgagcctgaccagacccgccagctgggacttcgacaccatcagcttctacatggacctgaaggccctgagactggacgacaccgccgtgtacttctgcgccagacagagaagcgactactgggacttcgacgtgtggggcagcggcacccaggtgaccgtgagcagcgccagcaccaagggc

SEQ ID NO: 34897 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagagtgagcctgaccagacaggccagctgggacttcgacacctacagcttctacatggacctgaaggccctgagaagcgacgacaccgccatctacttctgcgccagacagagaagcgacttctgggacttcgacgtgtggggcagcggcacccaggtgaccgtgagcagcgccagcaccaagggc

SEQ ID NO: 34898 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagagtgagcctgaccagacaggccagctgggacttcgacacctacagcttctacatggacctgaaggccgtgagaagcgacgacaccgccatctacttctgcgccagacagagaagcgacttctgggacttcgacgtgtggggcagcggcacccaggtgaccgtgagcagcgccagcaccaagggc

SEQ ID NO: 34899 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagaatcagcctgaccagacaggccagctgggacttcgacaccttcagcttctacatggacctgaaggccctgagaagcgacgacaccgccgtgtacttctgcgccagacagagaagcgactactgggacttcgacgtgtggggcagcggcacccaggtgaccgtgagcagcgccagcaccaagggc

SEQ ID NO: 34900 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacacgccagctgggacttcgacaccttcagcttctacatggacctgaagggcctgagaagcgacgacaccgccatctacttctgcgccagacagagaagcgactactgggacttcgacgtgtggggcagcggcacccaggtgaccgtgagcagcgccagcaccaagggc

SEQ ID NO: 34901 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacacgccagctgggacttcgacaccttcagcttctacatggacctgaaggccctgagaagcgacgacaccgccgtgtacttctgcgccagacagagaagcgactactgggacttcgacgtgtggggcagcggcacccaggtgaccgtgagcagcgccagcaccaagggc

SEQ ID NO: 34902 - RNA, 384 nt, synthetic construct
  misc_feature 1..384: note = derived and/or modified sequence opt4 from anti-HIV_Chain
  source 1..384: mol_type = other RNA
cacgtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacaggccagctgggacttcgacaccttcagcttctacatggacctgaaggccctgagactggacgacaccgccatctacttctgcgccagacagagaagcgactactgggacttcgacgtgtggggcagcggcacccaggtgaccgtgagcagcgccagcaccaagggc

SEQ ID NO: 34903 - RNA, 384 nt, synthetic construct
  misc_feature 1..384: note = derived and/or modified sequence opt4 from anti-HIV_Chain
  source 1..384: mol_type = other RNA
caggtgcacctgagccacagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagaatcagcctgaccagacaggccagctgggacttcgacaccttcagcttctacatggacctgaaggccctgagaagcgacgacaccgccgtgtacttctgcgccagacagagaagcgactactgggacttcgacgtgtggggcagcggcacccaggtgaccgtgagcagcgccagcaccaagggc

SEQ ID NO: 34904 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgtggtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagaatcagcctgaccagacaggccagctgggacttcgacaccttcagcttctacatggacctgaaggccctgagaagcgacgacaccgccgtgtacttctgcgccagacagagaagcgactactgggacttcgacgtgtggggcagcggcacccaggtgaccgtgagcagcgccagcaccaagggc

SEQ ID NO: 34905 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgtggtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagaatcagcctgaccagacaggccagctgggacatcgacaccttcagcttctacatggacctgaaggccctgagaagcgacgacaccgccgtgtacttctgcgccagacacagaagcgactactgggacttcgacgtgtggggcagcggcacccaggtgaccgtgagcagcgccagcaccaagggc

SEQ ID NO: 34906 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgtggtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacatccccagacagttccagggcagaatcagcctgaccagacaggccagcggcgacttcgacaccttcagcttctacatggacctgaaggccctgagaagcgacgacaccgccgtgtacttctgcgccagacagagaagcgactactgggacttcggcgtgtggggcagcggcacccaggtgaccgtgagcagcgccagcaccaagggc

SEQ ID NO: 34907 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgtggtgaccaagcccggcgccagcgtgagagtgagctgcgaggccagcggctacaagatcagcggccacttcatccactggtggagacaggcccccggccagggcctgcagtgggtgggctggatcaaccccaagaccggccagcccaacaaccccagacagttccagggcagaatcagcctgaccagacaggccagctgggacttcgacaccttcagcttctacatggacctgaaggccctgagaagcgacgacaccgccgtgtacttctgcgccagacacagaagcgactactgggacttcgacgtgtggggcagcggcacccaggtgaccgtgagcagcgccagcaccaagggc

SEQ ID NO: 34908 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagaatcagcctgaccagacaggccagctgggacttcgacaccttcagcttctacatggacctgaaggccctgagaagcgacgacaccgccgtgtacttctgcgccagacacagaagcgactactgggacttcgacgtgtggggcagcggcacccaggtgaccgtgagcagcgccagcaccaagggc

SEQ ID NO: 34909 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagagtgagcctgaccagacaggccagctgggacttcgacacctacagcttctacatgggcctgaaggccgtgagaagcgacgacaccgccatctacttctgcgccagacagagaagcgacttctgggacttcgacgtgtggggcagcggcacccaggtgaccgtgagcagcgccagcaccaagggc

SEQ ID NO: 34910 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgtggtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagaatcagcctgaccagacaggccagctgggacttcgacaccttcagcttctacatggacctgaaggccctgagaagcgacgacaccgccgtgtacttctgcgccagacacagaagcgactactgggacttcgacgtgtggggcagcggcacccaggtgaccgtgagcagcgccagcaccaagggc

SEQ ID NO: 34911 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgtggtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagaatcagcctgaccagacaggccagctgggacttcgacaccttcagcttctacatggacctggaggccctgagaagcgacgacaccgccgtgtacttctgcgccagacagagaagcgactactgggacttcgacgtgtggggcagcggcacccaggtgaccgtgagcagcgccagcaccaagggc

SEQ ID NO: 34912 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgccgtgaccaagcccggcgccagcgtgagagtgagctgcgaggccagcggctacaagatcagagactacagcatccactggtggagacaggcccccggccagggcctgcagtgggtgggctggatcaacccccagaccggccagcccaacatccccagacccttccagggcagaatcagcctgaccagacaggccagctgggacttcgacaccttcagcttctacatggacctggaggccctgagaagcgacgacaccgccgtgtacttctgcgccagacagagaagcgactactgggacttcgacgtgtggggcagcggcacccaggtgaccgtgagcagcgccagcaccaagggc

SEQ ID NO: 34913 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgccgtgaccaagcccggcgccagcgtgagagtgagctgcgaggccagcggctacaagatcagcgaccacttcatccactggtggagacaggcccccggccagggcctgcagtgggtgggctggatcaaccccaagaccggccagcccaacaaccccagacagttccagggcagaatcagcctgaccagacaggccagctgggacttcgacaccttcagcttctacatggacctgaaggccctgagaagcgacgacaccgccgtgtacttctgcgccagacagagaagcgactacagagacttcgacgtgtggggcagcggcacccaggtgaccgtgagcagcgccagcaccaagggc

SEQ ID NO: 34914 - RNA, 384 nt, synthetic construct
  misc_feature 1..384: note = derived and/or modified sequence opt4 from anti-HIV_Chain
  source 1..384: mol_type = other RNA
caggtgcacctgagccagagcggcgccgtggtgaccaagcccggcgccagcgtgagagtgagctgcgaggccagcggctacaagatcagcgaccacttcatccactggtggagacaggcccccggccagggcccccagtgggtgggctggatcaaccccaagaccggccagcccaacaaccccagacagttccagggcagaatcagcctgaccagacaggccagctgggacttcgacaccttcagcttctacatggacctgaaggccctgagaagcgacgacaccgccgtgtacttctgcgccagacacagaagcgactactgggacttcgacgtgtggggcagcggcacccaggtgaccgtgagcagcgccagcaccaagggc

SEQ ID NO: 34915 - RNA, 384 nt, synthetic construct
  misc_feature 1..384: note = derived and/or modified sequence opt4 from anti-HIV_Chain
  source 1..384: mol_type = other RNA
caggtgagactgctgcagagcggcgccgccgtgaccaagcccggcgccagcgtgagagtgagctgcgaggccagcggctacgagatcagagactacttcatccactggtggagacaggcccccggccagggcctgcagtgggtgggctggatcaaccccaagaccggccagcccaacaaccccagacagttccagggcagagtgagcctgaccagacaggccagctgggacttcgacagctacagcttctacatggacctgaaggccctgagaagcgacgacaccgccgtgtacttctgcgccagacagagaagcgactactgggacttcgacgtgtggggcagcggcacccaggtgaccgtgagcagcgccagcaccaagggc

SEQ ID NO: 34916 - RNA, 384 nt, synthetic construct
  misc_feature 1..384: note = derived and/or modified sequence opt4 from anti-HIV_Chain
  source 1..384: mol_type = other RNA
caggtgagactgctgcagagcggcgccgccgtgaccaagcccggcgccagcgtgagagtgagctgcgaggccagcggctacgagatcagagactacttcatccactggtggagacaggcccccggccagggcctgcagtgggtgggctggatcaaccccaagaccggccagcccaacaaccccagacagttccagggcagagtgagcctgaccagacaggccagctgggacttcgacagctacagcttctacatggacctgaaggccctgagaagcgacgacaccggcgtgtacttctgcgccagacagagaagcgactactgggacttcgacgtgtggggcagcggcacccaggtgaccgtgagcagcgccagcaccaagggc

SEQ ID NO: 34917 - RNA, 384 nt, synthetic construct
  misc_feature 1..384: note = derived and/or modified sequence opt4 from anti-HIV_Chain
  source 1..384: mol_type = other RNA
caggtgagactgctgcagagcggcgccgccgtgaccaagcccggcgccagcgtgagagtgagctgcgaggccagcggctacgagatcagagactacttcatccactggtggagacaggcccccggccagggcctgcagtgggtgggctggatcaaccccaagaccggccagcccaacaaccccagacagttccagggcagagtgagcctgaccagacaggccagctgggacttcgacagctacagcttctacatggacctgaaggccctgagaagcgacgacaccgccgtgtacttctgcgccagacagagaagcgactactgggacttcgacgtgtggggcagcggcagccaggtgaccgtgagcagcgccagcaccaagggc

SEQ ID NO: 34918 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaacccctgccagttccagggcagagtgagcctgaccagacaggccagctgggacttcgacaccatcagcttctacatggacctgaaggccctgagactggacgacaccgccgtgtacttctgcgccagacagagaagcgactactgggacttcgacgtgtggggcagcggcacccaggtgaccgtgagcagcgccagcaccaagggc

SEQ ID NO: 34919 - RNA, 384 nt, synthetic construct
  misc_feature 1..384: note = derived and/or modified sequence opt4 from anti-HIV_Chain
  source 1..384: mol_type = other RNA
caggtgcagctgctgcagagcggcgccgccgtgaccaagcccggcgccagcgtgagagtgagctgcgaggccagcggctacaacatcagagactacttcatccactggtggagacaggcccccggccagggcctgcagtgggtgggctggatcaaccccaagaccggccagcccaacaaccccagacagttccagggcagagtgagcctgaccagacacgccagctgggacttcgacaccttcagcttctacatggacctgaaggccctgagaagcgacgacaccgccgtgtacttctgcgccagacagagaagcgactactgggacttcgacgtgtggggcagcggcacccaggtgatcgtgagcagcgccagcaccaagggc

SEQ ID NO: 34920 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgacgtgaagaagcccggcgccaccgtgaccgtgagctgcaagaccgacgaggacgaggacgacttcagagcccacctgatgcagtggatgagacaggcccccggccagagactggagtgggtgggctggatcaagccccagaccggccagcccagctacggccagaagttccagggcagagtgaccctgaccagagaggtgagcaccagcaccgtgttcctgcagctgagaaacctgagaagcgacgacaccgccgtgtactactgcgccagacccagaggcggcagagacaactggagcttccacgtgtggggcagaggcaccctggtgaccgtgagcagcgccagcaccaagggc

SEQ ID NO: 34921 - RNA, 384 nt, synthetic construct
  misc_feature 1..384: note = derived and/or modified sequence opt4 from anti-HIV_Chain
  source 1..384: mol_type = other RNA
gaggtgcagctggtggagagcggcgccgaggtgaagaagcccggcgccagcgtgaaggtgagctgcaaggtgagcggcaacagcctgaccgagttcagcatccactgggtgagacaggcccccggcaagggcctggagtggatgggcggcttcgaccccgaggagggcgagaccgtgcccgcccagaagttcaagggcagactgaccatgaccgaggacaccagcaccaacaccgcctacatggagctgagcagcctgagaagcgaggacaccgccgtgtactactgcagcaccgagcccagagagatgggcaccctgaccgccggcttcgagtactggggccagggcaccctggtgaccgtgagcagcgccagcaccaagggc

SEQ ID NO: 34922 - RNA, 384 nt, synthetic construct
  misc_feature 1..384: note = derived and/or modified sequence opt4 from anti-HIV_Chain
  source 1..384: mol_type = other RNA
agagtgcagctgggccagagcggcgccgaggtgaagaagcccggcgccagcgtgaaggtgagctgcaaggtgagcggcaacagcctgaccgagttcagcatccactgggtgagacaggcccccggcaagggcctggagtggatgggcggcttcgaccccgaggagggcgagaccgtgcccgcccagaagttcaagggcagagtgaccatgaccgaggacaccagcaccaacaccgcctacatggagctgagcagcctgagaagcgaggacaccgccgtgtactactgcagcaccgagcccagagagatgggcaccctgaccgccggcttcgagtactggggccagggcaccctggtgatcgtgagcagcgccagcaccaagggc

SEQ ID NO: 34923 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgacgtgaagaagcccggcgccagcgtgaccgtgagctgcaagaccgacgaggacgaggacgacttcagagcccacctggtgcagtggatgagacaggcccccggccagagactggagtgggtgggctggatcaagccccagaccggccagcccagctacgcccagaagttccagggcagagtgaccctgaccagagaggtgagcaccagcaccgtgttcctgcagctgagaaacctgagaagcgacgacaccgccgtgtactactgcgccagacccagaggcggcagagacaactggagcttccacgtgtggggcagaggcaccctggtgaccgtgagcagcgccagcaccaagggc

SEQ ID NO: 34924 - RNA, 384 nt, synthetic construct
  misc_feature 1..384: note = derived and/or modified sequence opt4 from anti-HIV_Chain
  source 1..384: mol_type = other RNA
caggtgcagctgcaggagagcggccccggcctggtgaagcccagcgagaccctgagcctgacctgcagcgtgagcggcgccagcatcagcaacttctactggacctggatcagacagcccgccggcaagggcctggagtgggtgggcagactgtacagcagcgacagaaccaactacaaccccagcctgaacggcagagtgaccatgagcctggacaccagcaagaaccagttcagcctgagactgaccagcatgaccgacgccgacaccgccatctacttctgcgccagagagaagggccagtggctgaccgtgcccccctactacttcgacagctggggccagggcatcctggtgaccgtgagcagcgccagcaccaagggc

SEQ ID NO: 34925 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgaggtgagaaagcccggcgccagcgtgaaggtgagctgcaagaccagcggctacaccttcaccaacagctacatccactgggtgagacaggcccccggccagggcctggagtggatgggcatcatcaacccccccggcggcaacacctactacgcccagaagttccacggcagagtgaccctgaccagagacaccagcaccagcaccgtgtacatggagctgaacagcctgagaagcgaggacaccgccgtgtacttctgcgccagaccccacagccccaccaacatccccagcagacccctggactactggggccagggcaccctggtgaccgtgagcagcgccagcaccaagggc

SEQ ID NO: 34926 - RNA, 384 nt, synthetic construct
  misc_feature 1..384: note = derived and/or modified sequence opt4 from anti-HIV_Chain
  source 1..384: mol_type = other RNA
caggtgcagctgcaggagagcggccccggcctggtgaagcccagcggcaccctgagcctgacctgcaacgtgtacggcggcagcatgatcagctactactggagctggatcagacagccccccggcaagggcctggagtggatcggccacgtgtacaacagcggcaacaccaagtacagccccagcctgaagaacagagtgaccatcagcatggacaccagcagaaacctgttcagcctgaaggtgaccagcgtgacccccgccgacaccgccgtgtactactgcgccagagccgactacgacaacatctgggacagcagaggcggcttcgacctgtggggccagggcaccctggtgaccgtgagcagcgccagcaccaagggc

SEQ ID NO: 34927 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgaggtgaagaagcccggcagcagcgtgaaggtgagctgcaaggccagcggcggcaccctgagcagctacaccatcagctgggtgagacaggcccccggccagggcctggagtggatgggcagactgatccccctggtggacatcaccacctacgcccagaagttccagggcagagtgaccatcaccgccgacaccagcaccaacaccgcctacatggagctgagcaacctgagaagcgaggacaccgccatctaccactgcgccaccagcaccatgatcgccgccgtgatcaacgacgccttcgacctgtggggccagggcaccaccgtgaccgtgagcagcgccagcaccaagggc

SEQ ID NO: 34928 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgaggtgaagaagcccggcgccagcgtgaagatcagctgcaaggccagcggctacagcttcagaaactacgccgtgcactgggtgagacaggcccccggccagggcctggagtggatgggcgagatcaacggcggcaacggcaacaccgagtacagccagaagagccagggcagactgaccatcaccagagacatcagcgccaccaccgcctacatggagctgagcagcctgagaagcgacgacaccgccgtgtactactgcgccagagtggcctacgtgcacgtggtgaccaccagaagcctggacaactggggccagggcaccctggtgaccgtgagcagcgccagcaccaagggc

SEQ ID NO: 34929 - RNA, 384 nt, synthetic construct
  misc_feature 1..384: note = derived and/or modified sequence opt4 from anti-HIV_Chain
  source 1..384: mol_type = other RNA
caggtgagactgagccagagcggcgccgccgtgatgaagaccggcgccagcgtgaccatcagctgcgagaccgagggcttcaacttcgtgaactacatcatccactgggtgagaagaccccccggcagaggcttcgagtggctgggcatgatcgaccccagaaacggccacccctggttcgcccagaccgtgagaggcagactgagcctgagaagagacaccttcaacgagatcgtgtacatgaccctgagcggcctgaccaccgacgacaccggcctgtacttctgcgccagaaacgagccccagtaccacagcctgcccggcatgttcgactactggggccagggcacccccgtgaccgtgagcagcgccagcaccaagggc

SEQ ID NO: 34930 - RNA, 384 nt, synthetic construct
  misc_feature 1..384: note = derived and/or modified sequence opt4 from anti-HIV_Chain
  source 1..384: mol_type = other RNA
caggtgagactgagccagagcggcgccgccgtggtgaagaccggcgccagcgtgaccatcagctgcgagaccgagggctacaacttcgtgaactacatcatccactgggtgagaagaccccccggcagaggcttcgagtggctgggcatgatcgaccccagaaacggccacccctggttcgcccagaccgtgagaggcagactgagcctgagaagagacaccttcaaggagaccgtgtacatgaccctgagcggcctgaccagcgacgacaccggcgtgtacttctgcgccagaaacgagccccagtaccacagcctgcccggcatgttcgactactggggccacggcacccccgtgaccgtgagcagcgccagcaccaagggc

SEQ ID NO: 34931 - RNA, 384 nt, synthetic construct
  misc_feature 1..384: note = derived and/or modified sequence opt4 from anti-HIV_Chain
  source 1..384: mol_type = other RNA
cagggccagctggtgcagagcggcggcggcgtgaagaagctgggcaccagcgtgaccatcagctgcctggccagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcaccagc

SEQ ID NO: 34932 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgaggtgaagaagcccggcgccagcgtgaaggtgagctgcaaggccagcggctacaccttcaccagctacgacatcaactgggtgagacaggccaccggccagggcctggagtggatgggctggatgaaccccaacagcggcaacaccggctacgcccagaccttccagggcagagtgaccatgaccagaaacaccagcatcagcaccgcctacatggagctgagcagcctgagaagcgaggacaccgccgtgtactactgcgccagagacagatggctgccccagtactactactacggcatggacgtgtggggccagggcaccaccgtgaccgtgagcagcgccagcaccaagggc

SEQ ID NO: 34933 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgaggtgaagaagcccggcagcagcatgaaggtgagctgcaagagcagcggcggcaccttcagcaaccacgccatcagctgggtgagacaggcccccggcaagggcctggagtggatgggcggcatcatccccatgagcggcaccaccaactacctgcagaagttccagggcagagtgaccatcaccgccgacgagttcgccaccaccgcctacatggagctgagcagcctgaccagcgaggacaccgccgtgtactactgcgccagagccagagccgacagccacacccccatcgacgccttcgacatctggggccccggcaccagagtgatcgtgagcagcgccagcaccaagggc

SEQ ID NO: 34934 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgaggtgaagaagcccggcgccagcgtgaaggtgagctgcaaggtgagcggctacaccctgaccgagctgagcatccactgggtgagacaggcccccggcaagagactggagtggatgggcggcttcgaccccgaggacggcgagagaatctacgcccagaagttccagggcagagtgaccatgaccgaggacaccagcaccgacaccgcctacatggagctgaacagcctgagaagcgacgacaccgccgtgtactactgcgccaccggcggcctgtactgcagcagcatcagctgcatcatggacgtgtggggccagggcaccaccgtgaccgtgagcagcgccagcaccaagggc

SEQ ID NO: 34935 - RNA, 384 nt, synthetic construct
  misc_feature 1..384: note = derived and/or modified sequence opt4 from anti-HIV_Chain
  source 1..384: mol_type = other RNA
caggtgcagctggtgcagagcggcgccgaggtgaagatgcccggcgccagcgtgaaggtgagctgcaaggtgagcggctacagcctgaccgagctgagcatccactgggtgagacaggcccccggcaagagactggagtggatgggcggcttcgaccccgaggacgacgagagaatctacgcccagaagttccaggacagagtgaccatgaccgaggacaccagcaccgacaccgcctacatggacctgaacagcctgagaagcgaggacaccgccgtgtactactgcaccaccggcggcctgtactgcagcagcatcagctgcatcatggacgtgtggggccagggcaccaccgtgatcgtgagcagcgccagcaccaagggc

SEQ ID NO: 34936 - RNA, 387 nt, synthetic construct
  misc_feature 1..387: note = derived and/or modified sequence opt4 from anti-HIV_Chain
  source 1..387: mol_type = other RNA
gaggtgcagctgagcgagagcggcggcggcttcgtgaagcccggcggcagcctgagactgagctgcgaggccagcggcttcaccttcaacaactacgccatgagctgggtgagacaggcccccggcaagggcctggagtgggtgagcgtgaccagcgcccacggcggcagcgcctactacggcgagttcgtgaagggcagattcaccatgagcagagaccacttcatcgacaccgtgtacctggagatgaacggcctgaccgtggaggacaccgccgtgtactactgcgtgagagtgaccttctaccacgagggcagcggctactactacagagccggcaactacttcgacagctggggcaagggcaccagagtggtggtgagcgcc

SEQ ID NO: 34937 - RNA, 387 nt, synthetic construct
  misc_feature 1..387: note = derived and/or modified sequence opt4 from anti-HIV_Chain
  source 1..387: mol_type = other RNA
gaggtgcagctgagcgagagcggcggcggcttcgtgaagcccggcggcagcctgagactgagctgcgaggccagcggcttcaccttcaacaactacgccatgagctgggtgagacaggcccccggcaagggcctggagtgggtgagcgtgaccagcgcccacggcggcagcgcctactacggcgagttcgtgaagggcagattcaccatgagcagagaccacttcatcgacaccgtgtacctggagatgaacagactgaccgtggaggacaccgccgtgtactactgcgtgagagtgaccttctaccacgagggcagcggctactactacagagccggcaactacttcgacagctggggcaagggcaccagagtggtggtgagcgcc

SEQ ID NO: 34938 - RNA, 387 nt, synthetic construct
  misc_feature 1..387: note = derived and/or modified sequence opt4 from anti-HIV_Chain
  source 1..387: mol_type = other RNA
gaggtgcagctgagcgagagcggcggcggcgtggtgaagcccggcggcagcctgagactgagctgcgaggccagcggcttcaccttcagcaactacgccatgagctgggtgagacaggcccccggcaagggcctggagtgggtgagcgtgaccggcggccacggcacctacggctactacggcgagttcgtgaagggcagattcaccatcagcagagaccacagcatggacaccgtgtacctgcagatgaacagactgagagtggaggacaccgccgtgtactactgcgtgagaaccccctactaccacgagagcagcggctactactacagagccggcaactacttcgacttctggggcaagggcaccctggtgatcgtgagcgcc

SEQ ID NO: 34939 - RNA, 387 nt, synthetic construct
  misc_feature 1..387: note = derived and/or modified sequence opt4 from anti-HIV_Chain
  source 1..387: mol_type = other RNA
gaggtgcagctgagcgagagcggcggcggcttcgtgaagcccggcggcagcctgagactgagctgcgaggccagcggcttcaccttcaacaactacgccatgggctgggtgagacaggcccccggcaagggcctggagtgggtgagcgtgaccagcgcccacggcggcagcgcctacttcggcgagttcgtgaagggcagattcaccatgagcagagaccacttcatcgacaccgtgtacctggagatgaacagactgaccgtggaggacaccgccgtgtactactgcgtgagagtgaccttctaccacgagggcagcggctactactacagagccggcaactacttcgacagctggggccagggcaccctggtgatcgtgagcgcc

SEQ ID NO: 34940 - RNA, 387 nt, synthetic construct
  misc_feature 1..387: note = derived and/or modified sequence opt4 from anti-HIV_Chain
  source 1..387: mol_type = other RNA
caggtgcagctggtggagagcggcggcggcctggtgcagcccggcggcagcctgagactgagctgcgccgccagcggcttcaccttcagcacccactggatgcactgggtgagacaggcccccggcaagggcctggtgtgggtgagcagaatccacagcgacggcagaagcaccagctacgccgacagcgtgaagggcagattcaccatcagcagagacaacgccaagaacaccctgtacctgcagatgaacagcctgagagccgaggacaccgccgtgtactactgcgccagaggcgccgccgtgttcggcgtggtgatcatcggcggcatggacctgtggggccagggcaccaccgtgaccgtgagcagcgccagcaccaagggc

SEQ ID NO: 34941 - RNA, 387 nt, synthetic construct
  misc_feature 1..387: note = derived and/or modified sequence opt4 from anti-HIV_Chain
  source 1..387: mol_type = other RNA
caggtgcagctggtggagagcggcggcgccctggtgcagcccggcggcagcctgagactgagctgcgccgccagcggcttcagcttcagcagctacgccatgagctgggtgagacaggcccccggcaagggcctggagtgggtgagcgccatcagcagaagcggcggcagcacctactacgccgacagcgtgaagggcagattcaccatcagcatcgacaacagcaacaacaccctgtacctgcagatgaacagcctgagagtggaggacaccgccgtgtactactgcgccaagagagaggccttctactacggcgccggcggctacggcatggacgtgtggggccagggcaccaccgtgaccgtgagcagcgccagcaccaagggc

SEQ ID NO: 34942 - RNA, 387 nt, synthetic construct
  misc_feature 1..387: note = derived and/or modified sequence opt4 from anti-HIV_Chain
  source 1..387: mol_type = other RNA
ttccagggccacctggtgcagagcggcggcggcgtgaagaagcccggcaccagcgtgaccctgagctgcctggccagcgagtacaccttcaccgagttcaccatccactggatcagacaggcccccggccagggccccctgtggctgggcctgatcaagagaagcggcagactgatgaccagctacagattccaggacagactgagcctgagaagagacagaagcaccggcaccgtgttcatggagctgagaagcctgagaaccgacgacaccgccgtgtactactgcgccagagacggcctgggcgagctggcccccgcctaccactacggcatcgacgcctggggccagggcaccaccgtgatcgtgaccagcgccagcaccagc

SEQ ID NO: 34943 - RNA, 387 nt, synthetic construct
  misc_feature 1..387: note = derived and/or modified sequence opt4 from anti-HIV_Chain
  source 1..387: mol_type = other RNA
cagggcctgctggtgcagagcggcggcggcgtgaagaagctgggcaccagcgtgaccatcagctgcctggccagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcaccaagggc

SEQ ID NO: 34944 - RNA, 387 nt, synthetic construct
  misc_feature 1..387: note = derived and/or modified sequence opt4 from anti-HIV_Chain
  source 1..387: mol_type = other RNA
aacttcatgctgacccagcccgccagcgtgagcggcagccccggccagagcatcaccatcagctgcagcggcaccggcagcgacatcggcgtgtacaactacgtgagctggtaccagcagcaccccggcaaggcccccagactgatgatctacgacgtgaccaacagacccagcggcgtgagcaacagattcagcggcagcaagagcggcttcaccgccagcctgaccatcagcggcctgcagggcgacgacgaggccgactactactgcagcagctacagcagcaccaacacctacgtgttcggcaccggcacccacgtgaccgtgctgggccagcccaaggccaaccccaccgtgaccctgttcccccccagcagcgaggagctg

SEQ ID NO: 34945 - RNA, 387 nt, synthetic construct
  misc_feature 1..387: note = derived and/or modified sequence opt4 from anti-HIV_Chain
  source 1..387: mol_type = other RNA
cagagcgccctgacccagcccagaagcgtgagcggcagccccggccagagcgtgaccatcagctgcaccggcaccagcagcgacgtgggcgcctacaactacgtgagctggtacagacagcaccccggcaaggcccccaagctgatgatcaacgacgtgagcaagagacccagcggcgtgcccgacagattcagcggcagcaagagcggcaacaccgccagcctgaccatcagcggcctgcaggccgaggacgaggccgactactactgctgcagctacgccggcacctacagctacgtgttcggcaccggcaccaaggtgaccgtgctgggccagcccaaggccaaccccaccgtgaccctgttcccccccagcagcgaggagctg

SEQ ID NO: 34946 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcctgaagaagcccggcaccagcgtgaccatcagctgcctggccagcgagtacaccttcaacgagttcgtgatccactggatcagacaggcccccggccagggccccctgtggctgggcctgatcaagagaagcggcagactgatgaccgcctacaacttccaggacagactgagcctgagaagagacagaagcaccggcaccgtgttcatggagctgagaggcctgagacccgacgacaccgccgtgtactactgcgccagagacggcctgggcgaggtggcccccgactacagatacggcatcgacgtgtggggccagggcagcaccgtgatcgtgaccgccgccagcaccaagggc

SEQ ID NO: 34947 - RNA, 387 nt, synthetic construct
  misc_feature 1..387: note = derived and/or modified sequence opt4 from anti-HIV_Chain
  source 1..387: mol_type = other RNA
aacttcatgctgacccagccccccagcgccagcggcgcccccggccagagagtgaccatcagctgcagcggcggccccagcaacgtgggcggcaactacgtgtactggtacagacagttccccggcaccgcccccaacctgctgatcctgagagacgaccagagacccagcggcgtgcccgacagattcagcgccagcaagagcggcaacagcgccagcctggccatcagcggcctgagacccgacgacgaggccttctacttctgcgccacctacgacagcgacggcagcatcagactgttcggcggcggcaccaccctgaccgtgctgagccagcccaaggccgcccccagcgtgaccctgttcccccccagcagcgaggagctg

SEQ ID NO: 34948 - RNA, 387 nt, synthetic construct
  misc_feature 1..387: note = derived and/or modified sequence opt4 from anti-HIV_Chain
  source 1..387: mol_type = other RNA
cagctggtgctgacccagccccccagcgtgagcggcgcccccggccagagagtgaccatcagctgcagcggcggccccagcaacgtgggcggcaacctggtgtactggtacaagcagttccccggcaccgcccccaagctgctgatcagaagagacgaccagagacccagcggcgtgcccgacagattcagcggcagcaagagcggcaacagcgccagcctgaccatcagcggcctgagacccgacgacgaggccttctacttctgcgccacctacgacagccagggcagcaccagactgttcggcggcggcaccgtgctgaccgtgctgagccagcccaaggccgcccccagcgtgaccctgttcccccccagcagcgaggagctg

SEQ ID NO: 34949 - RNA, 387 nt, synthetic construct
  misc_feature 1..387: note = derived and/or modified sequence opt4 from anti-HIV_Chain
  source 1..387: mol_type = other RNA
aacttcatgctgacccagccccccagcgtgagcggcgcccccggccagagagtgaccatcagctgcagcggcggccccagcaacgtgggcggcaacctggtgtactggtacaagcagttccccggcaccgcccccaagctgctgatcagaagagacgaccagagacccagcggcgtgcccgacagattcagcggcagcaagagcggcaacagcgccagcctggccatcagcggcctgagacccgacgacgaggccttctacttctgcgccacctacgacagccacggcagcatcagactgttcggcggcggcaccctgctgaccgtgctgagccagcccaaggccgcccccagcgtgaccctgttcccccccagcagcgaggagctg

SEQ ID NO: 34950 - RNA, 387 nt, synthetic construct
  misc_feature 1..387: note = derived and/or modified sequence opt4 from anti-HIV_Chain
  source 1..387: mol_type = other RNA
cagagcgccctgaccagaacccccagcgtgagcggcgcccccggccagagagtgaccatcagctgcagcggcggccccagcaacgtgggcggcaactacgtgtactggtaccagcagttccccggcgccgcccccaagctgctgatcagaagagacgaccagagacccagcggcgtgcccgacagattcagcggcagcaagagcggcaacagcgccagcctggccatcagcggcctgagactggacgacgaggcctactacttctgcgccacctacgacagcggctggagcatcagactgttcggcggcggcaccagactgaccgtgctgagccagcccaaggccgcccccagcgtgaccctgttcccccccagcagcgaggagctg

SEQ ID NO: 34951 - RNA, 387 nt, synthetic construct
  misc_feature 1..387: note = derived and/or modified sequence opt4 from anti-HIV_Chain
  source 1..387: mol_type = other RNA
cagagcgccctgacccagccccccagcgtgagcgccacccccggccagaccgtgaccatcagctgcagcggcagcggcagcaacgtgggcggcaaccacgtgtactggtacagacagctgcccggcgccgcccccaccctgctgatcagcaagaccgaccacagacccagcagagtgcccgacagattcagcgccagcaagagcggcaacagcgccagcctggccatcagcggcctgagacccgacgacgaggccatctacttctgcgccacctacgacaccggcctgagcctgagactgttcggcggcggcaccagactgaccgtgctgagccagcccaaggccgcccccagcgtgaccctgttcccccccagcagcgaggagctg

SEQ ID NO: 34952 - RNA, 387 nt, synthetic construct
  misc_feature 1..387: note = derived and/or modified sequence opt4 from anti-HIV_Chain
  source 1..387: mol_type = other RNA
caggtgcagctgctggagagcggccccggcctggtgacccccagcggcaccctgagcctggcctgcgccgtgagcggcgccagcatcagcagcagccactggtggacctgggtgagacagagccccggcaagggcctggagtggatcggcgagatcgacagaagaggcaccaccaactacaaccccagcctgagaagcagagtgaccatcctgctggacaacagcaagaaccagttcagcctgagcctgagaagcgtgaccgccgccgacaccgccgtgtactactgcaccaaggtgtacgccggcctgttcaacgagagaacctacggcatggacgtgtggggccacggcaccaccgtgctggtgagcagcgccagcaccaagggc

SEQ ID NO: 34953 - RNA, 387 nt, synthetic construct
  misc_feature 1..387: note = derived and/or modified sequence opt4 from anti-HIV_Chain
  source 1..387: mol_type = other RNA
caggccgtggtgacccagccccccagcgtgagcgccacccccggccagaccgtgaccatcagctgcagcggcagcggcagcaacgtgggcggcaaccacgtgtactggtacagacagctgcccggcgccgcccccaccctgctgatcagcaagaccaacagaagacccagccaggtgcccgacagattcagcggcagcaagagcggcaacagcgccagcctggccatcagcggcctgagacccgacgacgaggccgactacttctgcgccacctacgacaccgacctgagcctgagactgttcggcggcggcaccagactgaccgtgctgagccagcccaaggccgcccccagcgtgaccctgttcccccccagcagcgaggagctg

SEQ ID NO: 34954 - RNA, 387 nt, synthetic construct
  misc_feature 1..387: note = derived and/or modified sequence opt4 from anti-HIV_Chain
  source 1..387: mol_type = other RNA
cagagcgccctgacccagccccccagcgtgagcggcacccccggccagaacgtgaccatcagctgcagcggcggcggcagcgacgtgggcggcaacctggtgagctggtaccagcacttccccggcgccgcccccaagctgctgatccacagagacaaccagagacccagcggcgtgcccgacagattcagcgccctgaagagcggcaacagcgccagcctggccatcagcggcctgagaagcgacgacgaggccttctacttctgcgccgtgtacgacagcagcctgagcctgggcctgttcggcggcggcaccaagctgaccgtgctgagccagcccaaggccgcccccagcgtgaccctgttcccccccagcagcgaggagctg

SEQ ID NO: 34955 - RNA, 387 nt, synthetic construct
  misc_feature 1..387: note = derived and/or modified sequence opt4 from anti-HIV_Chain
  source 1..387: mol_type = other RNA
cagagcgccctgacccagccccccagcgccagcggcacccccggccagagagtgaccatcagctgcagcggcggcggcagcaacatcggcggcaacctggtgagctggtaccagcacttccccggcaccgcccccaagctgctgatctacagaaacgaccagagacccagcggcgtgcccgacagattcagcggcagcaagagcggcaccagcgccagcctgaccatcagcggcctgagaagcgacgacgaggccacctacttctgcgccgcctacgacagcagcctgagcctgagactgttcggcggcggcaccaccctgaacgtgctgagccagcccaaggccgcccccagcgtgaccctgttcccccccagcagcgaggagctg

SEQ ID NO: 34956 - RNA, 387 nt, synthetic construct
  misc_feature 1..387: note = derived and/or modified sequence opt4 from anti-HIV_Chain
  source 1..387: mol_type = other RNA
cagagcgccctgacccagccccccagcgtgagcgccacccccggccagaccgtgaccatcagctgcagcggcagcggcagcaacgtgggcggcaaccacgtgtactggtacagacagctgcccggcgccgcccccaccctgctgatcagcaagaccaaccacagacccagccaggtgcccgacagattcagcgccagcaagagcggcaacagcgccagcctggccatcagcggcctgagacccgacgacgaggccgactacttctgcggcacctacgacaccagcctgagcctgagactgttcggcggcggcaccagactgaccgtgctgagccagcccaaggccgcccccagcgtgaccctgttcccccccagcagcgaggagctg

SEQ ID NO: 34957 - RNA, 387 nt, synthetic construct
  misc_feature 1..387: note = derived and/or modified sequence opt4 from anti-HIV_Chain
  source 1..387: mol_type = other RNA
cagagcgtgctgacccaggtgctgagcgtgagcggcacccccggccagagagtgatcatcagctgcagcggcaccagcagcaacgtgggcggcaacctggtgagctggtaccagcacctgcccggcgccgcccccagactgctgatccacagagacgaccagagacccagcggcgtgcccgacagattcagcggcagcaagagcggcaacagcgccagcctggtgatcagcggcctgagaagcgacgacgaggccgactacttctgcggcgcctacgacagcaccttcagcctgcccgtgttcggcggcggcaccagactgaccgtgctgagccagcccaaggccgcccccagcgtgaccctgttcccccccagcagcgaggagctg

SEQ ID NO: 34958 - RNA, 387 nt, synthetic construct
  misc_feature 1..387: note = derived and/or modified sequence opt4 from anti-HIV_Chain
  source 1..387: mol_type = other RNA
cagagcgccctgacccagccccccgccaccagcggcacccccggccagagagtgaccatcagctgcagcggcggcggcagcaacgtgggcggcaacctggtgagctggtaccagcagttccccggcgccgcccccaagctgatcctgcacagagacggccagagacccagcggcgtgcccgacagattcagcgccagcaagagcggcaccagcgccagcctgaccatcagcggcctgagaagcgacgacgaggccacctacttctgcgccgccttcgacagcgccctgagcctgcccctgttcggcggcggcaccaagctgaccgtgctgagccagcccaaggccgcccccagcgtgaccctgttcccccccagcagcgaggagctg

SEQ ID NO: 34959 - RNA, 387 nt, synthetic construct
  misc_feature 1..387: note = derived and/or modified sequence opt4 from anti-HIV_Chain
  source 1..387: mol_type = other RNA
cagctggtgctgacccagccccccagcgtgagcgccacccccggccagaccgtgaccatcagctgcagcggcagcggcagcaacgtgggcggcaaccacgtgtactggtacagacagctgcccggcgccgcccccaccctggtgatcagcaagaccgaccacagacccagcagagtgcccgacagattcagcggcagcaagagcggcaacagcgccagcctggccatcagcggcctgagacccgacgacgaggccgcctacttctgcgccacctacgacaccggcctgagcctgagactgttcggcggcggcaccagactggccgtgctgagccagcccaaggccgcccccagcgtgaccctgttcccccccagcagcgaggagctg

SEQ ID NO: 34960 - RNA, 387 nt, synthetic construct
  misc_feature 1..387: note = derived and/or modified sequence opt4 from anti-HIV_Chain
  source 1..387: mol_type = other RNA
cagagcgccctgacccagccccccagcgtgagcggcacccccggccagaacgtgaccatcagctgcagcggcggcggcagcaacgtgggcggcaacctggtgagctggtaccagcacttccccggcgccgcccccaagctgctgatccacagagacaaccagagacccagcggcgtgcccgacagattcagcgtgctgaagagcggcaacagcgccagcctggccatcagcggccccagaagcgacgacgaggccttctacttctgcgccgtgtacgacagcagcctgagcctgggcctgttcggcggcggcaccaagctgaccgtgctgagccagcccaaggccgcccccagcgtgaccctgttcccccccagcagcgaggagctg

SEQ ID NO: 34961 - RNA, 387 nt, synthetic construct
  misc_feature 1..387: note = derived and/or modified sequence opt4 from anti-HIV_Chain
  source 1..387: mol_type = other RNA
cagaccgtggtgacccagccccccagcgccagcggcacccccggccagagagtgaccatcagctgcagcggcggcggcagcaacatcggcggcaacctggtgagctggtaccagcacttccccggcgccgcccccaagctgctgatctacagaaacgaccagagacccagcggcgtgcccgacagattcagcggcagcaagagcggcaccagcgccagcctgaccatcagcggcctgagaagcgacgacgaggccacctacttctgcgccgcctacgactgcaccctgagcctgagactgttcggcggcggcaccaccctgaacgtgctgagccagcccaaggccgcccccagcgtgaccctgttcccccccagcagcgaggagctg

SEQ ID NO: 34962 - RNA, 387 nt, synthetic construct
  misc_feature 1..387: note = derived and/or modified sequence opt4 from anti-HIV_Chain
  source 1..387: mol_type = other RNA
cagagcgccctgacccagacccccagcgtgagcggcgcccccggccagagagtgaccatcagctgcagcggcggccccagcaacgtgggcggcaactacgtgtactggtaccagcagttccccggcgccgcccccaagctgctgatcagaagagacgaccagagacccagcggcgtgcccgacagattcagcggcagcaagagcggcaacagcgccagcctggccatcagcggcctgagactggacgacgaggcctactacttctgcgccacctacgacagcggctggagcatcagactgttcggcggcggcaccagactgaccgtgctgagccagcccaaggccgcccccagcgtgaccctgttcccccccagcagcgaggagctg

SEQ ID NO: 34963 - RNA, 387 nt, synthetic construct
  misc_feature 1..387: note = derived and/or modified sequence opt4 from anti-HIV_Chain
  source 1..387: mol_type = other RNA
cagagcgtgctgacccagccccccagcgccagcggcgcccccggccagagagtgaccatcagctgcagcggcggccccagcaacgtgggcggcaactacgtgtactggtacagacagttccccggcaccgcccccaacctgctgatcctgagagacgaccagagacccagcggcgtgcccgacagattcagcgccagcaagagcggcaacagcgccagcctggccatcagcggcctgagacccgacgacgaggccttctacttctgcgccacctacgacagcgacggcagcgtgagactgttcggcggcggcaccaccctgaccgtgctgagccagcccaaggccgcccccagcgtgaccctgttcccccccagcaacggcggcaga

SEQ ID NO: 34964 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagcccggcaccagcgtgaccatcagctgcctggccagcgagtacaccttcaacgagttcgtgatccactggatcagacaggcccccggccagggccccctgtggctgggcctgatcaagagaagcggcagactgatgaccagctacaagttccaggacagactgaacctgagaagagacagaagcaccggcaccgtgttcatggagctgagaggcctgagacccgacgacaccgccgtgtactactgcgccagagacggcctgggcgaggtggcccccgactacagatacggcatcgacgtgtggggccagggcagcaccgtgatcgtgaccgccgccagcaccaagggc

SEQ ID NO: 34965 - RNA, 387 nt, synthetic construct
  misc_feature 1..387: note = derived and/or modified sequence opt4 from anti-HIV_Chain
  source 1..387: mol_type = other RNA
gaggtgcagctggtggagagcggcgccgaggtgaagaagcccggcgccagcgtgaaggtggcctgcaaggtgagcggcaagaagctgagcgacctgagcatccactgggtgagacaggcccccggcaagggcctggagtggatgggcggcttcgacgaggaggacggcaagatcagctacgagagaaagttccagggcagagtgaccatgaccgaggacaccgccagagacaccgccttcatggagatgagcagcctgagaagcgacgacaccgccgtgtacttctgcgccgccgcccccagactggacctgggcgagctgagcagcggcttccacttctggggcctgggcaccctggtgagcgtgagcagcgccagcaccaagggc

SEQ ID NO: 34966 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcggcaagaagctgggcaccagcgtgaccatcagctgcctggccagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgagcagcgccagcaccaagggc

SEQ ID NO: 34967 - RNA, 387 nt, synthetic construct
  misc_feature 1..387: note = derived and/or modified sequence opt4 from anti-HIV_Chain
  source 1..387: mol_type = other RNA
gaggtgcagctggtggagagcggcgccgaggtgaagaagcccggcgccagcgtgaaggtgagctgcaaggtgagcggctacaccctgagcgacctgagcatgcactgggtgagacaggcccccggcaagggcctggagtggatgggcggcttcgacgaggaggacggcgagatcacctacgcccagaagttccagggcagagtgagcatgaccgaggacaccagcagagacaccgcctacatggagctgagcagcctgagaagcgaggacaccgccgtgtactactgcgccaccgcccccagactggagctgggcgagctgagcagcggcttccactactggggcctgggcaccctggtgaccgtgagcagcgccagcaccaagggc

SEQ ID NO: 34968 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagaccggcaccagcgtgaccatcagctgcctggccagcgagtacaccttcaccgagttcaccatccactggatcagacaggcccccggccagggccccctgtggctgggcctgatcaagagaagcggcagactgatgaccgccaacagattccaggacagactgagcctgagaagagacagaagcaccggcaccgtgttcatggagctgagaagcctgagaatcgacgacaccgccgtgtactactgcgccagagacggcctgggcgagctggcccccgcctaccactacggcatcgacgtgtggggccagggcaccaccatcatcgtgaccagcgccagcaccaagggc

SEQ ID NO: 34969 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagctgggcaccagcgtgaccatcagctgcctggccagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcaccaagggc

SEQ ID NO: 34970 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagctgggcaccagcgtgaccatcccctgcctggccagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcaccaagggc

SEQ ID NO: 34971 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagcccggcaccagcgtgaccatcagctgcctggccagcgagtacaccttcaacgagttcgtgatccactggatcagacaggcccccggccagggccccgtgtggctgggcctgatcaagagaagcggcagactgatgaccagctacaagttccaggacagactgagcctgagaagagacagaagcaccggcaccgtgttcatggagctgagaggcctgagactggacgacaccgccgtgtactactgcgccagagacggcctgggcgaggtggcccccgcctacctgtacggcatcgacgcctggggccagggcagcaaggtgatcgtgacccccgccagcaccaagggc

SEQ ID NO: 34972 - RNA, 387 nt, synthetic construct
  misc_feature 1..387: note = derived and/or modified sequence opt4 from anti-HIV_Chain
  source 1..387: mol_type = other RNA
caggccagactggaccagtggggcaccggcctgctgaagcccagcgagaccctgagcctgaagtgcgccgtgttcggcgtgctgttcaccgactacaactggacctgggtgagacagagccccggcaaggagctggagtggatcggccacctggaccacagaggcggcggcaactacaaccccagcctggagagcagagtgaccatcagcctggactacagcaaggcccagttcagcctgcacctgaagagcgtgaccgtggccgacaccgccagatactactgcgccggcgccgtgaagggcttctggttcgacgacccctacacctggttcggcccctggagccagggcaccctggtgaccgtggccagcgccagcaccaagggc

SEQ ID NO: 34973 - RNA, 387 nt, synthetic construct
  misc_feature 1..387: note = derived and/or modified sequence opt4 from anti-HIV_Chain
  source 1..387: mol_type = other RNA
caggccagactggaccagtggggcaccggcctgctgaagcccagcgagaccctgagcctgaagtgcgccgtgttcggcgtgctgttcaccgactacaactggacctgggtgagacagagccccggcaagggcctggagtggatcggccacctggaccacagaggcggcggcagctacaaccccagcctggagagcagagtgagcatcagcctggactacagcaaggcccagttcagcctgcacctgaagagcgtgaccgtggccgacaccgccctgtactactgcgccggcgccgtgaagggcttctggttcgacgagcccagcacctggttcggcccctggagccagggcaccatggtgaccgtggccagcgccagcaccaagggc

SEQ ID NO: 34974 - RNA, 387 nt, synthetic construct
  misc_feature 1..387: note = derived and/or modified sequence opt4 from anti-HIV_Chain
  source 1..387: mol_type = other RNA
cagggccacctggtgcagagcggcggcggcgtgaagaagctgggcaccagcgtgaccatcagctgcctggccagcgaggacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcaccaagggc

SEQ ID NO: 34975 - RNA, 387 nt, synthetic construct
  misc_feature 1..387: note = derived and/or modified sequence opt4 from anti-HIV_Chain
  source 1..387: mol_type = other RNA
caggtgcagctggtgcagagcgaggccgaggtgaagaagcccggcagcagcgtgaaggtgagctgcaaggccagcggcggcaccttcagaggctacaccatcagctgggtgagacaggcccccggccagggcctggagtggatgggcagaatcatccccatcctgggcaaggccatctacgcccccagcttccagggcagagtgaccctgaccgccgacaagagcaccggcaccgcctacatggagctgagcagactgagaagcgacgacaccgccgtgtactactgcgccaaggtgaagatgagaggcagcagcggctactactacctgttcgacgactggggccagggcaccctggtgaccgtgagcagcgccagcaccaagggc

SEQ ID NO: 34976 - RNA, 387 nt, synthetic construct
  misc_feature 1..387: note = derived and/or modified sequence opt4 from anti-HIV_Chain
  source 1..387: mol_type = other RNA
caggccagactggaccagtggggcaccggcctgctgaagcccagcgagaccctgagcctgaagtgcgccgtgttcggcgtgctgttcaccgactacaactggacctgggtgagacagagccccggcaagggcctggagtggatcggccacctggaccacagaggcggcggcaactacaaccccagcctggagagcagagtgaccatcagcctggactacagcaaggcccagttcagcctgcacctgaagagcgtgaccgtggccgacaccgccctgtactactgcgccggcgccgtgaagggcttctggttcgacgaggtgtacaactggttcggcccctggagccagggcaccctggtgaccgtggccagcgccagcaccaagggc

SEQ ID NO: 34977 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagcccggcaccagcgtgaccatcagctgcctggccagcgagtacaccttcaccgagttcaccatccactggatcagacaggcccccggccagggccccctgtggctgggcctgatcaagagaagcggcagactgatgaccgcctacagattccaggacagactgagcctgagaagagacagaagcaccggcaccgtgttcatggagctgagaaacctgagaatggacgacaccgccgtgtactactgcgccagagacggcctgggcgagctggcccccgcctaccagtacggcatcgacgtgtggggccagggcaccaccgtgatcgtgagcagcgccagcaccaagggc

SEQ ID NO: 34978 - RNA, 387 nt, synthetic construct
  misc_feature 1..387: note = derived and/or modified sequence opt4 from anti-HIV_Chain
  source 1..387: mol_type = other RNA
caggtgagactggtgcagagcggcccccaggtgaagagacccggcgccagcatcagactgagctgcgagagcagcggctacagattccaggactacatcgtggcctggatcagacagaccagaggccagggcttcgagttcgtgggcatggtgaaccccagaggcggcagaccctggcccagcagcagattcagagacagagtgaccctgaccagagacatcgagagcgagaccttctacctgggcctgaacgacctgaccagcgacgacaccgccacctacttctgcgccagactggaggccgacggcagcgactacagccccaagatgttcgacttctggggccagggcaccaagatcgtggtgagccccgccagcaccaagggc

SEQ ID NO: 34979 - RNA, 387 nt, synthetic construct
  misc_feature 1..387: note = derived and/or modified sequence opt4 from anti-HIV_Chain
  source 1..387: mol_type = other RNA
caggtgagactggtgcagagcggcccccaggtgaagacccccggcgccagcatgagagtgagctgcgaggccagcggctacagattcctggactacatcatcgtgtggatcagacagacccacggccagcacttcgagtacgtgggcatgatcaaccccagaggcggcaccccctggcccagcagcaagttcagagacagactgagcctgaccagagacatccacaccgacaccttctacctgggcctgaacaacctgggcagcgacgacaccgccatctacttctgcgccagactggaggccgacggcgacgactacagccccaagatgttcgaccactggggccagggcaccagaatcatcgtgagcgccgccagcaccaagggc

SEQ ID NO: 34980 - RNA, 387 nt, synthetic construct
  misc_feature 1..387: note = derived and/or modified sequence opt4 from anti-HIV_Chain
  source 1..387: mol_type = other RNA
caggtgagactggtgcagagcggcccccaggtgaagacccccggcgccagcatcagactgagctgcgaggccagcggctacagattcctggactacttcatcgtgtgggtgagacagacccccggccagggcttcgagtacgtgggcatgatcaaccccagaggcggcagaccctggagcagctggaagttcagagacagactgagcctgaccagagagatcgacaccgacaccttctacctgggcctgagcaacctgagaagcgacgacaccgccatctacttctgcgccagactggaggccgacggcgacgactacagccccaagatggtggactactggggccagggcaccaagatcatcgtgagcgccgccagcaccaagggc

SEQ ID NO: 34981 - RNA, 387 nt, synthetic construct
  misc_feature 1..387: note = derived and/or modified sequence opt4 from anti-HIV_Chain
  source 1..387: mol_type = other RNA
caggtgagactggtgcagagcggcccccaggtgaagagacccggcgccagcatcagactgagctgcgagaccagcggctacagattccaggactacatcgtggcctggatcagacagaccagaggccagagattcgagttcgtgggcatggtgaaccccagaggcggcagaccctggcccagcagcaagttcagagacagagtgaccctgaccagagacatcgagagcgagaccttccacctgggcctgaacgacctgaccagcgacgacaccgccacctacttctgcgccagactggaggccgacggcgccgactacagccccaagatgttcgacttctggggccagggcaccaagatcgtggtgagccccgccagcaccaagggc

SEQ ID NO: 34982 - RNA, 387 nt, synthetic construct
  misc_feature 1..387: note = derived and/or modified sequence opt4 from anti-HIV_Chain
  source 1..387: mol_type = other RNA
caggtgagactggtgcagagcggcccccaggtgaagacccccggcgccagcatgagaatcagctgcgaggccagcggctacagattccaggactacatcatcgtgtggatcagacagacccacggccagggcttcgagtacgtgggcatgatcaaccccagaggcggcaccccctggagcagcagcaagttcagagacagactgagcctgaccagagacatctacaccgacaccttctacctgggcctgaacaacctgggcagcgacgacaccgccatctacttctgcgccagactggaggccgacggcggcgactacagccccaagatgttcgactactggggccagggcaccagaatcatcgtgagcgccgccagcaccaagggc

SEQ ID NO: 34983 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagcccggcgccagcgtgaccatcagctgcctggccagcgagtacaccttcaacgagttcgtgatccactggatcagacaggcccccggccagggccccctgtggctgggcctgatcaagagaagcggcagactgatgaccgcctacaagttccaggacagactgagcctgagaagagacagaagcaccggcaccgtgttcatggagctgagaggcctgagacccgaggacaccgccgtgtactactgcgccagagacggcctgggcgaggtggcccccgactacagatacggcatcgacgtgtggggccagggcagcaccgtgatcgtgagcgccgccagcaccaagggc

SEQ ID NO: 34984 - RNA, 387 nt, synthetic construct
  misc_feature 1..387: note = derived and/or modified sequence opt4 from anti-HIV_Chain
  source 1..387: mol_type = other RNA
caggtgagactggtgcagagcggcccccagatgaagacccccggcgccagcctgagactgagctgcgaggtgagcggctacagattcctggactacttcatcgtgtgggtgagacagaccggcggccagggcttcgagtacgtgggcatgatcaaccccagaggcggcagaccctggagcagctggaagttcagagacagactgagcctgaccagagacatcgagaccgacaccttctacctgggcctgaacaacctgagaagcgacgacaccgccatctacttctgcgccagactggaggccgacggcgacaactacagccccaagatggtggactactggggccagggcaccaagatcatcgtgagccccgccagcaccaagggc

SEQ ID NO: 34985 - RNA, 387 nt, synthetic construct
  misc_feature 1..387: note = derived and/or modified sequence opt4 from anti-HIV_Chain
  source 1..387: mol_type = other RNA
caggtgagcctggtgcagagcggcccccaggtgaagacccccggcgccagcatgagagtgagctgcgagaccagcggctacagattcctggactacatcatcgtgtggatcagacagacccacggccagcacttcgagtacgtgggcatgatcaaccccagaggcggcaccccctggcccagcagcaagttcagagacagactgaccatgaccagagacatccacaccgacaccttctacctgggcctgaacaacctgagaagcgacgacaccgccatctacttctgcgccagactggaggccgacggcgacgactacagccccaagatgttcgactactggggccagggcaccagaatcatcgtgagcgccgccagcaccaagggc

SEQ ID NO: 34986 - RNA, 387 nt, synthetic construct
  misc_feature 1..387: note = derived and/or modified sequence opt4 from anti-HIV_Chain
  source 1..387: mol_type = other RNA
caggtgagactggtgcagagcggcccccaggtgaagaccgccggcgccagcatgagagtgagctgcgaggccagcggctacagattcctggactacatcatcgtgtggatcagacagacccacggccagcacttcgagtacgtgggcatgatcaaccccagaggcggcaccccctggcccagcagcaagttcagagacagactgaccctgaccagagacatctacaccgacaccttctacctgggcctgaacaacctgggcagcggcgacaccgccatctacttctgcgccagactggaggccgacggcgacgactacagccccaagatgttcgactactggggccagggcaccagaatcatcgtgagcgccgccagcaccaagggc

SEQ ID NO: 34987 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagcccggcaccagcgtgaccatcagctgcctggccagcgagtacaccttcaacgagttcgtgatccactggatcagacaggcccccggccagggccccgtgtggctgggcctgatcaagagaagcggcagactgatgaccagctacaagttccaggacagactgagcctgagaagagacagaagcaccggcaccgtgttcatggagctgagaggcctgagactggacgacaccgccgtgtactactgcgccagagacggcctgggcgaggtggcccccgcctacctgtacggcatcgacgcctggggccagggcagcaccgtgatcgtgaccagcgccagcaccaagggc

SEQ ID NO: 34988 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcctgaagaagcccggcaccagcgtgaccatcagctgcctggccagcgagtacaccttcaacgagttcgtgatccactggatcagacaggcccccggccagggccccctgtggctgggcctgatcaagagaagcggcagactgatgaccgcctacaacttccaggacagactgagactgagaagagacagaagcaccggcaccgtgttcatggagctgagaggcctgagacccgacgacaccgccgtgtactactgcgccagagacggcctgggcgaggtggcccccgactacagatacggcatcgacgtgtggggccagggcagcaccgtgatcgtgaccgccgccagcaccaagggc

SEQ ID NO: 34989 - RNA, 387 nt, synthetic construct
  misc_feature 1..387: note = derived and/or modified sequence opt4 from anti-HIV_Chain
  source 1..387: mol_type = other RNA
cagggccacctggtgcagagcggcggcggcgtgaagaagctgggcaccagcgtgaccatcagctgcctggtgagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcaccaagggc

SEQ ID NO: 34990 - RNA, 387 nt, synthetic construct
  misc_feature 1..387: note = derived and/or modified sequence opt4 from anti-HIV_Chain
  source 1..387: mol_type = other RNA
cagggccagctggtgcagagcggcggcggcgtgaagaagctgggcaccagcgtgaccatcagctgcctggccagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgagcagcgccagcaccaagggc

SEQ ID NO: 34991 - RNA, 387 nt, synthetic construct
  misc_feature 1..387: note = derived and/or modified sequence opt4 from anti-HIV_Chain
  source 1..387: mol_type = other RNA
cagggccacctggtgcagagcggcggcggcgtgaagaagctgggcaccagcgtgaccatcagctgcctggccagcgagtacaccttcaacgagttcgtgatccactggatcagacaggcccccggccagggccccctgtggctgggcctgatcaagagaagcggcagactgatgaccagctaccagttccaggacagactgagcctgagaagagacagaagcaccggcaccgtgttcatggagctgagaggcctgagagtggacgacaccgccgtgtactactgcgccagagacggcctgggcgaggtggcccccgcctacctgtacggcatcgacgcctggggccagggcaccaccgtgatcgtgaccagcgccagcaccaagggc

SEQ ID NO: 34992 - RNA, 387 nt, synthetic construct
  misc_feature 1..387: note = derived and/or modified sequence opt4 from anti-HIV_Chain
  source 1..387: mol_type = other RNA
caggtgcagctggtgcagagcggcagcgagctgaagaagcccggcgccagcgtgaaggtgagctgcaaggccagcggctacaccttcaccagctacgccatcaactgggtgagacaggcccccggccagggcctggagtggatgggctggatcaacaccaacaccggcaaccccacctacgcccagggcttcaccggcagattcgtgttcagcctggagaccagcgtgagcaccgcctacctgcagatcaacagcctgaaggccgaggacaccgccgtgtactactgcgccagagacctgctggagagcagaacctactacaacgacatcagagactgctggggccagggcaccctggtgaccgtgagcagcgccagcaccaagggc

SEQ ID NO: 34993 - RNA, 387 nt, synthetic construct
  misc_feature 1..387: note = derived and/or modified sequence opt4 from anti-HIV_Chain
  source 1..387: mol_type = other RNA
caggtgcagctggtgcagagcggcgccgaggtgaagaagcccggcgccagcgtgaaggtgagctgcaaggccagcggctacaccttcaccgactactacatccactgggtgagacaggcccccggccagggcctggagtggatgggctggatcaaccccagcaccggcggcaccaacttcgtgcagaagttcctgggcagagtgaccatgaccagcgacaccagcatcaacaccgcctacatggagctgagaagactgaagaacgacgacgccgccatctactactgcgccacctacagcaccagacagttcttccactactactacgtgaccgacgtgtggggccagggcaccaccgtgaccgtgagcagcgccagcaccaagggc

SEQ ID NO: 34994 - RNA, 387 nt, synthetic construct
  misc_feature 1..387: note = derived and/or modified sequence opt4 from anti-HIV_Chain
  source 1..387: mol_type = other RNA
ttccagggccagctggtgcagagcggcggcggcgtgaagaagcccggcagcagcgtgaccatcagctgcctggccagcgagtacaccttcaccgagttcaccatccactggatcagacaggcccccggccagggccccctgtggctgggcctgatcaagagaagcggcagactgatgaccagctacggcttccaggacagactgagcgtgagaagagacagaagcaccggcaccgtgttcatggagctgagaagcctgagaaccgacgacaccgccgtgtactactgcgccagagacggcctgggcgagctggcccccgcctaccactacggcatcgacgtgtggggccagggcaccaccgtgatcgtgaccagcgccagcaccagc

SEQ ID NO: 34995 - RNA, 387 nt, synthetic construct
  misc_feature 1..387: note = derived and/or modified sequence opt4 from anti-HIV_Chain
  source 1..387: mol_type = other RNA
caggtgcagctggtggagagcggcggcggcgtggtgcagcccggcagaagcctgagactgagctgcgccgccagcggcttcaccttcagcagctacgccatgcactgggtgagacaggcccccggcaagggcctggagtgggtggccgtgatcagctacgacggcagcaacaagtactacgccgacagcgtgaagggcagattcaccatcagcagagacgacagcaagagcaccgtgtacctgcagatcaacagcctgagagccgccgacaccgccgtgtacttctgcgccagagagggcggcctgagattcctggagtggctgttctggggccagggcaccctggtgaccgtgagcagcggcgagagcagcgccagcaccaagggc

SEQ ID NO: 34996 - RNA, 390 nt, synthetic construct
  misc_feature 1..390: note = derived and/or modified sequence opt4 from anti-HIV_Chain
  source 1..390: mol_type = other RNA
caggtgcagctggtgcagagcggcgccgtggtgaagagccccggcagcagcgccaagctgagctgcagactgctgggcgacgagttcggcacctacttcatcagctggatcagacaggcccccggcagaggcctggagtgggtgggcggcatcgtgccccacagccagctgcagagcagcgcccagaagttccacggcagattcttcatcaccggcggcgtgaccccccccatcatcttcctgcagctgaccaacgtgaccttcgaggacaccggcacctacttctgcgccagagagagaggcagacacagagaccccaagaccggcaagagcctgagaggcagatacttcgacttctggggcagaggcaccggcgtgaccgtgagcccc

SEQ ID NO: 34997 - RNA, 390 nt, synthetic construct
  misc_feature 1..390: note = derived and/or modified sequence opt4 from anti-HIV_Chain
  source 1..390: mol_type = other RNA
cagatcgagctgagacagagcggcgccgccatgaagagccccggcagcagcgtgaagctgagctgcaccgtgctgggcgagaacttcggcacctacttcatcagctggatcagacaggcccccggccagggcctggagtgggtgggcggcatcgtgccccacagccagctgcagagcagcgcccagaagttccacggcagaatcaagatcagcggcggcggcaccccccccgtggtgagcctggagctgaccaacgtgaccttcgacgacaccggcacctacttctgcgccagagagagaggcagacacgtggagcccaagaccggcgacagactggccggcagatacttcgacatctggggcagaggcaccggcctgagagtgagcccc

SEQ ID NO: 34998 - RNA, 390 nt, synthetic construct
  misc_feature 1..390: note = derived and/or modified sequence opt4 from anti-HIV_Chain
  source 1..390: mol_type = other RNA
gaggtgcagctggtggagagcggcggcggcctggtgaagcccggcggcagcctgagactgagctgcgaggccagcggcttcaccttcaccaacgcctggatgaactgggtgagacaggcccccggcaagggcctggagtgggtgggcagaatcaagagccagacccacggcggcaccaccagatacgccgcccccgtgaagggcagattcaccatcagcagagacgacagcaagcacaccctgtacctgcagatggacagactgaccaccgaggacaccgccgtgtactactgcaccggcaccatcaccggcagcaccttctactactacggcatggacgtgtggggccagggcaccaccgtgaccgtgagccccgccagcaccaagggc

SEQ ID NO: 34999 - RNA, 390 nt, synthetic construct
  misc_feature 1..390: note = derived and/or modified sequence opt4 from anti-HIV_Chain
  source 1..390: mol_type = other RNA
gtggtgcagctggtgcagagcggccccggcctggtgaagcccagccagaccctgagcctgacctgcaccgtgagcggcggcagcatcagcagcggcgacttctactggagctggatcagacagccccccggcaagggcctggagtggatcggctacatctactacagcggcagcacctactacaaccccagcctgaagagcagactgaccatcagcgtggacaccagcaagaaccagttcagcctgagactgagcagcgtgaccgccgccgacaccgccgtgtactactgcgccagagacctgaacagcagaatcgtgggcgccctggacgccttcgacatctggggccagggcaccatggtgaccgtgagcagcgccagcaccaagggc

SEQ ID NO: 35000 - RNA, 390 nt, synthetic construct
  misc_feature 1..390: note = derived and/or modified sequence opt4 from anti-HIV_Chain
  source 1..390: mol_type = other RNA
gaggtgcagctggtgcagagcggcggcggcctggtgcagcccggcagaagcctgagactgagctgcgccgccagcggcttcaccttcgacgactacgccatgcactgggtgagacaggcccccggcaagggcctggagtgggtgagcggcatcagctggaacagcggcaccatcggctacgccgacagcgtgagaggcagattcaccatcagcagagacgacgccaagagcagcctgtacctgcagatgaacagcctgagaaccgaggacaccgccctgtactactgcgccaaggacggctgggtgggcagcggcagcagcaccctgagaggcagcgactactggggccagggcaccctggtgaccgtgagcagcgccagcaccaagggc

SEQ ID NO: 35001 - RNA, 390 nt, synthetic construct
  misc_feature 1..390: note = derived and/or modified sequence opt4 from anti-HIV_Chain
  source 1..390: mol_type = other RNA
cagagcgtgctgacccagccccccagcgccagcggcagccccggccagagcatcaccatcagctgcaccggcaccagcagcgacgtgggcggctacaactacgtgagctggtaccagcagccccccggcaaggcccccaaggtgatcatctacgaggtgagcaagagacccagcggcgtgcccgacagattcagcggcagcaagagcggcaacaccgccagcctgaccgtgagcggcctgcaggccgaggacgaggccgactactactgcagcagctacgccggcagcaacaacttcgtgttcggcaccggcaccgaggtgaccgtggtgggccagcccaaggccaaccccaccgtgaccctgttcccccccagcagcgaggagctgctg

SEQ ID NO: 35002 - RNA, 390 nt, synthetic construct
  misc_feature 1..390: note = derived and/or modified sequence opt4 from anti-HIV_Chain
  source 1..390: mol_type = other RNA
caggccgtggtgacccaggagcccagcctgaccgtgagccccggcggcaccgtgaccctgacctgcgccagcagcaccggcgccgtgaccagcggcttctacccccactggttccagcagaagcccggccaggcccccagagccctgatctacagcaccagcaacagatacagctggacccccgccagattcagcggcagcctgctgggcggcaaggccgccctgaccctgagcggcgtgcagcccgaggacgaggccgagtactactgcctgctgctgccctactacggcggcccctggatcttcggcggcggcaccaagctgaccgtgctgggccagcccaaggccgcccccagcgtgaccctgttcccccccagcagcgaggagctg

SEQ ID NO: 35003 - RNA, 390 nt, synthetic construct
  misc_feature 1..390: note = derived and/or modified sequence opt4 from anti-HIV_Chain
  source 1..390: mol_type = other RNA
cagagcgccctgacccagccccccagcgccagcggcgcccccggccagagagtgaccatcagctgcagcggcggccccagcaacgtgggcggcaactacgtgtactggtacagacagttccccggcaccgcccccaccctgctgatcctgagagacgaccagagacccagcggcgtgcccgacagattcagcgccagcaagagcggcaacagcgccagcctggccatcagcggcctgagacccgacgacgagggcttctacttctgcgccacctacgacagcgacggcagcatcagactgttcggcggcggcaccgccctgaccgtgctgagccagcccaaggccgcccccagcgtgaccctgttcccccccagcagcgaggagctgaag

SEQ ID NO: 35004 - RNA, 390 nt, synthetic construct
  misc_feature 1..390: note = derived and/or modified sequence opt4 from anti-HIV_Chain
  source 1..390: mol_type = other RNA
caggtgcagctggtggagagcggcagcgacgtgagaaagcccggcgccaccgtgaccgtgagctgcaaggccgacgaggacgaggacgacttcaccgcctacaactacttcatgcactgggtgagacaggcccccggccacggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgaccgtgagcagcgccagcaccaagggc

SEQ ID NO: 35005 - RNA, 390 nt, synthetic construct
  misc_feature 1..390: note = derived and/or modified sequence opt4 from anti-HIV_Chain
  source 1..390: mol_type = other RNA
gaggtgcagctggtggagagcggcagcgacgtgagaaagcccggcgccaccgtgaccgtgagctgcaaggccgacgaggacgaggacgacttcaccgcctacaactacttcatgcactgggtgagacaggcccccggccacggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgaccgtgagcagcgccagcaccaagggc

SEQ ID NO: 35006 - RNA, 390 nt, synthetic construct
  misc_feature 1..390: note = derived and/or modified sequence opt4 from anti-HIV_Chain
  source 1..390: mol_type = other RNA
gaggtgcagctggtgcagagcggcagcgacgtgagaaagcccggcgccaccgtgaccgtgagctgcaaggccgacgaggacgaggacgacttcaccgcctacgactacttcatgcactgggtgagacaggcccccggccacggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgaccgtgagcagcgccagcaccaagggc

SEQ ID NO: 35007 - RNA, 390 nt, synthetic construct
  misc_feature 1..390: note = derived and/or modified sequence opt4 from anti-HIV_Chain
  source 1..390: mol_type = other RNA
caggtgcagctggtgcagagcggcagcgacgtgagaaagcccggcgccaccgtgaccgtgagctgcaaggccgacgaggacgaggacgacttcaccgcctacaactacttcatgcactgggtgagacaggcccccggccacggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgaccgtgagcagcgccagcaccaagggc

SEQ ID NO: 35008 - RNA, 390 nt, synthetic construct
  misc_feature 1..390: note = derived and/or modified sequence opt4 from anti-HIV_Chain
  source 1..390: mol_type = other RNA
caggtgcagctggtgcagagcggcagcgacgtgagaaagcccggcgccaccgtgaccgtgagctgcaaggccgacgaggacgaggacgacttcaccgcctacaactacttcatgcactgggtgagacaggcccccggccacggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagcagaggcagaggcaccagcctgaccgtgagcagcgccagcaccaagggc

SEQ ID NO: 35009 - RNA, 390 nt, synthetic construct
  misc_feature 1..390: note = derived and/or modified sequence opt4 from anti-HIV_Chain
  source 1..390: mol_type = other RNA
gaggtgcagctggtggagagcggcagcgacgtgagaaagcccggcgccaccgtgaccgtgagctgcaaggccgacgaggacgaggacgacttcaccgcctacaactacttcatgcactgggtgagacaggcccccggccagggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgaccgtgagcagcgccagcaccaagggc

SEQ ID NO: 35010 - RNA, 390 nt, synthetic construct
  misc_feature 1..390: note = derived and/or modified sequence opt4 from anti-HIV_Chain
  source 1..390: mol_type = other RNA
gtggtgcagctggtgcagagcggcagcgacgtgagaaagcccggcgccaccgtgaccgtgagctgcaaggccgacgaggacgaggacgacttcaccgcctacaactacttcatgcactgggtgagacaggcccccggccacggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgaccgtgagcagcgccagcaccaagggc

SEQ ID NO: 35011 - RNA, 390 nt, synthetic construct
  misc_feature 1..390: note = derived and/or modified sequence opt4 from anti-HIV_Chain
  source 1..390: mol_type = other RNA
gaggtgcagctggtgcagagcggcagcgacgtgagaaagcccggcgccaccgtgaccgtgagctgcaaggccgacgaggacgaggacgacttcaccgcctacaactacttcatgcactgggtgagacaggcccccggccacggcctggagtggatcggctggatcaaccccagaaccggccagcccaaccacgccaagcagttccagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgaccgtgagcagcgccagcaccaagggc

SEQ ID NO: 35012 - RNA, 390 nt, synthetic construct
  misc_feature 1..390: note = derived and/or modified sequence opt4 from anti-HIV_Chain
  source 1..390: mol_type = other RNA
gaggtgcagctggtgcagagcggcagcgacgtgaagaagcccggcaccaccgtgaccatcagctgcaaggccgacgaggacgaggacgacttcaccgcctacaactacttcatgcactgggtgagacaggcccccggccagggcctggagtggatcggctggatcaaccccagaaccggccagcccaaccacgccaagcagctgcagggcagagtgaccctgaccagagagagaagcaccagcaccgtgttcatgaagctgaccaacctgagactggacgacaccgccgtgtacttctgcgccagacccctgagaggcggcgacacctggcactaccacagctggggcagaggcaccagcctgatcgtgagcagcgccagcaccaagggc

SEQ ID NO: 35013 - RNA, 390 nt, synthetic construct
  misc_feature 1..390: note = derived and/or modified sequence opt4 from anti-HIV_Chain
  source 1..390: mol_type = other RNA
caggtgcagctggtggagagcggcggcggcctggtgaagcccggcggcagcctgagactgagctgcgccgccagcggcttcagcttcaacgagtactacatgagctggatcagacaggcccccggccagggcctggagtgggtggccaacatcggcagcagcgacgcctacaccatctacgccgacagcgtgaagggcagattcaccatcagcagagacaacgccgagaacaccgtgtacctgcagatgaacagcctgagaggcgaggacaccgccgtgtactactgcgccagaatcgagggctactgcagcaacagcagatgcagcaactacttcgacccctggggccagggcgccctggtgaccgtgagcagcgccagcaccaagggc

SEQ ID NO: 35014 - RNA, 390 nt, synthetic construct
  misc_feature 1..390: note = derived and/or modified sequence opt4 from anti-HIV_Chain
  source 1..390: mol_type = other RNA
caggtgcagctggtgcagagcggcgccgaggtgaagaagcccggcgccagcgtgaaggtgagctgcaaggtgagcggctaccccctggccgagctgagcgtgcactgggtgagacaggtgcccggcaagggcctggagtgggtgggcggcttcgaccccgaggagggcaagaccgtgtacgcccagaagttccagggcagagtgaccatgaccgaggacagaagcaccgacaccgtgtacatggagctgatcagcctgagatacgaggacaccgccgtgtactactgcgccaccgacaaccccgtgctgcagctgggcgagctgagcagcagcctggactactggggccagggcaccctggtgaccgtgagcagcgccagcaccaagggc

SEQ ID NO: 35015 - RNA, 390 nt, synthetic construct
  misc_feature 1..390: note = derived and/or modified sequence opt4 from anti-HIV_Chain
  source 1..390: mol_type = other RNA
gaggtgcagctggtgcagagcggcgccgaggtgaagaagcccggcgagagcctgagaatcagctgcaagaccagcggctacaacttcaacgacgactggatcgcctgggtgagacagagacccgacaagggccccgagtggatgggcatcttctaccccggcgacagccaggccacctacagccccagcttccagggccacgtgaccttcagcgccgacaccagcatcagcaccgcctacctgcagtggaccagcctgaaggccagcgacaccgccatctactactgcgccagaaccagatgcttcggcgccaactgcttcaacttcatggacgtgtggggcaagggcaccgccctgaccgtgaccgtgagcagcgccagcaccaagggc

SEQ ID NO: 35016 - RNA, 390 nt, synthetic construct
  misc_feature 1..390: note = derived and/or modified sequence opt4 from anti-HIV_Chain
  source 1..390: mol_type = other RNA
caggtgcagctggtgcagctgctgcagagcggcgccgaggtgaagaagcccggcagcagcgtgaaggtgagctgccagatcagcggctacggcttcagcaactacgccatcagctgggtgagacaggcccccggccagggcctggagtggctgggcagaatcgtgcccgccgtgggcatgaccgagtacgcccagaagttccagggcagagtgaccttcaccgccgacagaagcaccatcaccgcctacatggacctgagaggcctgagaagcgacgacaccgccgtgtactactgcgtgagagacccccaggtggaggtgagaggcaacgccttcgacatctggggccagggcaccatggtgaccgtgagcagcgccagcaccaagggc

SEQ ID NO: 35017 - RNA, 390 nt, synthetic construct
  misc_feature 1..390: note = derived and/or modified sequence opt4 from anti-HIV_Chain
  source 1..390: mol_type = other RNA
caggtgcacctgcagcagtggggcgccggcctgctgaagcccagcgagaccctgagcctgacctgcgccgtgagcggcggcagcttcagcggcttcttctggacctggatcagacagagccccggcaagggcctggagtggatcggcgaggtgaaccacagcggcttcacccacagcaaccccagcctggagagcagagccaccatcagcgtggccgccagcaacacccagttcagcctgagactggccagcgtgaccgccgccgacaccgccatctacttctgcgccctgagatacttcgactggagccccttcagaagagacacctacggcaccgacgtgtggggccagggcaccaccgtgatcgtgagcagcgccagcaccaagggc

SEQ ID NO: 35018 - RNA, 390 nt, synthetic construct
  misc_feature 1..390: note = derived and/or modified sequence opt4 from anti-HIV_Chain
  source 1..390: mol_type = other RNA
caggtgagactggagcagagcggcggcgccctgagaaagcccggcgccagcgtgaccctgagctgccaggccagcggctacaacttcgtgaagtacatcatccactgggtgagacagagacccggcctgggcttcgagtgggtgggcatgatcgacccctacagaggcagaccctggtacgcccacagcttcgccggcagactgagcctgagcagagacaccagcaccgagaccctgtacatgaccctgagcagcctgaagagcgacgacaccgccacctacttctgcgccagagccgaggccgccagcgacagccacagcagacccatcatggactggacctggagaatcctgtgcctgctggccgtggtgcccgccagcaccaagggc

SEQ ID NO: 35019 - RNA, 390 nt, synthetic construct
  misc_feature 1..390: note = derived and/or modified sequence opt4 from anti-HIV_Chain
  source 1..390: mol_type = other RNA
caggtgagactggagcagagcggcgccgccgtgagaaagcccggcgccagcgtgaccctgagctgccaggccagcggctacaacttcgtgaactacatcatccactgggtgagacagagacccggcctggacttcgagtgggtgggcatgatcgacccctacagaggcagaccctggagcgcccacaagttccagggcagactgagcctgagcagagacgtgagcaccgagatcctgtacatgaccctgaacagcctgagaagcgacgacaccgccacctacttctgcgccagagccgaggccgagagccagagccacagcagacccatcatgttcgacagctggggccagggcagcagagtgaccgtgagcagcgccagcaccaagggc

SEQ ID NO: 35020 - RNA, 390 nt, synthetic construct
  misc_feature 1..390: note = derived and/or modified sequence opt4 from anti-HIV_Chain
  source 1..390: mol_type = other RNA
caggtgagactggagcagagcggcgccgccgtgaagaagcccggcgccagcgtgaccatcagctgccaggccagcggctacaacttcgtgaagttcttcatccactgggtgagacagagacccggccagggcttcgagtgggtgggcatgatcgagccctacagaggcagaccctggagcgccggcaacttccagggcagactgagcctgagcagagacgtgagcaccgagaccctgtacatgaccctgaacaacctgagaagcgacgacaccgccgtgtacttctgcgccagactggaggccgagagcgacagccacagcagacccatcatgttcgaccactggggccacggcagcctggtgaccgtgagcagcgccagcaccaagggc

SEQ ID NO: 35021 - RNA, 390 nt, synthetic construct
  misc_feature 1..390: note = derived and/or modified sequence opt4 from anti-HIV_Chain
  source 1..390: mol_type = other RNA
caggtgagactggagcagagcggcgccgccgtgagaaagcccggcgccagcgtgaccctgagctgccaggccagcggctacaacttcgtgaactacatcatccactgggtgagacagagacccggcctggacttcgagtgggtgggcatgatcgacccctacagaggcagaccctggagcgcccacaagttcgagggcagactgagcctgagcagagacgtgagcaccgaggtgctgtacatgaccctgagcagcctgagaagcgacgacaccgccacctacttctgcgccagagccgaggccgagagccagagccacagcagacccatcatgttcgactactggggccagggcagcagagtgaccgtgagcagcgccagcaccaagggc

SEQ ID NO: 35022 - RNA, 390 nt, synthetic construct
  misc_feature 1..390: note = derived and/or modified sequence opt4 from anti-HIV_Chain
  source 1..390: mol_type = other RNA
caggtgagactggagcagagcggcaccgccgtgagaaagcccggcgccagcgtgaccatcagctgccaggccagcggctacaacttcgtgaagttcttcatccacggcgtgagacagagacccggccagggcttcgagtgggtgggcatgatcgagcccttcagaggcagaccctggagcgccggcaacttccagggcagactgagcctgagcagagacgtgagcaccgagaccctgtacatgaccctgaacaacctgagaagcgacgacaccgccgtgtacttctgcgccagactggaggccgagagcgacagccacagcagacccatcatgttcgaccactggggccacggcagcctggtgaccgtgagcagcgccagcaccaagggc

SEQ ID NO: 35023 - RNA, 390 nt, synthetic construct
  misc_feature 1..390: note = derived and/or modified sequence opt4 from anti-HIV_Chain
  source 1..390: mol_type = other RNA
caggtgagactggagcagagcggcaccgccatgagaaagcccggcgccagcgtgaccctgagctgccaggccagcggctacaacttcgtgaagtacatcgtgcactgggtgagacagaagcccggcctgggcttcgagtgggtgggcatgatcgacccctacagaggcagaccctggagcgcccacaagttccagggcagactgagcctgagcagagacaccagcatggagatcctgtacatgaccctgaccagcctgaagagcgacgacaccgccacctacttctgcgccagagccgaggccgccagcgacagccacagcagacccatcatgttcgaccactggggccagggcagcagagtgaccgtgagcagcgccagcaccaagggc

SEQ ID NO: 35024 - RNA, 390 nt, synthetic construct
  misc_feature 1..390: note = derived and/or modified sequence opt4 from anti-HIV_Chain
  source 1..390: mol_type = other RNA
caggtgagactggagcagagcggcgccgccatgagaaagcccggcgccagcgtgaccctgagctgccaggccagcggctacaacttcgtgaagtacatcgtgcactgggtgagacagaagcccggcctgggcttcgagtgggtgggcatgatcgacccctacagaggcagaccctggagcgcccacaagttccagggcagactgagcctgagcagagacaccagcatggagatcctgtacatgaccctgaccagcctgaagagcgacgacaccgccacctacttctgcgccagagccgaggccgccagcgacagccacagcagacccatcatgttcgaccactggggccagggcagcagagtgaccgtgagcagcgccagcaccaagggc

SEQ ID NO: 35025 - RNA, 390 nt, synthetic construct
  misc_feature 1..390: note = derived and/or modified sequence opt4 from anti-HIV_Chain
  source 1..390: mol_type = other RNA
caggtgagactggagcagagcggcgccgccatgagaaagcccggcgccagcgtgaccctgagctgccaggccagcggctacaacttcgtgaagtacatcatccactgggtgagacagaagcccggcctgggcttcgagtgggtgggcatgatcgacccctacagaggcagaccctggagcgcccacaagttccagggcagactgagcctgagcagagacaccagcatggagatcctgtacatgaccctgaccagcctgaagagcgacgacaccgccacctacttctgcgccagagccgaggccgccagcgacagccacagcagacccatcatgttcgaccactggggccagggcagcagagtgaccgtgagcagcgccagcaccaagggc

SEQ ID NO: 35026 - RNA, 390 nt, synthetic construct
  misc_feature 1..390: note = derived and/or modified sequence opt4 from anti-HIV_Chain
  source 1..390: mol_type = other RNA
caggtgagactggagcagagcggcaacgccgtgagaaagcccggcgccagcgtgaccatcagctgccaggccagcggctacaacttcgtgaagttcttcatccactgggtgagacagagacccggccagggcttcgagtgggtgggcatgatcgagcccttcagaggcagaccctggagcgccggcaacttccagggcagactgagcctgagcagagacgtgagcaccgagaccctgtacatgaccctgaacaacctgagaagcgacgacaccgccgtgtacttctgcgccagactggaggccgagagcgacagccacagcagacccatcatgttcgaccactggggccacggcagcctggtgaccgtgagcagcgccagcaccaagggc

SEQ ID NO: 35027 - RNA, 390 nt, synthetic construct
  misc_feature 1..390: note = derived and/or modified sequence opt4 from anti-HIV_Chain
  source 1..390: mol_type = other RNA
caggtgagactggagcagagcggcgccgccgtgagaaagcccggcgccagcgtgaccctgagctgccaggccagcggctacaacttcgtgagatacatcatccactgggtgagacagagacccggcctggacttcgagtgggtgggcatgatcgacccctacagaggcagaccctggagcgcccacaagttcggcggcagactgagcctgaccagagacgtgagcaccgagatcctgtacatgaccctgaccagcctgagaagcgacgacaccgccacctacttctgcgccagagccgaggccgagagccagagccacagcagacccatcatgttcgacagctggggccagggcagcagagtgaccgtgagcagcgccagcaccaagggc

SEQ ID NO: 35028 - RNA, 390 nt, synthetic construct
  misc_feature 1..390: note = derived and/or modified sequence opt4 from anti-HIV_Chain
  source 1..390: mol_type = other RNA
caggtgagactggagcagagcggcgccgccgtgagaaagcccggcgccagcgtgaccctgagctgccaggccagcggctacaacttcgtgaactacatcatccactgggtgagacagagacccggcctggacttcgagtgggtgggcatgatcgacccctacagaggcagaccctggagcgcccacaagttccagggcagactgagcctgagcagagacgtgagcaccgagatcctgtacatgaccctgagcagcctgagaagcgacgacaccgccacctacttctgcgccagagccgaggccgagagccagagccacagcagacccatcatgttcgacttctggggccagggcagcagagtgaccgtgagcagcgccagcaccaagggc

SEQ ID NO: 35029 - RNA, 390 nt, synthetic construct
  misc_feature 1..390: note = derived and/or modified sequence opt4 from anti-HIV_Chain
  source 1..390: mol_type = other RNA
caggtgagactggagcagagcggcaccgccgtgagaaagcccggcgccagcgtgaccatcagctgccaggccagcggctacaacttcgtgaagttcttcatccactgggtgagacagagacccggccagggcttcgagtgggtgggcatgatcgagcccttcagaggcagaccctggagcgccggcaacttccagggcagactgagcctgagcagagacgtgagcaccgagaccctgtacatgaccctgaacaacctgagaagcgacgacaccgccgtgtacttctgcgccagactggaggccgagagcgacagccacagcagacccatcatgttcgaccactggggccacggcagcctggtgaccgtgagcagcgccagcaccaagggc

SEQ ID NO: 35030 - RNA, 390 nt, synthetic construct
  misc_feature 1..390: note = derived and/or modified sequence opt4 from anti-HIV_Chain
  source 1..390: mol_type = other RNA
caggtgagactggagcagagcggcgccgccatgagaaagcccggcgccagcgtgaccctgagctgccaggccagcggctacaacttcgtgaagtacatcgtgcactgggtgagacagaagcccggcctgggcttcgagtgggtgggcatgatcgacccctacagaggcagaccctggagcgcccacaagttccagggcagactgagcctgagcagagacaccagcatggagatcctgtacatgaccctgaccagcctgaccagcgacgacaccgccacctacttctgcgccagagccgaggccgccagcgacagccacagcagacccatcatgttcgaccactggggccagggcagcagagtgaccgtgagcagcgccagcaccaagggc

SEQ ID NO: 35031 - RNA, 390 nt, synthetic construct
  misc_feature 1..390: note = derived and/or modified sequence opt4 from anti-HIV_Chain
  source 1..390: mol_type = other RNA
gaggtgcagctggtgcagagcggcggcggcctggtgcagcccggcggcagcctgagactgagctgcgccgccagcggcctgaccttcagaaacttcgccatgagctgggtgagacaggcccccggcaagggcctggagtgggtgagcagcatcagcggcagcggcggcagcacctactacgccgacagcgtgaagggcagattcaccatcagcagagacaacagcaagaacaccctgtacctgcagatgaacagcctgagaggcgaggacaccgccgtgtacttctgcgccaagggcgtgggctacgacatcctgaccggcctgggcgacgccttcgacatctggggccagggcaccgtggtggccgtgagcagcgccagcaccaagggc

SEQ ID NO: 35032 - RNA, 393 nt, synthetic construct
  misc_feature 1..393: note = derived and/or modified sequence opt4 from anti-HIV_Chain
  source 1..393: mol_type = other RNA
caggtgcagctggtgcagagcggcgccgccgtgagaaagcccggcgccagcgtgaccgtgagctgcaagttcgccgaggacgacgactacagcccccactgggtgaaccccgcccccgagcactacatccacttcctgagacaggcccccggccagcagctggagtggctggcctggatgaaccccaccaacggcgccgtgaactacgcctggcagctgcacggcagactgaccgccaccagagacggcagcatgaccaccgccttcctggaggtgagaagcctgagaagcgacgacaccgccgtgtactactgcgccagagcccagaagagaggcagaagcgagtgggcctacgcccactggggccagggcacccccgtgctggtgagcagc

SEQ ID NO: 35033 - RNA, 393 nt, synthetic construct
  misc_feature 1..393: note = derived and/or modified sequence opt4 from anti-HIV_Chain
  source 1..393: mol_type = other RNA
caggtgcagctgcagcagtggggcgccggcctgctgaagcccagcgagaccctgagcctgacctgcgccgtgtacgccggcagcttcagcggctactactggacctggatcagacagccccccggcaagggcctggagtggatcggcgaggtgaaccacggcggcagcaccaactacaaccccagcctgaagagcagagtgaccctgagcgtggacaccagcaagaaccagttcagcctgaagctgaccagcgtgaccgccgccgacaccgccgtgtactactgcgccagagtgagcagatacgacttctggagcggcaactacggcagctacggcctggacgtgtggggccagggcaccaccgtgaccgtgagcagcgccagcaccaagggc

SEQ ID NO: 35034 - RNA, 393 nt, synthetic construct
  misc_feature 1..393: note = derived and/or modified sequence opt4 from anti-HIV_Chain
  source 1..393: mol_type = other RNA
gaggtgcagctggtgcagagcggcggcggcgtggtgcagcccggcagaagcctgagactgagctgcgtggtgagcggcttcaccttcagcagcttcaccttccactgggtgagacaggcccccggcaagggcctggagtgggtggccggcatgagcttccacgccacctacatctactacgccgacagcgtgaagggcagattcaccatcagcagagacgacagccaggacaccctgtacctggagatggacagcctgagaagcgaggacaccgccatctactactgcgccagagaccccggcatccacgactacggcgactacgcccccggcgccttcgactactggggccagggcagccccgtgaccgtgagcagcgccagcaccaagggc

SEQ ID NO: 35035 - RNA, 393 nt, synthetic construct
  misc_feature 1..393: note = derived and/or modified sequence opt4 from anti-HIV_Chain
  source 1..393: mol_type = other RNA
caggtgcagctggtgcagagcggcaccgaggtgcagaagcccggcgccagcgtgaaggtgagctgcaagaccagcggctacaccttcagcaagtactacatccactgggtgagacaggcccccggccagggcctggagtgggtgggcagaatcaacaccgacagcggcggcaccgactacgccgagaagttccagggcagagtgaccatgaccagagacaccagcatcaccaccgtgtacctggagatgagaggcctgaccagcgacgacaccgccgccttctactgcgccagaggccccccccacgccggcggctggaccatctactactacggcctggacgtgtggggccagggcaccagcgtgatcgtgagcagcgccagcaccaagggc

SEQ ID NO: 35036 - RNA, 393 nt, synthetic construct
  misc_feature 1..393: note = derived and/or modified sequence opt4 from anti-HIV_Chain
  source 1..393: mol_type = other RNA
agaaccgtggtgacccagccccccagcgtgagcggcgcccccggccagagagtgaccatcagctgcaccggcagcagcagcaacatcggcgccggctacgacgtgcactggtaccagcagctgcccggcaccgcccccaagctgctgatctacggcaacagcaacagacccagcggcgtgcccgacagattcagcggcagcaagagcggcaccagcgccagcctggccatcaccggcctgcaggccgaggacgaggccgactactactgccagagctacgacagcagcctgagcggcagcggcgtgttcggcaccggcaccaaggtgaccgtgctgggccagcccaaggccaaccccaccgtgaccctgttcccccccagcagcgaggagctg

SEQ ID NO: 35037 - RNA, 393 nt, synthetic construct
  misc_feature 1..393: note = derived and/or modified sequence opt4 from anti-HIV_Chain
  source 1..393: mol_type = other RNA
caggtgcagctgcagcagtggggcagcggcctgctgaagcccagcgagaccctgagcctgacctgcgccgtgtacggcggcagcttcagaagctactactggaactggatcagacagagccccggcaagggcctggagtggatcggcgaggtgagccacagcggcagcaccaactacaaccccgccctgaagagcagagtgaccatcagcgtggacaccagcaagaaccagttcagcctgaaggtgaagagcgtgaccgccgccgacaccgccctgtactactgcagcagaggcagaggcaagagatgcagcggcgcctactgcttcgccggctacttcgacagctggggccagggcggcctggtggtggtgagcagcgccagcaccaagggc

SEQ ID NO: 35038 - RNA, 393 nt, synthetic construct
  misc_feature 1..393: note = derived and/or modified sequence opt4 from anti-HIV_Chain
  source 1..393: mol_type = other RNA
caggtgcacctggtgcagagcggcgccgaggtgaagaagcccggcagcagcgtgagagtgagctgcgaggccagcggctggaccttcggcagcgtgaacagcgccatcacctgggtgagacaggcccccggccagggcctggagtggatgggcagaaccatccccttcctgggcatcagcaactacgcccagaagttccagggcagagtgaccatcaccgccgacaagagcaccaacatcgcctacgtggacgtgaccagcctgaccagccaggacaccgccgtgtactactgcgccagactgatcaccggcatgaccgccccctggttctactacatggacgtgtggggcaagggcaccaccgtgaccgtgagcagcgccagcaccaagggc

SEQ ID NO: 35039 - RNA, 393 nt, synthetic construct
  misc_feature 1..393: note = derived and/or modified sequence opt4 from anti-HIV_Chain
  source 1..393: mol_type = other RNA
caggtgcacctgcaggagagcggccccagactggtgagaagcagcgagaccctgagcctgacctgcagcgtgcccggcggcagcatcgtgaaccccatcaccaactactactggagctggatcagacagagccccagaaagggcctgcagtggatcggcgacatctactacaccggcaccagcagcagaaaccccagcctggacagcagagtgagcatcagcatggacgtgagcagaaagcagatcagcctgaccctgtacagcgtgaccgccgccgacaccgccgtgcactactgcgccagccagagcctgagctggtacagacccagcggctacttcgagagctggggccagggcatcctggtgaccgtgagcagcgccagcaccaagggc

SEQ ID NO: 35040 - RNA, 393 nt, synthetic construct
  misc_feature 1..393: note = derived and/or modified sequence opt4 from anti-HIV_LightChain
  source 1..393: mol_type = other RNA
atgaagctgcccgtgagactgctggtgctgatgttctggatccccgccagcagcagcgacatcgtgatgacccagagccccctgagcctgcccgtgacccccggcgagcccgccagcatcagctgcagaagcagccagagactgctgagcagctacggccacacctacctgcactggtacctgcagaagcccggccagagcccccagctgctgatctacgaggtgagcaacagattcagcggcgtgcccgacagattcagcggcagcggcagcggcaccgacttcaccctgaagatcagcagagtggaggccgaggacgtgggcgtgtactactgcagccagagcacccacgtgcccctgaccttcggccagggcaccaaggtggagatcaag

SEQ ID NO: 35041 - RNA, 396 nt, synthetic construct
  misc_feature 1..396: note = derived and/or modified sequence opt4 from anti-HIV_Chain
  source 1..396: mol_type = other RNA
caggtgcagctgcaggagagcggccccggcctggtgaagcccagcgagaccctgagcgtgacctgcagcgtgagcggcgacagcatgaacaactactactggacctggatcagacagagccccggcaagggcctggagtggatcggctacatcagcgacagagccagcgccacctacaaccccagcctgaacagcagagtggtgatcagcagagacaccagcaagaaccagctgagcctgaagctgaacagcgtgacccccgccgacaccgccgtgtactactgcgccaccgccagaagaggccagagaatctacggcgtggtgagcttcggcgagttcttctactactacagcatggacgtgtggggcaagggcaccaccgtgaccgtgagcagc

SEQ ID NO: 35042 - RNA, 396 nt, synthetic construct
  misc_feature 1..396: note = derived and/or modified sequence opt4 from anti-HIV_Chain
  source 1..396: mol_type = other RNA
caggtgcagctgcaggagagcggccccggcctggtgaagccccccgagaccctgagcctgacctgcagcgtgagcggcgccagcgtgaacgacgcctactggagctggatcagacagagccccggcaagagacccgagtgggtgggctacgtgcaccacagcggcgacaccaactacaaccccagcctgaagagaagagtgaccttcagcctggacaccgccaagaacgaggtgagcctgaagctggtggccctgaccgccgccgacagcgccgtgtacttctgcgccagagccctgcacggcaagagaatctacggcatcgtggccctgggcgagctgttcacctacttctacatggacgtgtggggcaagggcaccaccgtgaccgtgagcagc

SEQ ID NO: 35043 - RNA, 396 nt, synthetic construct
  misc_feature 1..396: note = derived and/or modified sequence opt4 from anti-HIV_Chain
  source 1..396: mol_type = other RNA
caggtgcagctgcaggagagcggccccggcctggtgaagcccagcgagaccctgagcctgacctgcagcgtgagcggcgccagcatcagcgacagctactggagctggatcagaagaagccccggcaagggcctggagtggatcggctacgtgcacaagagcggcgacaccaactacagccccagcctgaagagcagagtgaacctgagcctggacaccagcaagaaccaggtgagcctgagcctggtggccgccaccgccgccgacagcggcaagtactactgcgccagaaccctgcacggcagaagaatctacggcatcgtggccttcaacgagtggttcacctacttctacatggacgtgtggggcaacggcacccaggtgaccgtgagcagc

SEQ ID NO: 35044 - RNA, 396 nt, synthetic construct
  misc_feature 1..396: note = derived and/or modified sequence opt4 from anti-HIV_Chain
  source 1..396: mol_type = other RNA
caggtgcacctgcaggagagcggccccggcctggtgaagcccagcgagaccctgagcctgacctgcaacgtgagcggcaccctggtgagagacaactactggagctggatgagacagcccctgggcaagcagcccgagtggatcggctacgtgcacgacagcggcgacaccaactacaaccccagcctgaagagcagagtgcacctgagcctggacaagagcaacaacctggtgagcctgagactgaccgccgtgaccgccgccgacagcgccacctactactgcgccaccaccaagcacggcagaagaatctacggcatcgtggccttcaacgagtggttcacctacttctacatggacgtgtggggcaagggcaccaccgtgaccgtgagcagc

SEQ ID NO: 35045 - RNA, 396 nt, synthetic construct
  misc_feature 1..396: note = derived and/or modified sequence opt4 from anti-HIV_Chain
  source 1..396: mol_type = other RNA
caggtgcagctgcaggagagcggccccggcctggtgaagcccagcgagaccctgagcgtgacctgcagcgtgagcggcgacagcatgaacaactactactggacctggatcagacagagccccggcaagggcctggagtggatcggctacatcagcgacagagagagcgccacctacaaccccagcctgaacagcagagtggtgatcagcagagacaccagcaccaaccagctgagcctgaagctgaacagcgtgacccccgccgacaccgccgtgtactactgcgccaccgccagaagaggccagagaatctacggcgtggtgagcttcggcgagttcttctactactacagcatggacgtgtggggcagaggcaccaccgtgaccgtgagcagc

SEQ ID NO: 35046 - RNA, 396 nt, synthetic construct
  misc_feature 1..396: note = derived and/or modified sequence opt4 from anti-HIV_Chain
  source 1..396: mol_type = other RNA
caggtgcagctggtggagagcggccccggcctggtgacccccagcgagaccctgagcctgacctgcaccgtgagcaacggcagcgtgagcggcagattctggagctggatcagacagagccccggcagaggcctggagtggatcggctacttcagcgacaccgacagaagcgagtacagccccagcctgagaagcagactgaccctgagcctggacgccagcagaaaccagctgagcctgaagctgaagagcgtgaccgccgccgacagcgccacctactactgcgccagagcccagcagggcaagagaatctacggcatcgtgagcttcggcgagttcttctactactactacatggacgcctggggcaagggcaccgccgtgaccgtgagcagc

SEQ ID NO: 35047 - RNA, 396 nt, synthetic construct
  misc_feature 1..396: note = derived and/or modified sequence opt4 from anti-HIV_Chain
  source 1..396: mol_type = other RNA
caggtgcagctgcaggagagcggccccggcctggtgaagccccccgagaccctgagcctgacctgcagcgtgagcggcgccagcatcaacgacgcctactggagctggatcagacagagccccggcaagagacccgagtgggtgggctacgtgcaccacagcggcgacaccaactacaaccccagcctgaagagaagagtgaccttcagcctggacaccgccaagaacgaggtgagcctgaagctggtggacctgaccgccgccgacagcgccgtgtacttctgcgccagagccctgcacggcaagagaatctacggcatcgtggccctgggcgagctgttcacctacttctacatggacgtgtggggcaagggcaccaccgtgaccgtgagcagc

SEQ ID NO: 35048 - RNA, 396 nt, synthetic construct
  misc_feature 1..396: note = derived and/or modified sequence opt4 from anti-HIV_Chain
  source 1..396: mol_type = other RNA
caggtgcagctgcaggagagcggccccggcctggtgaagccccccgagaccctgagcctgacctgcagcgtgagcggcgccagcatcaacgacgcctactggagctggatcagacagagccccggcaagagacccgagtgggtgggctacgtgcaccacagcggcgacaccaactacaaccccagcctgaagagaagagtgagcttcagcctggacaccgccaagaacgaggtgagcctgaagctggtggacctgaccgccgccgacagcgccatctacttctgcgccagagccctgcacggcaagagaatctacggcatcgtggccctgggcgagctgttcacctacttctacatggacgtgtggggcaagggcaccaccgtgaccgtgagcagc

SEQ ID NO: 35049 - RNA, 396 nt, synthetic construct
  misc_feature 1..396: note = derived and/or modified sequence opt4 from anti-HIV_Chain
  source 1..396: mol_type = other RNA
caggtgcagctgcaggagagcggccccggcctggtgaagcccagcgagaccctgagcgtgacctgcagcgtgagcggcgacagcatgaacaacagctactggacctggatcagacagagccccggcaagggcctggagtggatcggctacatcagcaagagcgagagcgccaactacaaccccagcctgaacagcagagtggtgatcagcagagacaccagcaagaaccagctgagcctgaagctgaacagcgtgacccccgccgacaccgccgtgtactactgcgccaccgccagacacggccagagaatctacggcgtggtgagcttcggcgagttcttcacctactacagcatggacgtgtggggcaagggcaccaccgtgaccgtgagcagc

SEQ ID NO: 35050 - RNA, 396 nt, synthetic construct
  misc_feature 1..396: note = derived and/or modified sequence opt4 from anti-HIV_Chain
  source 1..396: mol_type = other RNA
caggtgcagctgcaggagagcggccccggcctggtgaagcccagcgagaccctgagcctgacctgcagcgtgagcaacggcagcgtgagcggcagattctggagctggatcagacagagccccggcagaggcctggagtggatcggctacttcagcgacaccgagaagagcaactacaaccccagcctgagaagcagactgaccctgagcgtggacgccagcaagaaccagctgagcctgaagctgaacagcgtgaccgccgccgacagcgccacctactactgcgccagaacccagcagggcaagagaatctacggcgtggtgagcttcggcgagttcttccactactactacatggacgcctggggcaagggcaccgccgtgaccgtgagcagc

SEQ ID NO: 35051 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcaccgccctgaagagccccggcagcagcgccaagctgagctgcaccgtgctgggcgacgagttcggcacctacttcatcagctggatcagacaggcccccggccagggcctggagtgggtgggcggcatcgtgccccacagccagctgcagagcagcgcccagaagttccacggcagaatcatcatcagcgccggcgccggcgtgaccccccccgtggtgagcctgcagctgaccaacctgaccttcgaggacaccggcacctacttctgcgccagagagagaggcagacacagagaccccaagaccggcgacgccctgagaggcagatacttcgacttctggggcagaggcaccggcgtgagcgtgagcgcc

SEQ ID NO: 35052 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcaccgccctgaagagccccggcagcagcgccaagctgagctgcaccgtgctgggcgacgagttcggcacctacttcatcagctggatcagacaggcccccggccagggcctggagtgggtgggcggcatcgtgccccacagccagctgcagagcagcgcccagaagttccacggcagaatcatcatcagcgccggcgccggcgtgaccccccccgtggtgagcctgcagctgaccaacctgaccttcgaggacaccggcacctacttctgcgccagagagagaggcagacacagagaccccaagaccggcaaggcccccagaggcagatacttcgacttctggggcagaggcaccggcgtgaccgtgagcgcc

SEQ ID NO: 35053 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcaccgccctgaagagccccggcagcagcgccaagctgagctgcaccgtgctgggcgacgagttcggcacctacttcatcagctggatcagacaggcccccggccagggcctggagtgggtgggcggcatcgtgccccacagccagctgcagagcagcgcccagaagttccacggcagaatcaccatcagcgccggcgccggcgtgaccccccccgtggtgagcctgcagctgaccaacctgaccttcgaggacaccggcacctacttctgcgccagagagagaggcagacacagagaccccaagaccggcgacgccctgagaggcagatacttcgacttctggggcagaggcaccggcgtgagagtgagcacc

SEQ ID NO: 35054 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcgccgccgtgaagagccccggcagcagcgccaagctgagctgcaccgtgctgggcgacgagttcggcacctacttcatcagctggatcagacaggcccccggccagggcctggagtgggtgggcggcatcgtgccccacagccagctgcagagcagcgcccagagattccacggcagaatcaccatcagcgccggcgccggcgtgaccccccccgtggtgagcctgcagctgaccaacctgaccttcgacgacgccggcacctacttctgcgccagagagagaggcagacacagagaccccaagaccggcgacgccctgagaggcagatacttcgacttctggggcagaggcaccggcatcagcgtgagcccc

SEQ ID NO: 35055 - RNA, 396 nt, synthetic construct
  misc_feature 1..396: note = derived and/or modified sequence opt4 from anti-HIV_Chain
  source 1..396: mol_type = other RNA
gaggtgcagctggtgcagagcggcgccgaggtgaagaagcccggcgccagcgtgaaggtgagctgcaaggtgagcggctacaccctgaccgagctgagcatccactgggtgagacaggcccccggcaagggcctggagtggatgggcggcttcgaccccgaggacgacgaggccatctacgagcccaagttccagggcagactgaccatgaccgaggacaccagcaccgacaccgcctacatggagctgagcagcctgagaagcgaggacaccgccgtgtactactgcgccaccgccgaccccttcaaggtggcccaggacgagggcctgtacgtgatcttcgactactggggccagggcaccctggtgaccgtgagcagcgccagcaccaagggc

SEQ ID NO: 35056 - RNA, 396 nt, synthetic construct
  misc_feature 1..396: note = derived and/or modified sequence opt4 from anti-HIV_Chain
  source 1..396: mol_type = other RNA
gaggtgcagctggtggagagcggcggcggcctgctgcagcccggcggcagcctgagactgagctgcgccgccagcggcttcagcttcaacgacttcgagatgaactgggtgagacaggcccccggcaagggcctggagtgggtgagctacatcagcaacgacggcaccatgatccactacgccgacagcgtgaagggcagattcaccatcagcagagacaacgccaagaagagcctgttcctgcagatgaacagcctgagagccgaggacaccgccgtgtactactgcgccagactggccgaggtgccccccgccatcagaggcagctactactacggcatggacgtgtggggccagggcaccaccgtgaccgtggccagcgccagcaccaagggc

SEQ ID NO: 35057 - RNA, 396 nt, synthetic construct
  misc_feature 1..396: note = derived and/or modified sequence opt4 from anti-HIV_Chain
  source 1..396: mol_type = other RNA
caggtgcagctgatgcagagcggcgccgaggtgaagagacccggcgccagcgtgaaggtgagctgcaaggccttcagacacagcctgaacaacctgggcatcagctggatcagaagagcccccggcagaggcctggagtggctgggctggatcaacgtgtacgagggcaacaccaagtacggcagaagattccagggcagagtgaccatgaccaccgacagaagcaccaacaccgtgagcatggagctgagaagcctgaccagcgacgacaccgccgtgtactactgcgccagagacaaccacttctggagcggcagcagcagatactactacttcggcatggacgtgtggggccagggcaccaccgtgatcgtgagcagcgccagcaccaagggc

SEQ ID NO: 35058 - RNA, 396 nt, synthetic construct
  misc_feature 1..396: note = derived and/or modified sequence opt4 from anti-HIV_Chain
  source 1..396: mol_type = other RNA
caggtgcagctggtgcagtggggcgccggcctgctgaagcccctggagaccctgagcctgacctgcgccgtgtacggcggcagcttcaacggctacttctggagctggatcagacagacccccggcaagggcctggagtggatcggcgagatcaaccacggcggcagcgccaacttcaaccccagcctgaagagcagagtgaccatgagcgtggacaccagcaagaaccagttcagcctgaagctggccagcgtgaccgccgccgacaccgccatctactactgcgccagaggcagaatcaccatggtgagaggcgacccccagagaggcggcgtgagaatggacgtgtggggccagggcaccagcgtgaccgtgagcagcgccagcaccaagggc

SEQ ID NO: 35059 - RNA, 396 nt, synthetic construct
  misc_feature 1..396: note = derived and/or modified sequence opt4 from anti-HIV_Chain
  source 1..396: mol_type = other RNA
ctggtgcagctggtgcagagcggcgccgaggtgaagaagcccggcgccagcgtgaaggtgagctgcaaggtgagcggccacaccctgagcgagctgagcatcaactgggtgagacacgtgcccggcaagggcctggagtggatgggcggcctggaccccgaggacggcgaggccatccacgagcccaagttccagggcagactgaccatgaccgaggacaccagcaccgacaccgcctacagcaccctgagcgtgtgggcccccgtggccgccgccatgtactactgcgccaccgccgaccccttcaaggtggcccaggacgagggcctgtacgtgatcttcgactactggggccagggcaccctggtgaccgtgagcagcgccagcaccaagggc

SEQ ID NO: 35060 - RNA, 396 nt, synthetic construct
  misc_feature 1..396: note = derived and/or modified sequence opt4 from anti-HIV_Chain
  source 1..396: mol_type = other RNA
caggtgcagctgctgcagagcggcggcgaggtgaagaagcccggcgccagcgtgaaggtgagctgcaaggtgagcggctacaccctgaccgagctgagcatccactgggtgagacaggcccccggcaagggcctggagtggatgggcggcttcgaccccgaggacgacgaggccatctacgagcccaagttccagggcagactgaccatgaccgaggacaccagcaccgacaccgcctacatggagctgagcagcctgagaagcgaggacaccgccgtgtactactgcgccaccgccgaccccttcaaggtggcccaggacgagggcctgtacgtgatcttcgactactggggccagggcaccctggtgaccgtgagcagcgccagcaccaagggc

SEQ ID NO: 35061 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcgccgaggtgaagaagcccggcgccagcgtgaaggtgagctgcaaggtgagcggctacaccctgaccgagctgagcatccactgggtgagacaggcccccggcaagggcctggagtggatgggcggcttcgacagcgaggacggcgaggccttctacaagcagaacttccagggcagagtgaccatgaccgaggacaccagcaccgacaccgcctacatggagctgagaagactgagaagcgaggacaccgccgtgtactactgcgccaccgccgacagattcaaggtggcccaggacgagggcctgttcgtgatcttcgactactggggccagggcaccctggtgaccgtgagcagcgccagcaccaagggc

SEQ ID NO: 35062 - RNA, 396 nt, synthetic construct
  misc_feature 1..396: note = derived and/or modified sequence opt4 from anti-HIV_Chain
  source 1..396: mol_type = other RNA
caggtgcacctggtgcagagcggcgccgaggtgaagaagcccggcgccagcgtgagagtgagctgcaaggccagcggctacaccttcaccacctacggcatcagctgggtgagacaggcccccggccagggcctggagtggatgggctggatcagcgcccacagcggcgacaccaactacgcccagaagctgcaggccagagtgaccatgaccaccgacaccagcaccaacaccgcctacatggagctgagaagcctgaccagcgacgacaccgccgtgtactactgcgccagagacagacccagacactactacgacagaggcggctactacagccccttcgactactggggccagggcaccctggtgaccgtgagcagcgccagcaccaagggc

SEQ ID NO: 35063 - RNA, 396 nt, synthetic construct
  misc_feature 1..396: note = derived and/or modified sequence opt4 from anti-HIV_Chain
  source 1..396: mol_type = other RNA
ctggtgcagctgctgcagagcggcgccgaggtgaagaagcccggcgccagcgtgaaggtgagctgcaaggtgagcggctacaccctgaccgagctgagcatccactgggtgagacaggcccccggcaagggcctggagtggatgggcggcttcgaccccgaggacgacgaggccatctacgagcccaagttccagggcagactgaccatgaccgaggacaccagcaccgacaccgcctacatggagctgagcagcctgagaagcgaggacaccgccgtgtactactgcgccaccgccgaccccttcaaggtggcccaggacgagggcctgtacgtgatcttcgactactggggccagggcaccctggtgaccgtgagcagcgccagcaccaagggc

SEQ ID NO: 35064 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcgccgaggtgaagaagcccggcgccagcgtgaaggtgagctgcaaggtgagcggccacaccctgagcgagctgagcatcaactgggtgagacacgtgcccggcaagggcctggagtggatgggcggcctggaccccgaggacggcgaggccatccacgagcccaagttccagggcagactgaccatgaccgaggacaccagcaccgacaccgcctacgtggagctgagcagcctgagaagcgaggacaccgccatgtactactgcgccaccgccgaccccttcaaggtggcccaggacgagggcctgtacgtgatcttcgactactggggccagggcaccctggtgaccgtgagcagcgccagcaccaagggc

SEQ ID NO: 35065 - RNA, 396 nt, synthetic construct
  misc_feature 1..396: note = derived and/or modified sequence opt4 from anti-HIV_Chain
  source 1..396: mol_type = other RNA
caggtgcagctgctgcagagcggcgccgaggtgaagaagcccggcgccagcgtgaaggtgagctgcaaggtgagcggctacaccctgaccgagctgagcatcaactgggtgagacaggcccccggcaagggcctggagtggatgggcggcttcgaccccgaggacgacgaggccatctacgagcccaagttccagggcagactgaccatgaccgaggacaccagcaccgacaccgcctacatggagctgagcagcctgagaagcgaggacaccgccgtgtactactgcgccaccgccgaccccttcaaggtggcccaggacgagggcctgtacgtgatcttcgactactggggccagggcaccctggtgaccgtgagcagcgccagcaccaagggc

SEQ ID NO: 35066 - RNA, 396 nt, synthetic construct
  misc_feature 1..396: note = derived and/or modified sequence opt4 from anti-HIV_Chain
  source 1..396: mol_type = other RNA
cagccccagctggtgcagagcggcagcggcgccgaggtgaagaagcccggcgccagcgtgagaatcagctgcgaggccagcgagtacaacgtgttcgaccacttcatgcagtgggtgagacaggcccccggccagggcctggagtggatgggctggatcaaccccagaggcggctaccccagctacagccccaccttccagggcagactgaccttcaccagacagcccagctgggacgacagcaccatcaccttccacatggagctgagaggcctgggccacgacgacaccgccgtgtactactgcgccagaccccacagccccgacgacgcctggagcctggacgtgtggggcagaggcaccctggtgaccgtgagcagcgccagcaccaagggc

SEQ ID NO: 35067 - RNA, 396 nt, synthetic construct
  misc_feature 1..396: note = derived and/or modified sequence opt4 from anti-HIV_Chain
  source 1..396: mol_type = other RNA
cagccccagctggtgcagagcggcagcggcgccgaggtgaagaagcccggcgccagcgtgagaatcagctgcgaggccagcgagtacaacgtgttcgaccacttcatgcagtgggtgagacaggcccccggccagggcctggagtggatgggctggatcaaccccagaggcggctaccccagctacagccccagattccagggcagactgaccttcaccagacagcccagctgggacgacagcagcgtgaccttccacatggagctgagaggcctgagacacgacgacaccgccgtgtactactgcgccagaccccacagccccgacgacgcctggagcctggacgtgtggggcagaggcaccctggtgaccgtgagcagcgccagcaccaagggc

SEQ ID NO: 35068 - RNA, 396 nt, synthetic construct
  misc_feature 1..396: note = derived and/or modified sequence opt4 from anti-HIV_Chain
  source 1..396: mol_type = other RNA
gaggtgcagctggtggagagcggcggcggcgtggtggagcccggcgagagcctgagactgagctgcgccgccagcggcttcaccttcagaagctacgacatgttctgggtgagacaggccaccggcaagagcctggagtgggtgagcgccatcggcatcgccggcgacacctactacagcggcagcgtgaagggcagattcaccatcagcagagagaacgccagaaccagcctgtacctgcagctgagcggcctgagagtggaggacagcgccgtgtacttctgcgtgagaggcagcccccccagaatcgccgccaccgagtacaactactactacggcctggacgtgtggggccagggcaccaccgtgagcgtgttcagcgccagcaccaagggc

SEQ ID NO: 35069 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcgccgaggtgaagaagcccggcagcagcgtgaaggtgagctgcaaggccagcggcggcaccttcaccacctacgacatcagctgggtgagacaggcccccggccagggcctggagtggatgggcggcatcctgcccgacttcggcgcccccagctacgcccagaagttccaggacagagtgaccatcaccaccgacgagagcagcagcaccgcctacatggagctgaacagcctgagaagcgaggacaccgccatctactactgcgccagaggcagaggcgacgacttctggagcggcgagagccccagctggtacttcgactactggggccagggcaccctggtgaccgtgagcagcgccagcaccaagggc

SEQ ID NO: 35070 - RNA, 396 nt, synthetic construct
  misc_feature 1..396: note = derived and/or modified sequence opt4 from anti-HIV_Chain
  source 1..396: mol_type = other RNA
cagccccagctggtgcagagcggcagcggcgccgaggtgaagaagcccggcgccagcgtgagaatcagctgcgaggccagcgagtacaacgtgttcgaccacttcatgcagtgggtgagacaggcccccatggagggcctggagtggatgggctggatcaaccccagaggcggctaccccagctacagccccaccttccagggcagactgaccttcaccagacagcccagctgggacgacagcaccatcaccttccacatggagctgagaggcctgagacacgacgacaccgccgtgtactactgcgccagaccccacagccccgacgacgcctggagcctggacgtgtggggcagaggcaccctggtgaccgtgagcagcgccagcaccaagggc

SEQ ID NO: 35071 - RNA, 396 nt, synthetic construct
  misc_feature 1..396: note = derived and/or modified sequence opt4 from anti-HIV_Chain
  source 1..396: mol_type = other RNA
gaggtgagactgctggagagcggcggcggcctggtgcagcccggcggcagcctgagactgagctgcagcgccagcggcttcaccttcagcaacagcgccctgagctgggtgagacaggcccccggcaagggcctggagtgggtgagcagcgtggtgagcagcggcggcgacaccttctacgccgacagcgtgaagggcagattcaccatcagcagagacaacagcagaaacaccctgtacctgcagatgaagagcctgagagccgaggacaccgccctgtactactgcgccaaggtgcagatccagcagctgaacttcggcgtgatcaccgacgccggcatggacgtgtggggcaagggcaccaccgtgatcgtgagcagcgccagcaccaagggc

SEQ ID NO: 35072 - RNA, 396 nt, synthetic construct
  misc_feature 1..396: note = derived and/or modified sequence opt4 from anti-HIV_Chain
  source 1..396: mol_type = other RNA
caggtgcagctggtggagagcggcggcggcgtggtgcagcccggcagaagcctgagactgagctgcgtgggcagcggcttcaccttcagcagcagcggcatgcactgggtgagacaggcccccggcaagggcctggagtgggtggccgtgatcagcagcgacggcagcgacgagtactacggcgacagcgtggagggcagattcaccatcagcagagacaacagcaagaacaccctgttcctgcagctggacagcctggaggccgaggacagcgccgtgtactactgcgccaagacccccccccactacgacgccctgaccggctaccccagcagcgtgctggagttctggggcctgggcaccctggtgaccgtgagcagcgccagcaccaagggc

SEQ ID NO: 35073 - RNA, 396 nt, synthetic construct
  misc_feature 1..396: note = derived and/or modified sequence opt4 from anti-HIV_Chain
  source 1..396: mol_type = other RNA
gaggtgcagctggtgcagagcggcgccgaggtgaagaagcccggcagcagcgtgaaggtgagctgcaaggccagcggcggcaccttcaccacctacgacatcagctgggtgagacaggcccccggccagggcctggagtggatcggcggcatcctgcccgacttcggcgcccccagctacgcccagaagttccaggacagagtgaccatcaccaccgacgagagcagcagaaccgcctacatggagctgaacagcctgagaagcgaggacaccgccatctactactgcgccagaggcagaggcgacgacttctggagcggcgagagccccagctggtacttcgactactggggccagggcacccaggtgaccgtgagcagcgccagcaccaagggc

SEQ ID NO: 35074 - RNA, 396 nt, synthetic construct
  misc_feature 1..396: note = derived and/or modified sequence opt4 from anti-HIV_Chain
  source 1..396: mol_type = other RNA
caggtgcagctgctgcagagcggcaccgaggtgaagaagcccggcagcagcgtgaaggtgagctgcagagccagcggctggaccctgggcaacagccccaacagcgccatcggctgggtgagacaggcccccggccagggcctggagtggatcggcagaatcatccccatcctggacgtgaccaactacgcccagaagttccagggcagagtgaccatcagcgccgacaagagcaccaacatcgcctacatggagatcagcagcctgggcagcgaggacaccgccttctactactgcgccagagtgatcaccggcatgaccagcccctggtacttctacatggacgtgtggggcgagggcaccaccgtgatcgtgagcagcgccagcaccaagggc

SEQ ID NO: 35075 - RNA, 396 nt, synthetic construct
  misc_feature 1..396: note = derived and/or modified sequence opt4 from anti-HIV_Chain
  source 1..396: mol_type = other RNA
caggtgcacctggtgcagagcggcgccgaggtgaagaagcccggcagcagcgtgagagtgagctgcaaggccagcggctggaccttcggcgacagcgtgaacagcgccatcacctgggtgagacaggcccccggccagggcctggagtggatgggcagattcatccccatcctgggcctgagcaactacgcccagaagttccaggacagagtgaccatcaacgtggacagaagcaccaacaccgcctacatggagctgagcggcctgagaagcgaggacaccgccgtgtactactgcgccagactgatcaccggcatgaacgccccctggttctactacatggacgtgtggggcaagggcaccaccatcaccgtgagcagcgccagcaccaagggc

SEQ ID NO: 35076 - RNA, 396 nt, synthetic construct
  misc_feature 1..396: note = derived and/or modified sequence opt4 from anti-HIV_Chain
  source 1..396: mol_type = other RNA
caggtgcacctggtgcagagcggcgccgaggccaagagacccggcagcagcgtgagagtgagctgcagagccagcggcggcgacttcagcagctacaccctgagctgggtgagacaggcccccggccagggcctggagagaatgggcggcgtggtgcccatgctggacaccgtgcactacgcccagaagttccagggcagactgaccctgagcgtggacgagggcaccagcaccgcctacatggagctgagcagcctgagaagcgaggacaccgccatgtactactgcaccagaggcagacagaccttcagagccatctggagcggcccccccgtggtgttcgacatctggggccagggcaccctggtgagcgtgagcagcgccagcaccaagggc

SEQ ID NO: 35077 - RNA, 396 nt, synthetic construct
  misc_feature 1..396: note = derived and/or modified sequence opt4 from anti-HIV_Chain
  source 1..396: mol_type = other RNA
caggtgcacctggtgcagagcggcgccgaggccaagagacccggcagcagcgtgagagtgagctgcagagccagcggcggcgacttcagcagctacaccctgagctgggtgagacaggcccccggccagggcatcgagtggatgggcggcgtggtgcccatgctggacaccgtgcactacgcccagaagttccagggcagactgaccctgagcgtggacgagggcaccagcaccgcctacatggagctgagcagcctgagaagcgaggacaccgccatgtactactgcaccagaggcagacagaccttcagagccatctggagcggcccccccgccgtgttcgacatctggggccagggcaccctggtgatcgtgagcagcgccagcaccaagggc

SEQ ID NO: 35078 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcgccgagctgaagaagcccggcagcagcgtgaaggtgagctgcaaggccagcggcggcaccttcaacaaccacaccttcaactgggtgagacaggcccccggccagggcctggagtggatgggcagaaccatccccatcctgggcagcagagactacgccaagaccttccaggacagagtgaccatcatcgccgacaagagcaccagcaccgtgtacctggagctgagaagactgaagagcgaggacaccggcgtgtactactgcgccaccagcatgtactacttcgacagcggcggctactacagaaacaccgacctggacaagtggggccagggcagcctggtgaccgtgagcagcgccagcaccaagggc

SEQ ID NO: 35079 - RNA, 396 nt, synthetic construct
  misc_feature 1..396: note = derived and/or modified sequence opt4 from anti-HIV_Chain
  source 1..396: mol_type = other RNA
caggtgtacctggtgcagagcggccccgagctgaagaagcccggcgccagcgtgaagatcagctgcaaggccagcggctacaacttccccaagtacgccatccactgggtgagacaggcccccggccagggcctgcagtggatgggctggatcaacggcgacaacggcgacgccagatacagccagaagctgcagggcagagtgacccccagcaccgacaccagcgccagcgtggtgtacatggagctgaagagactgagaagcgaggacaccgccgtgtactactgcgccagagccctgtacccctgggagatcggcggcgtgcccagcaccatgggcgacgactactggggccagggcaccctgatcaccgtgagcagcgccagcaccaagggc

SEQ ID NO: 35080 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggccccgagctgatgaagcccggcagcagcgtgaaggtgagctgcagagccagcggcgacaacttcctgaccagcaccttcaactggctgagacaggcccccggccagagactggagtggatgggcagattcatccccagcctgggcctgatcaccagcgcccccaagttcagcgacagactgaccatcaccgccgaccaggccaccctgaccgcctacatggagctgaccggcctgaccagcgaggacaccgccctgtactactgcgccagaggcctgtgcagaggcggcaactgcagactgggccccagcggctggctggacccctggggcagaggcacccaggtgaccgtgagcagcgccagcaccaagggc

SEQ ID NO: 35081 - RNA, 396 nt, synthetic construct
  misc_feature 1..396: note = derived and/or modified sequence opt4 from anti-HIV_Chain
  source 1..396: mol_type = other RNA
ggcgtgcacttccagggccacctggtgcagagcggcggcggcgtgaagaagcccggcagcagcgtgaccatcagctgcctggccagcgagtacaccttcaccgagttcaccatccactggatcagacaggcccccggccagggccccctgtggctgggcctgatcaagagaagcggcagactgatgaccagctacagattccaggacagactgagcctgagaagagacagaagcaccggcaccgtgttcatggagctgagaggcctgagaatcgacgacaccgccgtgtactactgcgccagagacggcctgggcgaggtggcccccgcctacctgtacggcatcgacgtgtggggccagggcagcaccgtgatcgtgaccagcgccagcaccagc

SEQ ID NO: 35082 - RNA, 396 nt, synthetic construct
  misc_feature 1..396: note = derived and/or modified sequence opt4 from anti-HIV_Chain
  source 1..396: mol_type = other RNA
caggtgcagctgctgcagagcggcgccgaggtgaagaagcccggcgccagcgtgaaggtgagctgcaaggtgagcggctacaccctgaccgagctgagcatccactgggtgagacaggcccccggcaagggcctggagtggatgggcggcttcgaccccgaggacgacgaggccatctacgagcccaagttccagggcagactgaccatgaccgaggacaccagcaccgacaccgcctacatggagctgagcagcctgagaagcgaggacaccgccgtgtactactgcgccaccgccgaccccttcaaggtggcccaggacgagggcctgtacgtgatcttcgactactggggccagggcaccctggtgaccgtgagcagcgccagcaccaagggc

SEQ ID NO: 35083 - RNA, 396 nt, synthetic construct
  misc_feature 1..396: note = derived and/or modified sequence opt4 from anti-HIV_Chain
  source 1..396: mol_type = other RNA
caggtgcagctggtgcagagcggcgccgaggtgaagaagcccggcgccagcgtgaaggtgagctgcaaggtgagcggctacaccctgaccgagctgagcatccactgggtgagacaggcccccggcaagggcctggagtggatgggcggcttcgaccccgaggacggcgaggccagcttcgagcccaagttccagggcagactgaccatgaccgaggacaccagcaccgacaccgcctacatggagctgagcagcctgagaagcgaggacaccgccgtgtactactgcgccaccgccgaccccttcaaggtggcccaggacgagggcctgtacgtgatcttcgactactggggccagggcaccctggtgaccgtgagcagcgccagcaccaagggc

SEQ ID NO: 35084 - RNA, 396 nt, synthetic construct
  misc_feature 1..396: note = derived and/or modified sequence opt4 from anti-HIV_Chain
  source 1..396: mol_type = other RNA
ggcgtgcacttccagggccacctggtgcagagcggcggcggcgtgaagaagcccggcagcagcgtgaccatcagctgcctggccagcgagtacaccttcaccgagttcaccatccactggatcagacaggcccccggccagggccccctgtggctgggcctgatcaagagaagcggcagactgatgaccagctacagattccaggacagactgagcctgagaagagacagaagcaccggcaccgtgttcatggagctgagaggcctgagaatcgacgacaccgccgtgtactactgcgccagagacggcctgggcgaggtggcccccgcctacctgtacggcatcgacgtgtggggccagggcaccaccgtgatcgtgaccagcgccagcaccagc

SEQ ID NO: 35085 - RNA, 396 nt, synthetic construct
  misc_feature 1..396: note = derived and/or modified sequence opt4 from anti-HIV_Chain
  source 1..396: mol_type = other RNA
caggtgcagctgggcgagagcggcggcggcctggtggagcccggcggcagcctgagactgagctgcgccgccagcggcttcctgttcagcgactaccagatgagctggatcagactggcccccggcaagggcctggagtggatcagcttcatcagcggcttcggcagcgtgtactacgccgacagcgtggagggcagattcaccatcagcagagacaacgccagaaacagcctgtacctgcagatgaacaacctgagagccgaggacaccgccgtgtactactgcgccagagcctacggcaccggcaactggagaggcctgtactactactactacggcatggacgtgtggggccacggcaccaccgtgaccgtgagcagcgccagcaccaagggc

SEQ ID NO: 35086 - RNA, 399 nt, synthetic construct
  misc_feature 1..399: note = derived and/or modified sequence opt4 from anti-HIV_Chain
  source 1..399: mol_type = other RNA
caggtgcagctggtgcagagcggcaccgccctgaagagccccggcagcagcgccaagctgagctgcaccgtgctgggcgacgagttcggcacctacttcatcagctggatcagacaggcccccggccagggcctggagtgggtgggcggcatcgtgccccacagccagctgcagagcagcgcccagaagttccacggcagaatcatcatcagcgccggcgccggcgtgaccccccccgtggtgagcctgcagctgaccaacctgaccttcgaggacaccggcacctacttctgcgccagagagagaggcagacacagagaccccaagaccggcgacgccctgagaggcagatacttcgacttctggggcagaggcaccggcctgagagtgagcaccagc

SEQ ID NO: 35087 - RNA, 399 nt, synthetic construct
  misc_feature 1..399: note = derived and/or modified sequence opt4 from anti-HIV_Chain
  source 1..399: mol_type = other RNA
gaggtgcagctggtgcagagcggcggcggcctggtgaagcccggcggcagcctgagactgagctgcgccgccagcggcttcaccttcaagaacgcctggatgagctgggtgagacaggcccccggcaagggcctggagtgggtgggccacatcaagagcaagaccgacggcggcaccatcgactacgccgcccccgtgaagggcagattcaccatcagcagagacgacagcaagaacaccctgtacctgcagatgaacagcctgaagatcgaggacaccgccgtgtactactgcaccaccgacatcggcagcggcagaggctgggacttccactactacgacagcaacgactggggccagggcaccctggtgaccgtgagcagcgccagcaccaagggc

SEQ ID NO: 35088 - RNA, 399 nt, synthetic construct
  misc_feature 1..399: note = derived and/or modified sequence opt4 from anti-HIV_Chain
  source 1..399: mol_type = other RNA
caggtgcagctggtggagagcggcggcggcgtggtgcagcccggcagaagcctgagactgttctgcgccgccagcggcttcgccttcaacacctacggcatgcactgggtgagacaggcccccggcaagggcctggagtgggtggccgtgacctggcacgacggcagccagaagtactacgccgacagcgtgaagggcagattcaccatcagcagagacaacagcaagaacaccctgtacctgcagatgaacagcctgagagccgaggacaccgccatctactactgcgccagcgaccagggcggcttcgacgacagcagcggctacttcgcccccggcggcatggacgtgtggggcagaggcaccaccgtgatcgtgagcagcgcccccaccaagggc

SEQ ID NO: 35089 - RNA, 399 nt, synthetic construct
  misc_feature 1..399: note = derived and/or modified sequence opt4 from anti-HIV_Chain
  source 1..399: mol_type = other RNA
ggctacagcgaggtgcagctggtgcagagcggccccggcctggtgaagcccagccagaccctgagcctgacctgcaccgtgagcggcggcagcatcagcaacggcggccactactggaactggatcagacagcaccccggcaagggcctggagtggatcggccacatctacaacatcgccaccacctactacaaccccagcctgaagagcagagtgagcatcagcgtggacaccagcaagaaccagttcagcctgaagctgagcagcgtgaccgccgccgacaccgccgtgtactactgcgccagaggcagcggcagatggaccatcggcgccagaatctacttcgacaactggggccagggcgccctggtggccgtgagcagcgccagcaccaagggc

SEQ ID NO: 35090 - RNA, 399 nt, synthetic construct
  misc_feature 1..399: note = derived and/or modified sequence opt4 from anti-HIV_Chain
  source 1..399: mol_type = other RNA
cagctgcagctgaaggagagcggccccggcatggtgaagcccagcgagaccctgagcctgacctgcagcgtgagcggcgccagcgtggtgagcgccaacgactactggggctggatcagacaggcccccggcaagggcctggagtgcatcggcatcatcctgtacaccggcagcaccttctacaaccccagcctgcagagcagagtgaccatcagcagagaccccagcaagaaccacgtgagcctgaccctgaccagcgtgaccgccgccgacagcgccgtgtactactgcgccagaatcccctaccacagcgagagctactacaacgtggtgatcggcggcttcgacgtgtggggccagggcaccagagtgaccgtgagcagcgccagcaccaagggc

SEQ ID NO: 35091 - RNA, 399 nt, synthetic construct
  misc_feature 1..399: note = derived and/or modified sequence opt4 from anti-HIV_Chain
  source 1..399: mol_type = other RNA
tgccaggtgcagctggtggagagcggcggcggcgtggtgcagcccggcagaagcctgagactgagctgcgtgggcagcggcttcaccttcagcagcagcggcatgcactgggtgagacaggcccccggcaagggcctggagtgggtggccgtgatcagcagcgacggcagcgacgagtactacggcgacagcgtggagggcagattcaccatcagcagagacaacagcaagaacaccctgttcctgcagctggacagcctggaggccgaggacagcgccgtgtactactgcgccaagacccccccccactacgacgccctgaccggctaccccagcagcgtgctggagttctggggcctgggcaccctggtgaccgtgagcagcgccagcaccaagggc

SEQ ID NO: 35092 - RNA, 399 nt, synthetic construct
  misc_feature 1..399: note = derived and/or modified sequence opt4 from anti-HIV_Chain
  source 1..399: mol_type = other RNA
caggtgcagctggtgcagagcggcgccgacgtgaagaagcccggcgccagcgtgaaggtgagctgcaaggtgagcggctacaccgtgagcgagctgagcatccactgggtgagacaggcccccggcaagggcctggagtggatgggcggcttcgaccccgaggacggcaagaccgtgagcgcccagaacttccagggcagagtgaccatgaccgaggacaagagcaccggcaccgccaacatggagctgagaagcctgagaagcgaggacaccgccgtgtactactgcgccaccaccgtgcagctgatcgtggacttctgcaacggcggcccctgctacaacttcgacgactggggccagggcaccctggtgaccgtgagcagcgccagcaccaagggc

SEQ ID NO: 35093 - RNA, 399 nt, synthetic construct
  misc_feature 1..399: note = derived and/or modified sequence opt4 from anti-HIV_Chain
  source 1..399: mol_type = other RNA
ggcctggacctggagcacgacggccaccacaaggaggagcccagagccagcgtgaccgtgagctgcgaggccagcggctacaacttcgtgaactacatcatccactgggtgagactgacccccggcagaggcttcgagtggatgggcatgatcgaccccagaagaggcagaccctggagcgcccagaagttccagggcagactgaccctgaccagagacatcgacagcgagagactgtacatgcagctgagcggcctgagaggcgacgacaccgccgtgtacttctgcgccagacaggagcccgacttccacgacggccacggccacaccctgagaggcatgttcgacagctggggccagggcagccccgtgagcgtgagcagcgccagcaccaagggc

SEQ ID NO: 35094 - RNA, 399 nt, synthetic construct
  misc_feature 1..399: note = derived and/or modified sequence opt4 from anti-HIV_Chain
  source 1..399: mol_type = other RNA
caggtgagactggtgcagagcggcgcccagctgaagaagcccggcgccagcgtgaccgtgagctgcgaggccagcggctacaacttcgtgaactacatcatcaactgggtgagacagacccccggcagaagcttcgagtgggtgggcatgatcgaccccagaagaggcagaccctggagcgcccagaagttccagggcagactgaccctgaccagagacatcgacagcgagaagctgtacatgcacctgagcggcctgagaggcgacgacaccgccgtgtactactgcgccagacaggacagcgacttccacgacggccacggccacaccctgagaggcatgttcgacagctggggccagggcagccccgtgaccgtgagcagcgccagcaccaagggc

SEQ ID NO: 35095 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccgtggtgaagaccggcgccagcgtgaccatcagctgcgagaccgagggctacaccttcgtgaactacatcatccactgggtgagacagccccccggcagaggcttcgagtggctgggcatgatcgaccccagaaacggccacccctggttcggccagagattcagaggcagactgagcctgagaagagacagaagcaccgagaccgtgttcatgaccctgagcggcctgaccagcgacgacaacggcatctacttctgcgccagaaacgagccccagtactacgacggcagcggccacagcctgcccggcatgttcgactactggggccagggcaccagagtggtggtgagcagcgccagcaccaagggc

SEQ ID NO: 35096 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccgtgatgaagaccggcgccagcgtgaccatcagctgcgagaccgagggctacaacttcgtgaactacatcatccactgggtgagaagaccccccggcagaggcttcgagtggctgggcatgatcgaccccaagaacggccacccctggttcgcccaggccgtgagaggcagactgagcctgagaagagacaccttcaacgaggtggtgtacatgaccctgagcggcctgaccagcgacgacaccggcctgtacttctgcgccagaaacgagccccagtaccacgacggcaacggccacagcctgcccggcatgttcgacttctggggccagggcaccctggtgaccgtgagcagcgccagcaccaagggc

SEQ ID NO: 35097 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccgtggtgaagaccggcgccagcgtgaccatcagctgcgagaccgagggctacaccttcgtgaactacatcatccactgggtgagacagccccccggcagaggcttcgagtggctgggcatgatcgaccccagaaacggccacccctggttcggccagagactgcagggcagactgagcctgagaagagacagaagcaccgagaccgtgttcatgaccctgagcggcctgaccagcgacgacaccggcatctacttctgcgccagaaacgagccccagtactacgacggcagcggccacagcctgcccggcatgttcgactactggggccagggcaccagagtggtggtgagcagcgccagcaccaagggc

SEQ ID NO: 35098 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccgtggtgaagaccggcgccagcgtgaccatcagctgcgagaccgagggctacaccttcgtgaaccacatcatccactgggtgagacagccccccggcagaggcttcgagtggctgggcatgatcgaccccagaaacggccacccctggttcggccagagactgagaggcagactgagcctgagaagagacagaagcaccgagaccgtgttcatgaccctgagcggcctgaccagcgacgacatcggcatctacttctgcgccagaaacgagccccagtacttcgacggcagcggccacagcctgcccggcatgttcgactactggggccagggcaccagagtggtggtgagcagcgccagcaccaagggc

SEQ ID NO: 35099 - RNA, 399 nt, synthetic construct
  misc_feature 1..399: note = derived and/or modified sequence opt4 from anti-HIV_Chain
  source 1..399: mol_type = other RNA
caggtgcagttcttccagagcggcagcagcatgaagaagagcggcgccagcgtgaccatcagctgcgaggccaccggctacaacatcaagaaccacatcctgcactgggtgagacagaagcccggcagaggcttcgagtgggtgggcatgatcgaccccatcaacggcagaccctggttcggccaggccttcagaggcagactgaccctgaccagagacctgagcaccgagaccttctacatgagcctgagcggcctgaccagcgacgacaccgccacctacttctgcgccagaagagaggccgactaccacgacggcaacggccacaccctgcccggcatgttcgacttctggggccccggcaccctggtgaccgtgagcagcgccagcaccaagggc

SEQ ID NO: 35100 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccgtggtgaagaccggcgccagcgtgaccatcagctgcgagaccgagggctacaccttcgtgaactacatcatccactgggtgagacagagccccggcagaggcttcgagtggctgggcatgatcgaccccagaaacggccacccctggttcggccagagactgagaggcagactgagcctgagaagagacagaagcaccgagaccgtgttcatgaccctgagcggcctgaccagcgacgacaccgccatctacttctgcgccagaaacgagccccagtactacgacggcagcggccacagcctgcccggcatgttcgactactggggccagggcaccagagtggtggtgagcagcgccagcaccaagggc

SEQ ID NO: 35101 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccatgaagaagcccggcgccagcgtgaccatcagctgcgagaccgagggctacaccttcatcaactacatcatccactgggtgagacagccccccggcagaggcttcgagtggctgggcatgatcgaccccagaaacggcagaccctggttcggccagagcgtgcagggcagactgagcctgagaagagacacctacaccgaggtggtgtacatgaccctgagcggcctgaccagcgacgacgccggcctgtacttctgcgccagaaacgagccccagtaccacgacggcaacggccacagcctgcccggcatgttcgactactggggccagggcaccctggtggccgtgagcagcgccagcaccaagggc

SEQ ID NO: 35102 - RNA, 399 nt, synthetic construct
  misc_feature 1..399: note = derived and/or modified sequence opt4 from anti-HIV_Chain
  source 1..399: mol_type = other RNA
caggtgagactggtgcagagcggcgcccagctgaagaagcccggcgccagcgtgaccgtgagctgcgaggccagcggctacaacttcgtgaactacatcatcaactgggtgagacagacccccggcagaggcttcgagtgggtgggcatgatcgaccccagaagaggcagaccctggagcgcccagaagttccagggcagactgaccctgaccagagacatcgacagcgagaagctgtacatgcacctgagcggcctgagaggcgacgacaccgccgtgtactactgcgccagacaggacagcgacttccacgacggccacggccacaccctgagaggcatgttcgacagctggggccagggcagccccgtgaccgtgagcagcgccagcaccaagggc

SEQ ID NO: 35103 - RNA, 399 nt, synthetic construct
  misc_feature 1..399: note = derived and/or modified sequence opt4 from anti-HIV_Chain
  source 1..399: mol_type = other RNA
caggtgcacaccttccagagcggcagcagcatgaagaagagcggcgccagcgtgaccatcagctgcgaggccaccggctacaacatcaagaactacatcctgcactgggtgagacagaagcccggcagaggcttcgagtgggtgggcatgatcgaccccatcaacggcagaccctggttcggccagcccttcagaggcagactgaccctgaccagagacctgagcaccgagaccttctacatgagcctgagcggcctgaccagcgacgacaccgccacctacttctgcgccagaagagaggccgactaccacgacggcaacggccacaccctgcccggcatgttcgacttctggggccccggcaccctgatcaccgtgagcagcgccagcaccaagggc

SEQ ID NO: 35104 - RNA, 399 nt, synthetic construct
  misc_feature 1..399: note = derived and/or modified sequence opt4 from anti-HIV_Chain
  source 1..399: mol_type = other RNA
caggtgagactgttccagagcggcgccgccatgaagaagcccggcgccagcgtgaccatcagctgcgaggccagcggctacaacttcatgaactacttcgtgcactgggtgagacagagacccggcagaggcttcgagtggctgggcatgatcaaccccagaggcggcagaccctggagcgcccagagcgtgcagggcagactgaccctgaccagagacatcagcaccgagatgttctacatgagactggacggcctgagaagcgacgacaccgccacctacttctgcgccagaaacgaggccgactaccacgacggcaacggccacagcctgagaggcatgttcgactactggggccagggcagcctgatcaccgtgagcagcgccagcaccaagggc

SEQ ID NO: 35105 - RNA, 399 nt, synthetic construct
  misc_feature 1..399: note = derived and/or modified sequence opt4 from anti-HIV_Chain
  source 1..399: mol_type = other RNA
caggtgcagctgttccagagcggcgccgccatgagaaagcccggcgccagcgtgaccatcagctgcgaggccagcggctacaacttcatgaactacttcgtgcactgggtgagacagagacccggcagaggcttcgagtggctgggcatgatcaaccccagaggcggcagaccctggagcgcccagagcgtgcagggcagactgaccctgaccagagacaccagcaccgagatgttctacatgagactggacggcctgagaagcgacgacaccgccacctacttctgcgccagaaacgaggccgactaccacgacggcaacggccacagcctgagaggcatgttcgactactggggccagggcagcctgatcaccgtgagcagcgccagcaccaagggc

SEQ ID NO: 35106 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccatcaagaagcccggcgccagcgtgaccatcagctgcgagaccgagggctacaccttcatcaactacatcatccactgggtgagacagccccccggcagaggcttcgagtggctgggcatgatcgaccccagaaacggcagaccctggttcggccagagcgtgcagggcagactgagcctgagaagagacacctacaccgaggtggtgtacatgaccctgagcggcctgaccagcgacgacaccggcctgtacttctgcgccagaaacgagccccagtaccacgacggcaacggccacagcctgcccggcatgttcgacagctggggccagggcaccctggtggccgtgagcagcgccagcaccaagggc

SEQ ID NO: 35107 - RNA, 399 nt, synthetic construct
  misc_feature 1..399: note = derived and/or modified sequence opt4 from anti-HIV_Chain
  source 1..399: mol_type = other RNA
caggtgagactgttccagagcggcgccgccatgagaaagcccggcgccagcgtgaccatcagctgcgaggccagcggctacaacttcctgaactacttcgtgcactgggtgagacagagacccggcagaggcttcgagtggctgggcatgatcaaccccagaggcggcagaccctggagcgcccagagcgtgcagggcagactgaccctgaccagagacaccagcaccgagatgttctacatgagactggacggcctgagaagcgacgacaccgccacctacttctgcgccagaaacgaggccgactaccacgacggcaacggccacagcctgagaggcatgttcgactactggggccagggcagcctgatcaccgtgagcagcgccagcaccaagggc

SEQ ID NO: 35108 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccgtgaagaagcccggcgccagcgtgaccatcgtgtgcgagaccgagggctacaacttcatcgactacatcatccactgggtgagacagccccccggcagaggcttcgagtggctgggcatgatcgaccccagaaacggcagaccctggagcggccagaaggtgcacggcagactgagcctgtggagagacaccagcaccgagaaggtgtacatgaccctgaccggcctgaccagcgacgacaccggcctgtacttctgcggcagaaacgagccccagtaccacgacgacaacggccacagcctgcccggcatgatcgactactggggccagggcaccatggtgaccgtgagcagcgccagcaccaagggc

SEQ ID NO: 35109 - RNA, 399 nt, synthetic construct
  misc_feature 1..399: note = derived and/or modified sequence opt4 from anti-HIV_Chain
  source 1..399: mol_type = other RNA
caggtgagactgagccagagcggcgccgccatcaagaagcccggcgccagcgtgaccatcagctgcgagaccgagggctacaccttcatcaactacatcatccactgggtgagacagccccccggcagaggcttcgagtggctgggcatgatcgaccccagaaacggcagaccctggttcggccagagcgtgcagggcagactgagcctgagaagagacacctacaccgaggtggtgtacatgaccctgagcggcctgaccagcgacgacgccggccactacttctgcgccagaaacgagccccagtaccacgacggcaacggccacagcctgcccggcatgttcgactactggggccagggcaccctggtggccgtgagcagcgccagcaccaagggc

SEQ ID NO: 35110 - RNA, 399 nt, synthetic construct
  misc_feature 1..399: note = derived and/or modified sequence opt4 from anti-HIV_Chain
  source 1..399: mol_type = other RNA
caggtgagactgttccagagcggcgccgccatgagaaagcccggcgccagcgtgaccatcagctgcgaggccagcggctacaacttcatgaactacttcgtgcactgggtgagacagagacccggcagaggcttcgagtggctgggcatgatcaaccccagaggcggcagaccctggagcgcccagagcgtgcagggcagactgaccctgaccagagacaccagcaccgagatgttctacatgagactggacggcctgagaagcgacgacaccgccacctacttctgcgccagaaacgaggccgactaccacgacggcaacggccacagcctgagaggcatgttcgactactggggccagggcagcctgatcaccgtgagcagcgccagcaccaagggc

SEQ ID NO: 35111 - RNA, 399 nt, synthetic construct
  misc_feature 1..399: note = derived and/or modified sequence opt4 from anti-HIV_LightChain
  source 1..399: mol_type = other RNA
atgaagctgcccgtgagactgctggtgctgatgttctggatccccgccagcagcagcgacatcgtgatgacccagagccccctgagcctgcccgtgacccccggcgagcccgccagcatcagctgcagaagcagccagagactgctgagcagctacggccacacctacctgcactggtacctgcagaagcccggccagagcccccagctgctgatctacgaggtgagcaacagattcagcggcgtgcccgacagattcagcggcagcggcagcggcaccgacttcaccctgaagatcagcagagtggaggccgaggacgtgggcgtgtactactgcagccagagcacccacgtgcccctgaccttcggccagggcaccaaggtggagatcaagagaaag

SEQ ID NO: 35112 - RNA, 402 nt, synthetic construct
  misc_feature 1..402: note = derived and/or modified sequence opt4 from anti-HIV_Chain
  source 1..402: mol_type = other RNA
cagccctacatcgtgcagagcggccccgccgtgaagggcgccggcagcagcgtgaccgtgacctgcaaggtggacggcgacgacgacggcatcttcagcttcggcacctacttcatggtgtgggtgagacaggcccccggccagggcctgcagtacatgggcggcctggtgcccagctacgcccccacctacgcccacaagttcgagggcagaatcaccatcagcgccgccggcaccccccccgtggtgagcctgaccctgctgaacctgaccaacgacgacgccgccacctacttctgcgccagagagagaggcagacactacgacagcaagaccagagagaacagaagaggcagatacttcgacatgtggggcagaggcaccagaatcaccgtgagcccc

SEQ ID NO: 35113 - RNA, 402 nt, synthetic construct
  misc_feature 1..402: note = derived and/or modified sequence opt4 from anti-HIV_Chain
  source 1..402: mol_type = other RNA
cagccctacatcgtgcagagcggccccgccgtgaagggcgccggcagcagcgtgaccgtgacctgcagagtggacggcgacgacgacggcatcttcaacttcggcacctacttcatggtgtgggtgagacaggcccccggccagggcctgcagtacatgggcggcctggtgcccagctacgcccccacctacgcccacaagttcgagggcagaatcaccatcagcgccgccggcaccccccccgtggtgagcctgaccctgatcaacctgaccaacgccgacgccgccacctacttctgcgccagagagagaggcagacactacgacagcaagaccagagagaacagaagaggcagatacttcgacatgtggggcagaggcaccagaatcaccgtgagcccc

SEQ ID NO: 35114 - RNA, 402 nt, synthetic construct
  misc_feature 1..402: note = derived and/or modified sequence opt4 from anti-HIV_Chain
  source 1..402: mol_type = other RNA
agagtgcacagccaggtgcagctggtggagagcggccccggcctggtgaagcccagccagaccctgagcctgacctgcaccgtgagcggcggcagcatcagcaacggcggccactactggaactggatcagacagcaccccggcaagggcctggagtggatcggccacatctacaacatcgccaccacctactacaaccccagcctgaagagcagagtgagcatcagcgtggacaccagcaagaaccagttcagcctgaagctgagcagcgtgaccgccgccgacaccgccgtgtactactgcgccagaggcagcggcagatggaccatcggcgccagaatctacttcgacaactggggccagggcgccctggtggccgtgagcagcgccagcaccaagggc

SEQ ID NO: 35115 - RNA, 402 nt, synthetic construct
  misc_feature 1..402: note = derived and/or modified sequence opt4 from anti-HIV_Chain
  source 1..402: mol_type = other RNA
agcgtggacgagagactgctggagttcggcggcagactggtgcagcccggcggcagcctgagactgagctgcagcgccagcggcttcaccttcagcaacagcgccatgagctgggtgagacaggcccccggcaagggcctggagtgggtgagcagcatcctgagcagcggcgtgggcaccttctacgccgacagcgtgaagggcagattcaccgtgagcagagacaacagcagaaacaccctgtacctgcagatgaagagcctgagagccgaggacaccgccctgtactactgcgccaaggtgcagatccagcagctgaacttcggcgtgatcaccgacgccggcctggacgtgtggggcaagggcaccaccctgatcgtgagcagcgccagcaccaagggc

SEQ ID NO: 35116 - RNA, 402 nt, synthetic construct
  misc_feature 1..402: note = derived and/or modified sequence opt4 from anti-HIV_Chain
  source 1..402: mol_type = other RNA
gtgcagagccaggtgtacctggtgcagagcggcggcgaggtgaagaagcccggcagcagcgtgaaggtgagctgcaaggccagcggcgacagcttcagcagcagcgtgatcacctgggtgagacaggcccccggccagggccccgagtggatgggcagaatcatccccgtgctgggcgtggccgcctacgcccagaacttctacggcagagtgaccatcagcgccgacaccagcagcaacaccgcctacatggagctgagcagcctgagattcgaggacaccgccgtgttctactgcgccagagagaccggcagaggcggcaacctggccctgagacagtacttcttcgacagctggggccagggcaccctggtgaccgtgagcagccccagcaccaagggc

SEQ ID NO: 35117 - RNA, 402 nt, synthetic construct
  misc_feature 1..402: note = derived and/or modified sequence opt4 from anti-HIV_Chain
  source 1..402: mol_type = other RNA
cagctgcagctgcaggagagcggccccggcctggtgaagcccagcgagaccctgagcctgacctgcagcgtgagcgacggcagcatcaacagcaacagctactactgggcctggatcagacagagccccggcaagggcctggagtggatcggcagcgtgtactacttcggcggcacctactacagccccagcctgaagagcagagtgaccatgagcgtggacagaagcaagaaccagttcagcctgaacgtgagcagcgtgaccgccgccgacaccgccatctactactgcgccagacacgtgagaccctacgacagaagcggctaccccgagagacccaactggttcgacccctggggcagaggcaccctggtgaccgtgagcagcgccagcaccaagggc

SEQ ID NO: 35118 - RNA, 402 nt, synthetic construct
  misc_feature 1..402: note = derived and/or modified sequence opt4 from anti-HIV_Chain
  source 1..402: mol_type = other RNA
caggtgcagctgcaccagtggggcgccggcctgctgaagcccagcgacaccctgagcctgacctgcggcatcctgggcgtgagcccccccggcagcctgaccggctactactggacctggatcagacagccccccggcaagggcctggagtggatcggcgaggtgtaccacagcggcagcaccaactacaaccccagcctggccagcagagtgaccatcagcatgggcaccaccaagacccagttcagcctgagactgaccagcgtgaccgccgccgacagcgccgtgtactactgcgccagcggcaaggtgtggggcatcaccgccagacccagagacgccggcctggacgtgtggggccagggcaccaccgtgaccgtgaccagcgccagcaccaagggc

SEQ ID NO: 35119 - RNA, 402 nt, synthetic construct
  misc_feature 1..402: note = derived and/or modified sequence opt4 from anti-HIV_Chain
  source 1..402: mol_type = other RNA
caggtgcagctggtgcagagcggcgccgaggtgaagaagcccggcagcagcgtgaaggtgagctgcagagccagcggcggcagcttcggcaactacgccatcaactgggtgagacaggcccccatgcagggcctggagtggatgggcggcatcatccccatcttcggcaccaccaactacgcccagaacttcagaggcagagtgaccatcaacgccgacaccttcaccaacaccgtgaacatggacctgagcagcctgagaagcgaggacaccgccgtgtactactgcggcagaagcatcaacgccgccgtgcccggcctggagggcgtgtactactactacggcatggccgtgtggggccagggcaccaccgtgaccgtgagcagcgccagcaccaagggc

SEQ ID NO: 35120 - RNA, 402 nt, synthetic construct
  misc_feature 1..402: note = derived and/or modified sequence opt4 from anti-HIV_Chain
  source 1..402: mol_type = other RNA
ttcgtgcagctggtggagagcggcggcggcctggtgcagcccggcggcagcctgagactgagctgcgccgccagcggcttcaacttcaacacctactggatgaactgggtgagacaggcccccggcaagggcctggagtgggtggccaacatgaaggaggacggcagcgagaagtactacgtggacagcgtgaagggcagattcaccatcagcagagacaacgccaagaacagcctgtacctgcagatgaacagcctgagagccgaggacaccgccgtgtactactgcgccagaaaccccgagagcagatgcatcgtgggcagaaacagaggctggtgcagatacttcgacctgtggggcagaggcagcctggtgaccgtgagccccgccagcaccaagggc

SEQ ID NO: 35121 - RNA, 405 nt, synthetic construct
  misc_feature 1..405: note = derived and/or modified sequence opt4 from anti-HIV_Chain
  source 1..405: mol_type = other RNA
cagctgcagctggaccagcccggcgccgccatgaagagcctgggcagcagcctgaccatcacctgcagagtgagcggcgacgacctgggcagcttccacttcggcacctacttcatgatctgggtgagacagggccccggccagggcctggagtacatgggcggcatcctgcccagcaccaagacccccacctacgcccacaagttcagaggcagagtgagcatcagcgcccccggcgtgccccccgtgctgagcctggccctgaccaacctgacctacgacgacaccgccacctacttctgcgccagagagagaggcagacacttcgagcccaagaacagagaccacctggagggcaagttcctggacctgtggggcagaggcaccttcgtgagagtgagcccc

SEQ ID NO: 35122 - RNA, 405 nt, synthetic construct
  misc_feature 1..405: note = derived and/or modified sequence opt4 from anti-HIV_Chain
  source 1..405: mol_type = other RNA
caggtgcagctggtgcagcccggcaccgccatgaagagcctgggcagcagcctgaccatcacctgcagagtgagcggcgacgacctgggcagcttccacttcggcacctacttcatgatctgggtgagacaggcccccggccagggcctggagtacatgggcggcatcctgcccagcaccaagacccccacctacgcccacaagttcagaggcagagtgagcatcagcgcccccggcgtgccccccgtgctgagcctggccctgaccaacctgacctacgacgacaccgccacctacttctgcgccagagagagaggcagacacttcgagcccaagaacagagacaacctggagggcaagttcttcgacctgtggggcagaggcaccttcgtgagagtgagcccc

SEQ ID NO: 35123 - RNA, 405 nt, synthetic construct
  misc_feature 1..405: note = derived and/or modified sequence opt4 from anti-HIV_Chain
  source 1..405: mol_type = other RNA
caggtgcagctggtgcagcccggcaccgccatgaagaccctgggcagcagcctgaccatcagctgcagagtgagcggcgacgacggcaacttccacttcggcacctacttcatggcctgggtgagacaggtgcccggccagggcctggagtacatgggcggcatcctgcccagcaccaagagccccacctacgcccacaagttcagaggcagagtgagcatcagcaccgccggcgtgccccccgtggtgagcctggccctgaccaacctgacctacgacgacaccgccacctacttctgcgccagagagagaggcagacactacgacagcaagaagcaggagaactacagaggcaagttcttcgacctgtggggcagaggcacctgggtgagagtgagccccacc

SEQ ID NO: 35124 - RNA, 405 nt, synthetic construct
  misc_feature 1..405: note = derived and/or modified sequence opt4 from anti-HIV_Chain
  source 1..405: mol_type = other RNA
cacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacctgaccagcgacgacaccgccgtgtacttctgcaccaccaccagcacctacgaccagtggagcggcctgcaccacgacggcgtgatggccttcagcagctggggccagggcaccctgatcagcgtgagcgccgccagcaccaagggc

SEQ ID NO: 35125 - RNA, 405 nt, synthetic construct
  misc_feature 1..405: note = derived and/or modified sequence opt4 from anti-HIV_Chain
  source 1..405: mol_type = other RNA
caggtgcagctggtgcagagcggcgccgaggtgaagaagcccggcagcagcgtgaaggtgagctgcaaggccagcggcggcaccttcagcacctacgccttcagctgggtgagacaggcccccatcgagggcctggagtggatgggcggcatcatccccatcttcggcaccgagaactacgcccagaagttccagggcagagtgaccatcaccgccgacaagagcaccagcaccgcctacatggagctgagcagcctgagaagcgaggacaccgccgtgtactactgcgccagagacagaagcagcgccatcggctactgcagcagcatcagctgctacaagggcagcttcgacatctggggccagggcaccatggtgaccgtgagcagcgccagcaccaagggc

SEQ ID NO: 35126 - RNA, 405 nt, synthetic construct
  misc_feature 1..405: note = derived and/or modified sequence opt4 from anti-HIV_Chain
  source 1..405: mol_type = other RNA
caggtgcagctggtgcagagcggcgccgaggtgaagaagcccggcagcagcgtgaaggtgagctgcaaggccagcggcggcaccttcagcacctacgccttcagctgggtgagacaggcccccggccagggcctggagtggatgggcggcatcatccccatcttcggcaccgagaactacgcccagaagttccagggcagagtgaccatcaccgccgacaagagcaccagcaccgcctacatggagctgagcagcctgagaagcgaggacaccgccgtgtactactgcgccagagacagaagcagcgccatcggctactgcagcagcatcagctgctacaagggcagcttcgacatctggggccagggcaccatggtgaccgtgagcagcgccagcaccaagggc

SEQ ID NO: 35127 - RNA, 405 nt, synthetic construct
  misc_feature 1..405: note = derived and/or modified sequence opt4 from anti-HIV_Chain
  source 1..405: mol_type = other RNA
gaggtgcagctggtggagagcggcggcggcctggtgcagcccggcggcagcctgagactgagctgcgccgccagcggcttcaccttcagcagctacagcatgaactgggtgagacaggcccccggcaagggcctggagtgggtgagctacatcagcggcagcagctacaccatctactacgccgacagcgtgagaggcagattcaccatcagcagagacaacgccaagaacagcctgtacctgcagatgaacagcctgagagacgaggacaccgccgtgtacttctgcgccagagccaccccccccaaccccctgaacctgtacaactacgacagcagcggcagcagcttcgactactggggccagggcaccctggtgaccgtgagcagcgccagcaccaagggc

SEQ ID NO: 35128 - RNA, 405 nt, synthetic construct
  misc_feature 1..405: note = derived and/or modified sequence opt4 from anti-HIV_Chain
  source 1..405: mol_type = other RNA
gaggtgcagctggtgcagagcggcgccgaggtgaagaagcccggcagcagcgtgaaggtgagctgcaaggccagcggcggcaccttcagcacctacgccttcagctgggtgagacaggcccccggccagggcctggagtggatgggcggcatcatccccatcttcggcaccgagaactacgcccagaagttccagggcagagtgaccatcaccgccgacaagagcaccagcaccgcctacatggagctgagcagcctgagaagcgaggacaccgccgtgtactactgcgccagagacagaagcagcgccatcggctactgcagcagcatcagctgctacaagggcagcttcgacatctggggccagggcaccatggtgaccgtgagcagcgccagcaccaagggc

SEQ ID NO: 35129 - RNA, 405 nt, synthetic construct
  misc_feature 1..405: note = derived and/or modified sequence opt4 from anti-HIV_Chain
  source 1..405: mol_type = other RNA
gaggtgcagctggtggagagcggcgccgaggtgaagaagcccggcagcagcgtgaaggtgagctgcaaggccagcggcggcaccttcagcacctacgccttcagctgggtgagacaggcccccggccagggcctggagtggatgggcggcatcatccccatcttcggcaccgagaactacgcccagaagttccagggcagagtgaccatcaccgccgacaagagcaccagcaccgcctacatggagctgagcagcctgagaagcgaggacaccgccgtgtactactgcgccagagacagaagcagcgccatcggctactgcagcagcatcagctgctacaagggcagcttcgacatctggggccagggcaccatggtgaccgtgagcagcgccagcaccaagggc

SEQ ID NO: 35130 - RNA, 405 nt, synthetic construct
  misc_feature 1..405: note = derived and/or modified sequence opt4 from anti-HIV_Chain
  source 1..405: mol_type = other RNA
cccctggtgcagctggagcccagcggcgtggaggtgaagaagagaggcgccagcgtgaaggtgagctgcaaggtgagcggctacagcctgaccgagctgagcatgcactgggtgagacaggcccccggcaagggcctggagtggatgggcagcttcgaccccctggacggcgacaccatctacgcccagaagttccagggcagagtgaccatgaccgtggacaccagcaccgacaccgcctacatggacctgagcagcctgagattcgaggacaccgccgtgtactactgcgccacccccagcaaggcctactactacgacagccccaactacgagggcgacttctacatggacgtgtggggcaagggcaccaccgtgatcgtgagcagcgccagcaccaagggc

SEQ ID NO: 35131 - RNA, 408 nt, synthetic construct
  misc_feature 1..408: note = derived and/or modified sequence opt4 from anti-HIV_HeavyChain
  source 1..408: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagctgaccagcgacgacaccgccgtgtacttctgcaccaccaccagcacctacgacaagtggagcggcctgcaccacgacggcgtgatggccttcagcagcagaggccagggcaccctgatcagcgtgagcgccgccagcaccaagggc

SEQ ID NO: 35132 - RNA, 408 nt, synthetic construct
  misc_feature 1..408: note = derived and/or modified sequence opt4 from anti-HIV_HeavyChain
  source 1..408: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagggcctggagtacatcggccagatctggagatggaagagcagcgccagccaccacttcagaggcagagtgctgatcagcgccgtggacctgaccggcagcagcccccccatcagcagcctggagatcaaggtgaccagcgacgacaccgccgtgtacttctgcaccaccaccagcacctacgacgagtggagcgacctgcaccacgacggcgtgatggccttcagcagctggggccagggcaccctgatcagcgtgagcgccgccagcaccaagggc

SEQ ID NO: 35133 - RNA, 408 nt, synthetic construct
  misc_feature 1..408: note = derived and/or modified sequence opt4 from anti-HIV_HeavyChain
  source 1..408: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagctgaccagcgacgacaccgccgtgtacttctgcaccaccaccagcacctacgacagatggagcggcctgcaccacgacggcgtgatggccttcagcagctggggccagggcaccctgatcagcgtgagcgccgccagcaccaagggc

SEQ ID NO: 35134 - RNA, 408 nt, synthetic construct
  misc_feature 1..408: note = derived and/or modified sequence opt4 from anti-HIV_Chain
  source 1..408: mol_type = other RNA
tgcaaccccagagtgcacagcgaggtgcagctggtggagagcggcgccgaggtgaagaagcccggcgccagcgtgaaggtggcctgcaaggtgagcggcaagaagctgagcgacctgagcatccactgggtgagacaggcccccggcaagggcctggagtggatgggcggcttcgacgaggaggacggcaagatcagctacgagagaaagttccagggcagagtgagcatgaccgaggacaccgccagagacaccgccttcatggagatgagcagcctgagaagcgacgacaccgccgtgtacttctgcgccgccgcccccagactggacctgggcgagctgagcagcggcttccacttctggggcctgggcaccctggtgaccgtgagcagcgccagcaccaagggc

SEQ ID NO: 35135 - RNA, 408 nt, synthetic construct
  misc_feature 1..408: note = derived and/or modified sequence opt4 from anti-HIV_Chain
  source 1..408: mol_type = other RNA
atctgggcccccctgatcgccgtgaccttcctggtgctgcactgcgagagcctgggcacctgctgctgctgccaggccagcggcggcaccttcaacaccttcgccatcaactgggtgagacaggcccccggccagggcctggagtgggtgggcggcatcatccccgtgttcggcaccgccagctacgcccagaagttccagggcagagtgaccgtgaccaccgacgagagcagaggcaccgcctacatggagctgaacagcctgagaagcgaggacaccgccgtgtactactgcgccagaggccagaccgacctgaacgacgacctgtggagcgactacagcacccccggcttcgactactggggccagggcaccctggtgaccgtgagcagcgccagcaccaagggc

SEQ ID NO: 35136 - RNA, 408 nt, synthetic construct
  misc_feature 1..408: note = derived and/or modified sequence opt4 from anti-HIV_Chain
  source 1..408: mol_type = other RNA
ctgcagcccagagtgcacagcgaggtgcagctggtggagagcggcgccgaggtgaagaagcccggcgccagcgtgaaggtgagctgcaaggtgagcggctacaccctgagcgacctgagcatgcactgggtgagacaggcccccggcaagggcctggagtggatgggcggcttcgacgaggaggacggcgagatcacctacgcccagaagttccagggcagagtgagcatgaccgaggacaccagcagagacaccgcctacatggagctgagcagcctgagaagcgaggacaccgccgtgtactactgcgccaccgcccccagactggagctgggcgagctgagcagcggcttccactactggggcctgggcaccctggtgaccgtgagcagcgccagcaccaagggc

SEQ ID NO: 35137 - RNA, 408 nt, synthetic construct
  misc_feature 1..408: note = derived and/or modified sequence opt4 from anti-HIV_Chain
  source 1..408: mol_type = other RNA
cagagccaggtgcacctggtgcagagcggcgccgaggtgaagaagcccggcagcagcgtgaaggtgagctgccaggccagcggcggcaccttcaacaccttcgccatcaactgggtgagacaggcccccggccagggcctggagtgggtgggcggcatcatccccgtgttcggcaccgccagctacgcccagaagttccagggcagagtgaccgtgaccaccgacgagagcagaggcaccgcctacatggagctgaacagcctgagaagcgaggacaccgccgtgtactactgcgccagaggccagaccgacctgaacgacgacctgtggagcgactacagcacccccggcttcgactactggggccagggcaccctggtgaccgtgagcagcgccagcaccaagggc

SEQ ID NO: 35138 - RNA, 408 nt, synthetic construct
  misc_feature 1..408: note = derived and/or modified sequence opt4 from anti-HIV_Chain
  source 1..408: mol_type = other RNA
ggcagcgaggtgcagctggtggagagcggcgccgaggtgaagaagagaggcgccagcgtgaaggtgagctgcaaggtgagcggctacagcctgaccgagctgagcatgcactgggtgagacaggcccccggcaagggcctggagtggatgggcagcttcgaccccctggacggcgacaccatctacgcccagaagttccagggcagagtgaccatgaccgtggacaccagcaccgacaccgcctacatggacctgagcagcctgagattcgaggacaccgccgtgtactactgcgccacccccagcaaggcctactactacgacagccccaactacgagggcgacttctacatggacgtgtggggcaagggcaccaccgtgatcgtgagcagcgccagcaccaagggc

SEQ ID NO: 35139 - RNA, 408 nt, synthetic construct
  misc_feature 1..408: note = derived and/or modified sequence opt4 from anti-HIV_Chain
  source 1..408: mol_type = other RNA
caggtgcagctggtgcagagcggcggcgaggtgaagaagcccggcgccagcgtgaaggtgagctgcaaggtgagcggctacagcctgaccgagctgagcatgcactgggtgagacaggcccccggcaagggcctggagtggatgggcgtgttcgaccccctggagggcgacggcgtgtacgtgcagaagttcagaggcagagtgatcatgaccgaggacaccagcaccgacaccgcctacatggagctgaccagcctgagaagcgaggacaccgccatctactactgcgccaccaaggccaaggactactactacgagagcagcgactacagcccctactactactactacatggacgtgtggggcaagggcaccaccgtgaccgtgagcagcgccagcaccaagggc

SEQ ID NO: 35140 - RNA, 408 nt, synthetic construct
  misc_feature 1..408: note = derived and/or modified sequence opt4 from anti-HIV_Chain
  source 1..408: mol_type = other RNA
gaggtgcagctggtgcagagcggcgccgaggtgaagaagcccggcgccagcgtgaaggtgagctgcaaggtgagcggctacaccctgaccgagctgagcatgcactgggtgagacaggcccccggcaagggcctggagtggatgggcgtgttcgaccccctggagggcgacggcgtgtacgccgagaagttcagaggcagagtgatcatgaccgaggacaccagcaccgacaccggctacatggagctgaccagcctgagaagcgaggacaccgccatctactactgcgccaccaaggccaaggactactactacgagagcagcgactacagcccctactactactactacatggacgtgtggggcaagggcaccaccgtgaccgtgagcagcgccagcaccaagggc

SEQ ID NO: 35141 - RNA, 408 nt, synthetic construct
  misc_feature 1..408: note = derived and/or modified sequence opt4 from anti-HIV_Chain
  source 1..408: mol_type = other RNA
caggtgcagctggtgcagagcggcgccgaggtgaagaagcccggcgccagcgtgaaggtgagctgcaaggccagcggctacaccttcaccagataccacatccactgggtgagacacgcccccggccagggcctggagtggatgggcaagatcaaccccagcagagccagcaccaagtacgccaagaagttccaggacagagtgaccatgaccagagacaccagcaccagcaccgtgtacatggagctgagcagcctgagaggcgacgacaccgccgtgtactactgcggcagagagatgggcaccttcaccctgctgggcgtggtgatcgaccactacgacttctaccccatggacgtgtggggccagggcacccccgtgaccgtgagcagcgccagcaccaagggc

SEQ ID NO: 35142 - RNA, 408 nt, synthetic construct
  misc_feature 1..408: note = derived and/or modified sequence opt4 from anti-HIV_Chain
  source 1..408: mol_type = other RNA
agcagaccccccagctgcctgctgggctgctggtgctgcagcggcttcctgctgcccgccgtgatcctgcccaacctgcacagcccctgcctgagcctgctggagagccagccccccagcctggccgacctggtgagcgccttcgccgtgatggacatccccatctacatcggcacctacagaagccaggccagcctgcacagcagcagcaccaagttccccaccgacttcctgggcagccagaccggcagcgtggccgtgggccagggccagatcagccacctgagaagcgtggagtggagactgagaatgtgggagttcatcaccgccctgaaggtgcacatgttcctgagcagaagcgacagaggccccagatggaagaacgtgagcagcctgctgaacagcaga

SEQ ID NO: 35143 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgatcatcagcgccgtggacctgaccggcagcagcccccccatcagccccctggagatcaagaacctgaccagcgacgacaccgccgtgtacttctgcaccaccaccagcaccagcgacagatggagcggcctgcaccacgacggcgtgatggccttcagcagctggggccagggcaccctgatcagcgtgagcgccgccagcaccaagggc

SEQ ID NO: 35144 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgatcatcagcgccgtggacctgaccggcagcagcccccccatcagcagcctggagatcaagaacctgaccagcgacgacaccgccgtgtacttctgcaccaccgccagcacctacgacaagtggagcggcctgcaccacgacggcgtgatggccttcagcagctggggccagggcaccctgatcagcgtgagcgccgccagcaccaagggc

SEQ ID NO: 35145 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggccccagcccccccatcagcagcctggagatcaagaacctgaccagcgacgacaccgccgtgtacttctgcaccaccaccagcacctacgacaagtggagcggcctgcaccacgacggcgtgatggccttcagcagctggggccagggcaccctgatcagcgtgagcgccgccagcaccaagggc

SEQ ID NO: 35146 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtggccgtgagctgcaaggcctacggcgtgaacaccttcggcctgtacgccgtgaactgggtgagacaggcccccggccagagcctggagtacatcggccagatctggagatggaagagcagcgccagccacgacttcagaggcagagtgatcatcagcgccgtggacctgaccggcagcagcccccccatcagcagcctggagatcaagaacctgaccagcgacgacaccgccgtgtacttctgcaccgccaccagcacccccgactactggagcggcctgcaccacgacggcgtgatggccttcagcagctggggccagggcaccctgatcagcgtgagcgccgccagcaccaagggc

SEQ ID NO: 35147 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccggcgtgaagaagcccggcagcagcgtgaccgtgagctgcaaggcctacggcgtgaacaccttcggcctgtacgccgtgaactgggtgagacaggcccccggccagggcctggagtacatcggccagatctggagatggaagagcagcgccagccaccacttcagaggcagagtgctgatcagcgccgtggacctgaccggcagcagcccccccatcaccagcctggagatcaagaacgtgaccagcgacgacaccgccgtgtacttctgcaccaccaccagcacctacgacaagtggagcggcctgtaccacgacggcgtgatggccttcagcagctggggccagggcaccctgatcagcgtgagcgccgccagcaccaagggc

SEQ ID NO: 35148 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgatcatcagcgccgtggacctgaccggcagcagcccccccatcagcagcctggagatcaagaacctgaccagcgacgacaccgccgtgtacttctgcaccaccaccagcaccagcgactactggagcggcctgcaccacgacggcgtgatggccttcagcagctggggccagggcaccctgatcagcgtgagcgccgccagcaccaagggc

SEQ ID NO: 35149 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacctgaccagcgacgacaccgccgtgtacttctgcaccaccaccagcacctacgacagatggagcggcctgcaccacgacggcgtgatggccttcagcagctggggccagggcaccctgatcagcgtgagcgccgccagcaccaagggc

SEQ ID NO: 35150 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgagaaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacctgaccagcgacgacaccgccgtgtacttctgcaccaccaccagcacctacgacaagtggagcggcctgcaccacgacggcgtgatggccttcagcagctggggccagggcaccctgatcagcgtgagcgccgccagcaccaagggc

SEQ ID NO: 35151 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacctgaccagcgacgacaccgccgtgtacttctgcaccaccaccagcacctacgaccagtggagcggcctgcaccacgacggcgtgatggccttcagcagctggggccagggcaccctgatcagcgtgagcgccgccagcaccaagggc

SEQ ID NO: 35152 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgagctgggtgagacaggcccccggccagagactggagtacatcggccagatcagaagatggaagagcagcgccagccaccacttcagaggcagagtgaccgtgagcgccgtggaccccaccggcagcagcccccccatcagcagcctggagatcagagacctgaccaccgacgacaccgccgtgtacttctgcaccaccaccagcaccagcgactactggagcggcctgcacaacgagagaggcaccgccttcagcagctggggccagggcaccctgatcagcgtgagcgccgccagcaccaagggc

SEQ ID NO: 35153 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagggcctggagtacatcggccagatctggagatggaagagcagcgccagccaccacttcagaggcagagtgctgatcagcgccatcgacctgaccggcagcagcccccccatcagcagcctggagatcaagaacgtgaccagcgacgacaccgccgtgtacttctgcaccaccatgagcacctacgacaagtggagcggcctgcaccacgacggcgtgatggccttcagcagctggggccagggcaccctgatcagcgtgagcgccgccagcaccaagggc

SEQ ID NO: 35154 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacgaggtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacgtgaccagcgacgacaccgccgtgtacttctgcaccaccaccagcacccacgacaagtggagcggcctgcaccacgacggcgtgatggccttcagcagctggggccagggcaccctgatcagcgtgagcgccgccagcaccaagggc

SEQ ID NO: 35155 - RNA, 411 nt, synthetic construct
  misc_feature 1..411: note = derived and/or modified sequence opt4 from anti-HIV_HeavyChain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagggcctggagtacatcggccagatctggagatggaagagcagcgccagccaccacttcagaggcagagtgctgatcagcgccgtggacctgaccggcagcagcccccccatcagcagcctggagatcaagaacgtgaccagcgacgacaccgccgtgtacttctgcaccaccaccagcacctacgacaagtggagcggcctgcaccacgacggcgtggtggccttcagcagctggggccagggcaccctgatcagcgtgagcgccgccagcaccaagggc

SEQ ID NO: 35156 - RNA, 411 nt, synthetic construct
  misc_feature 1..411: note = derived and/or modified sequence opt4 from anti-HIV_Chain
  source 1..411: mol_type = other RNA
caggtgaccctggtgcagagcggcgccgaggtgaagaagcccggcgccagcgtgagaatcagctgcagagccagcggcttcaccttcgacgactacagcgactacagcttcatccccaccacctacctgatccactggttcagacaggcccccggccagggcctggagtggatggcctggatcaacagcgtgaacggcggcagaaacatcgccagacagttccagggcagagtgaccgtggccagagacagaagcaacagcatcgccttcctggagttcagcggcctgagacacgacgacaccgccgtgtacttctgcgccagagacagaagagacgacgacagagcctggctgctggacccctggggccagggcaccagagtgaccgtgagcagcgccagcaccaagggc

SEQ ID NO: 35157 - RNA, 411 nt, synthetic construct
  misc_feature 1..411: note = derived and/or modified sequence opt4 from anti-HIV_Chain
  source 1..411: mol_type = other RNA
cagatccacctggtgcagagcggcaccgaggtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacctgaccagcgacgacaccgccgtgtacttctgcaccaccaccagcacctacgacaagtggagcggcctgcaccacgacggcgtgatggccttcagcagctggggccagggcaccctgatcagcgtgagcgccgccagcaccaagggc

SEQ ID NO: 35158 - RNA, 414 nt, synthetic construct
  misc_feature 1..414: note = derived and/or modified sequence opt4 from anti-HIV_Chain
  source 1..414: mol_type = other RNA
gtggtgcagctggtgcagagcggcgccgaggtgagaaagcccggcagcagcctgaaggtgagctgcaagagcagcggcggcaccttcagcagattcgtggtgaactgggtgagacaggcccccggccagggcctggagtggatgggcggcatgatccccatcttcggcatcgccaagtacgcccagaagttccaggacagagtgaccatgaccgccgacgagagcaagaacaccgtgtacctggacttcagcagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35159 - RNA, 414 nt, synthetic construct
  misc_feature 1..414: note = derived and/or modified sequence opt4 from anti-HIV_Chain
  source 1..414: mol_type = other RNA
caggtgcagctggtgcagagcggcgccgaggtgagaaagcccggcagcagcctgaaggtgagctgcaagagcagcggcggcaccttcagcagattcgtggtgaactgggtgagacaggcccccggccagggcctggagtggatgggcggcatgatccccatcttcggcatcgccaagtacgcccagaagttccaggacagagtgaccatgaccgccgacgagagcaagaacaccgtgtacctggacttcagcagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35160 - RNA, 414 nt, synthetic construct
  misc_feature 1..414: note = derived and/or modified sequence opt4 from anti-HIV_Chain
  source 1..414: mol_type = other RNA
gaggtgcagctggtggagagcggcgccgaggtgagaaagcccggcagcagcctgaaggtgagctgcaagagcagcggcggcaccttcagcagattcgtggtgaactgggtgagacaggcccccggccagggcctggagtggatgggcggcatgatccccatcttcggcatcgccaagtacgcccagaagttccaggacagagtgaccatgaccgccgacgagagcaagaacaccgtgtacctggacttcagcagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35161 - RNA, 414 nt, synthetic construct
  misc_feature 1..414: note = derived and/or modified sequence opt4 from anti-HIV_Chain
  source 1..414: mol_type = other RNA
caggtgcagctggtggagagcggcgccgaggtgagaaagcccggcagcagcctgaaggtgagctgcaagagcagcggcggcaccttcagcagatacgtggtgaactgggtgagacaggcccccggccagggcctggagtggatgggcggcatcatccccatcttcggcatcgccaagtacgcccagaagttccaggacagagtgaccatgaccgccgacgagcccaagaacaccgtgtacctggacttcaacagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35162 - RNA, 414 nt, synthetic construct
  misc_feature 1..414: note = derived and/or modified sequence opt4 from anti-HIV_Chain
  source 1..414: mol_type = other RNA
caggtgcagctggtgcagagcggcgccgaggtgagaaagcccggcagcagcctgaaggtgagctgcaagagcagcggcggcaccttcagcagatacgtggtgaactgggtgagacaggcccccggccagggcctggagtggatgggcggcatgatccccatcttcggcatcgccaagtacgcccagaagttccaggacagagtgaccatgaccgccgacgagagcaagaacaccgtgtacctggacttcagcagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35163 - RNA, 414 nt, synthetic construct
  misc_feature 1..414: note = derived and/or modified sequence opt4 from anti-HIV_Chain
  source 1..414: mol_type = other RNA
caggtgcagctggtgcagagcggcgccgaggtgagaaagcccggcagcagcctgaaggtgagctgcaagagcagcggcggcaccttcagcagatacgtggtgaactgggtgagacaggcccccggccagggcctggagtggatgggcggcatcatccccatcttcggcatcgccaagtacgcccagaagttccaggacagagtgaccatgaccgccgacgagagcaagaacaccgtgtacctggacttcagcagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35164 - RNA, 414 nt, synthetic construct
  misc_feature 1..414: note = derived and/or modified sequence opt4 from anti-HIV_Chain
  source 1..414: mol_type = other RNA
caggtgcagctggtggagagcggcgccgaggtgagaaagcccggcagcagcctgaaggtgagctgcaagagcagcggcggcaccttcagcagatacgtggtgaactgggtgagacaggcccccggccagggcctggagtggatgggcggcatcatccccatcttcggcatcgccaagtacgcccagaagttccaggacagagtgaccatgaccgccgacgagagcaagaacaccgtgtacctggacttcagcagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35165 - RNA, 414 nt, synthetic construct
  misc_feature 1..414: note = derived and/or modified sequence opt4 from anti-HIV_Chain
  source 1..414: mol_type = other RNA
caggtgcagctggtgcagagcggcgccgaggtgagaaagcccggcagcagcctgaaggtgagctgcaagagcagcggcggcaccttcagcagatacgtggtgaactgggtgagacaggcccccggccagggcctggagtggatgggcggcatcatccccatcttcggcatcgccaagtacgcccagaagttccaggacagagtgaccatgaccgccgacgagcccaagaacaccgtgtacctggacttcaacagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35166 - RNA, 414 nt, synthetic construct
  misc_feature 1..414: note = derived and/or modified sequence opt4 from anti-HIV_Chain
  source 1..414: mol_type = other RNA
gtggtgcagctggtgcagagcggcgccgaggtgagaaagcccggcagcagcctgaaggtgagctgcaagagcagcggcggcaccttcagcagatacgtggtgaactgggtgagacaggcccccggccagggcctggagtggatgggcggcatgatccccatcttcggcatcgccaagtacgcccagaagttccaggacagagtgaccatgaccgccgacgagagcaagaacaccgtgtacctggacttcagcagcctgagaagcgacgacaccgccgtgtactactgcgccagagacagaggcgacaccagactgctggactacggcgactacgaggacgagagatactactacggcatggacgtgtggggccagggcaccaccgtgatcgtgagcagcgccagcaccaagggc

SEQ ID NO: 35167 - RNA, 414 nt, synthetic construct
  misc_feature 1..414: note = derived and/or modified sequence opt4 from anti-HIV_Chain
  source 1..414: mol_type = other RNA
ttcatctgcttcagcgtggtggtgagactgctggagttcggcggcagactggtgcagcccggcggcagcctgagactgagctgcagcgccagcggcttcaccttcagcaacagcgccatgagctgggtgagacaggcccccggcaagggcctggagtgggtgagcagcatcctgagcagcggcgtgggcaccttctacgccgacagcgtgaagggcagattcaccgtgagcagagacaacagcagaaacaccctgtacctgcagatgaagagcctgagagccgaggacaccgccctgtactactgcgccaaggtgcagatccagcagctgaacttcggcgtgatcaccgacgccggcctggacgtgtggggcaagggcaccaccctgatcgtgagcagcgccagcaccaagggc

SEQ ID NO: 35168 - RNA, 414 nt, synthetic construct
  misc_feature 1..414: note = derived and/or modified sequence opt4 from anti-HIV_Chain
  source 1..414: mol_type = other RNA
caggtgcagctggtgcagagcggcgccgaggtgagaaagcccggcagcagcctgaaggtgagctgcaagagcagcggcggcaccttcagcagatacgtggtgaactgggtgagacaggcccccggccagggcctggagtggatgggcggcatcatccccatcttcggcatcgccaagtacgcccagaagttccaggacagagtgaccatgaccgccgacgagagcaagaacaccgtgtacctggacttcagcagcctgagaagcggcgacaccgccgtgtactactgcgccagagacagaggcgacaccagactgctggactacggcgactacgaggacgagagatactactacggcatggacgtgtggggccagggcaccaccgtgaccgtgagcagcgccagcaccaagggc

SEQ ID NO: 35169 - RNA, 417 nt, synthetic construct
  misc_feature 1..417: note = derived and/or modified sequence opt4 from anti-HIV_Chain
  source 1..417: mol_type = other RNA
caggtgcagctggtggagagcggcgccgaggtgaagaagcccggcagcagcgtgaaggtgagctgcaaggccagcggcggcaccttcaacatcttcgccttcagctgggtgagacaggcccccggccagggcctggagtggatgggcggcatcatccccatcttcgccagccccaactacgcccagagattccagggcagagtgaccatcaccgccgacgagagcaccagcaccgtgcacatggagctgagcagcctgagaagcgaggacaccgccatctactactgcgccaaggacgcccacatgcacatcgaggagcccagagactacgactacatctggggcaccagcccctactacttcgactactggggccagggcaccctggtgaccgtgagcagcgccagcaccaagggc

SEQ ID NO: 35170 - RNA, 417 nt, synthetic construct
  misc_feature 1..417: note = derived and/or modified sequence opt4 from anti-HIV_Chain
  source 1..417: mol_type = other RNA
caggtgcagctggtggagagcggcgccgaggtgaagaagcccggcgccagcgtgaaggtgagctgcaaggccagcggctacaccttcaccagccacgacatcaactgggtgagacaggccaccggccagggcctggagtggatgggctggatgaaccccaacagcggcgacaccggctacgcccacaagttccagggcagagtgaccatgaccagaaacacccccatcagcaccgcctacatggagctgagcagcctgagaagcgaggacaccgccgtgtactactgcgccagaggcagagccaccagcagaaacaccccctgggcccactactacgacagcagcggctactacggcgccggcgactactggggccagggcaccctggtgaccgtgagcagcgccagcaccaagggc

SEQ ID NO: 35171 - RNA, 417 nt, synthetic construct
  misc_feature 1..417: note = derived and/or modified sequence opt4 from anti-HIV_Chain
  source 1..417: mol_type = other RNA
caggtgcagatcagacagagcggccccggcctggtgaagcccctggagaccctgagcctgagctgcatcgtgttcggcggcagcttcatcgcctaccactggacctggatcagacaggcccccctgaagggcctggagtggatcggcgacatcgaccagggcggcgacatcacctacagccccagcctgaagagcagagtgaccatgagcgtggacagaagcaagagccagttcagcctgaagctgagcagcgtgaccgccgccgacgccgccgtgtactactgcgtgagaggcccccccaacagatacgccgtgaccagcttcaccagcggcacccacagagagagaagcagctactacttcgactactggggccccggcaccctggtgaccgtgagcagcgccagcaccaagggc

SEQ ID NO: 35172 - RNA, 423 nt, synthetic construct
  misc_feature 1..423: note = derived and/or modified sequence opt4 from anti-HIV_Chain
  source 1..423: mol_type = other RNA
aacggcggcagcctgagactgagctgcagagtgagcggcttcggcttccacctgtacgagatgaactgggtgagacaggcccccggcaagggcctggagtggatcagcagcatcagcggcagcggcgagagcacccactacagcgacagcatcaccggcagattcagcatgagcagagacgaggccaaggacagcctgtacctgcagatgaacaacctgagagtggaggacaccgccgtgtactactgcaccagaggcttcagcatgggcgacggcaccggcttcagcttcgacacctggggcagaggcaccatggtgaccgtgagcagcggcctggacaccgtgagcctggccagcaccaagggccccagcgtgttccccctggccccctgcagcagaagcaccagcgacgccagactgagc

SEQ ID NO: 35173 - RNA, 423 nt, synthetic construct
  misc_feature 1..423: note = derived and/or modified sequence opt4 from anti-HIV_Chain
  source 1..423: mol_type = other RNA
caggtgcagctggtgcagagcggcgccgaggtgaagaagcccggcagcagcgtgaaggtgagctgcaaggccagcggcggcaccttcagcacctacgccatcagctgggtgagacaggcccccggccagggcctggagtggatgggcggcatcatccccagcttcagcatgagcaactacgcccaggacttccagggcagactgaccatcaccgccgacgagagcaccagcagcgtgtacatggagctgaacagcctgagaagcgaggacaccgccgtgtactactgcgccagagacttccccagattccacagactggtgggcaactacgacttctggagaggcaccctggacagattcagctacatggacctgtggggcagaggcaccgccgtgaccgtgagcagcgccagcaccaagggc

SEQ ID NO: 35174 - RNA, 423 nt, synthetic construct
  misc_feature 1..423: note = derived and/or modified sequence opt4 from anti-HIV_Chain
  source 1..423: mol_type = other RNA
ctggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccgtgatcagctacgacggcagcaacaagttctacgccgacagcgtgaagggcagattcaccatcagcagagacaacagcaagaacaccctgtacctgcagatgaacagcctgagagccgaggacaccgccgtgtactactgcgccagacccaagttcctgcccggcgccgacatcgtggtggtggtggccgccacccccttcgactactggggccagggcaaccccggccacagactgctgagcttccaccagggccccatcggcctgccccccggc

SEQ ID NO: 35175 - RNA, 423 nt, synthetic construct
  misc_feature 1..423: note = derived and/or modified sequence opt4 from anti-HIV_HeavyChain
  source 1..423: mol_type = other RNA
atggagtggagcggcgtgttcatcttcctgctgagcgtgaccgccggcgtgcacagcgaggtgcagctggtggagagcggcggcggcctggtgaagcccggcggcagcctgagactgagctgcgccgccagcggctacaccttcagcaactactggatcggctgggtgagacaggcccccggcaagggcctggagtggatcggcgacatctaccccggcggcaactacatcagaaacaacgagaagttcaaggacaagaccaccctgagcgccgacaccagcaagaacaccgcctacctgcagatgaacagcctgaagaccgaggacaccgccgtgtactactgcggcagcagcttcggcagcaactacgtgttcgcctggttcacctactggggccagggcaccctggtgaccgtgagcagc

SEQ ID NO: 35176 - RNA, 423 nt, synthetic construct
  misc_feature 1..423: note = derived and/or modified sequence opt4 from anti-HIV_HeavyChain
  source 1..423: mol_type = other RNA
atggagtggagcggcgtgttcatcttcctgctgagcgtgaccgccggcgtgcacagccaggtgcagctggtgcagagcggccccgacgtgaagaagcccggcaccagcatgaagatgagctgcaagaccagcggctacaccttcagcaactactggatcggctgggtgagacaggcccccggccagggcctggagtggatcggcgacatctaccccggcggcaactacatcagaaacaacgagaagttcaaggacaagaccaccctgaccgccgacaccagcaccagcaccgcctacatgcagctgggcagcctgagaagcgaggacaccgccgtgtactactgcggcagcagcttcggcagcaactacgtgttcgcctggttcacctactggggccagggcaccctggtgaccgtgagcagc

SEQ ID NO: 35177 - RNA, 429 nt, synthetic construct
  misc_feature 1..429: note = derived and/or modified sequence opt4 from anti-HIV_Chain
  source 1..429: mol_type = other RNA
caggtgttcgtgcagctggtgcagagcggcggcggcctggtgcagcccggcggcagcgtgagactgagctgcaccgccagcggcttcctgttcagcacctacagcatgaactgggtgagacaggcccccggcaagggcctggagtgggtgagcagcatcagcaccaccagcaactacatctactacgccgacagcgtgaagggcagattcaccatcagcagaagcaacggccagggcagcctgtacctgcagctgaacagcctgagagtggaggacaccgccgtgtactactgcgccagagacaccaaggtgggcgcccccagacaggactgctacgccatggacctgtggggccagagagaccacggccacagactgctgagcttccaccagggccccatcggcctgccccccggcgccctgctgcag

SEQ ID NO: 35178 - RNA, 432 nt, synthetic construct
  misc_feature 1..432: note = derived and/or modified sequence opt4 from anti-HIV_Chain
  source 1..432: mol_type = other RNA
atcatcctgttcctggtggccaccgccaccggcgtgcacagcgacatccagatgacccagagccccagcagcctgagcgccagcgtgggcgacagagtgaccatcacctgcagagccagccagagcatcgacagatacctgaactggtaccagcacaagcccggcaaggcccccaagctgctgatctacgccgccagcaacctgcacaccgacgtgcccagcagattcagcggcagcggcgccggcacctacttcaccctgaccatcaccagcctgcagcccgaggacttcgccacctactactgccagcagagccacagccccagcttcggccaggagagctacagcatcgccttcggccagggcaccagactggagatcaagagaaccgtggccgcccccagcgtgttcatcttcccccccagcgacgag

SEQ ID NO: 35179 - RNA, 432 nt, synthetic construct
  misc_feature 1..432: note = derived and/or modified sequence opt4 from anti-HIV_Chain
  source 1..432: mol_type = other RNA
ctgcagcagctgcaggtgcccagactgagcatgtggagagtgttcaaggtggccgccgccaccggcgcccagaccctgaccgtggaggagcccggcagcagcgtgaaggtgagctgcaaggccagcggcggcagcagcaccgcctacggctacagctgggtgagacaggcccccggccagggcttcgagtggatgggcagaatcatccccttctacggcatcatcacctacgcccccaagttccagggcagagtgaccatcaccgccgacagaagcaccagcaccgtgtacatggagctgaccagcctgaccttcgccgacaccgccctgttcttctgcgccagagacttcggcgaccccagaaacggctactacttcgacagctgggaccagggcctgtggctgaccgtgagcagcgccagcaccaagggc

SEQ ID NO: 35180 - RNA, 432 nt, synthetic construct
  misc_feature 1..432: note = derived and/or modified sequence opt4 from anti-HIV_Chain
  source 1..432: mol_type = other RNA
caggtgagactggagcagagcggcgtggccatgagaaagcccggcgccagcgtgaccctgagctgccaggccagcggctacaacttcgtgaagtacatcatccactgggtgagacagaagcccggcctgggcttcgagtgggtgggcatgatcgacccctacagaggcagaccctggagcgcccacaagttccagggcagactgagcctgagcagagacaccagcatggagatcctgtacatgaccctgaccagcctgaagagcgacgacaccgccacctacttctgcgccagagccgaggccgccagcgacatccacagcagacccatcatcctgaccggccccggcgagtacggcctggacctggagcacatggactggacctggagaatcctgtgcctgctggccgtggcccccggctgccacagccag

SEQ ID NO: 35181 - RNA, 435 nt, synthetic construct
  misc_feature 1..435: note = derived and/or modified sequence opt4 from anti-HIV_Chain
  source 1..435: mol_type = other RNA
atgttcctgttcctggtggccggcgccaccggcgtgcagagccaggtgtacctggtgcccttcggccccgaggtgaagaagcccggcagcagcgtgaaggtgagctgcaaggccagcggcgacagcttcaccagcagcgtgatcacctgggtgagacaggcccccggccagggccccgagtggatgggcagagtgatccccgtgctgggcgtggccgcctacgcccagaagttctacggcagagtgaccatcaccgccgacaccagcagcaacaccgcctacatggaggtgaacagcctgagattcgaggacaccgccgtgtactactgcgccagagagaccggcagaggcggcaacctggccctgagacagtacttcttcgacagctggggccagggcaccctggtgaccgtgagcagccccagcaccaagggc

SEQ ID NO: 35182 - RNA, 438 nt, synthetic construct
  misc_feature 1..438: note = derived and/or modified sequence opt4 from anti-HIV_Chain
  source 1..438: mol_type = other RNA
caggtgcagctgcaggagagcggccccggcctggtgaagcccagcggcaccctgagcctgacctgcgccgtgagcggcgccagcatcagcagcagaaactggtggacctgggtgagacagccccccggcaagggcctggagtggatcggcgagatctacgagagcggcgccaccaactacaaccccagcctgaagagcagagtgaccatcagcgtggacaagagcaagaaccagttcagcctgagactgaccagcgtgaccgccgccgacaccgccgtgtacttctgcgccagactgatgaccttcggcggcctgatcggcaccctggactactggggccagggcaccctggtgaccgtgctgcagcccccccccagagcccacagataccaccccagaaacctgctgcaggagcacctgtgcgccagagtgatgccc

SEQ ID NO: 35183 - RNA, 444 nt, synthetic construct
  misc_feature 1..444: note = derived and/or modified sequence opt4 from anti-HIV_HeavyChain
  source 1..444: mol_type = other RNA
atggagtggagcggcgtgttcatcttcctgctgagcgtgaccgccggcgtgcacagcgaggtgcagctggtggagagcggcggcggcctggtgaagcccggcggcagcctgagactgagctgcgccgccagcggctacaccttcagcaactactggatcggctgggtgagacaggcccccggcaagggcctggagtggatcggcgacatctaccccggcggcaactacatcagaaacaacgagaagttcaaggacaagaccaccctgagcgccgacaccagcaagaacaccgcctacctgcagatgaacagcctgaagaccgaggacaccgccgtgtactactgcggcagcagcttcggcagcaactacgtgttcgcctggttcacctactggggccagggcaccctggtgaccgtgagcagcggcgagagcctgaagcccctg

SEQ ID NO: 35184 - RNA, 444 nt, synthetic construct
  misc_feature 1..444: note = derived and/or modified sequence opt4 from anti-HIV_HeavyChain
  source 1..444: mol_type = other RNA
atggagtggagcggcgtgttcatcttcctgctgagcgtgaccgccggcgtgcacagccaggtgcagctggtgcagagcggccccgacgtgaagaagcccggcaccagcatgaagatgagctgcaagaccagcggctacaccttcagcaactactggatcggctgggtgagacaggcccccggccagggcctggagtggatcggcgacatctaccccggcggcaactacatcagaaacaacgagaagttcaaggacaagaccaccctgaccgccgacaccagcaccagcaccgcctacatgcagctgggcagcctgagaagcgaggacaccgccgtgtactactgcggcagcagcttcggcagcaactacgtgttcgcctggttcacctactggggccagggcaccctggtgaccgtgagcagcggcgagagcctgaagcccctg

SEQ ID NO: 35185 - RNA, 447 nt, synthetic construct
  misc_feature 1..447: note = derived and/or modified sequence opt4 from anti-HIV_Chain
  source 1..447: mol_type = other RNA
caggccagactggaccagtggggcaccggcctgctgaagcccagcgagaccctgagcctgaagtgcgccgtgttcggcgtgctgttcaccgactacaactggacctgggtgagacagagccccggcaagggcctggagtggatcggccacctggaccacagaggcggcggcaactacaaccccagcctggagagcagagtgaccatcagcctggactacagcaaggcccagttcagcctgcacctgaagagcgtgaccgtggccgacaccgccctgtactactgcgccggcgccgtgaagggcttctggttcgacgaggtgtacaactggttcggccccggcgtgagagagccctggctgcccagcccccagcccccccccagagcccacagaagcagcccctggcaccccccccccagagcccccctggtgaccgccaccgtgccc

SEQ ID NO: 35186 - RNA, 447 nt, synthetic construct
  misc_feature 1..447: note = derived and/or modified sequence opt4 from anti-HIV_Chain
  source 1..447: mol_type = other RNA
caggccagactggaccagtggggcaccggcctgctgaagcccagcgagaccctgagcctgaagtgcgccgtgttcggcgtgctgttcaccgactacaactggacctgggtgagacagagccccggcaagggcctggagtggatcggccacctggaccacagaggcggcggcaactacaaccccagcctggagagcagagtgaccatcagcctggactacagcaaggcccagttcagcctgcacctgaagagcgtgaccgtggccgacaccgccctgtactactgcgccggcgccgtgaagggcctgtggttcgacgagacctacacctggttcggcccctggagccagggcaccagagtgaccgtggccagcgccagcaccaagggccccagcgtgttccccctggcccccagcagcaagagcaccagcggcaccagagacctgagc

SEQ ID NO: 35187 - RNA, 447 nt, synthetic construct
  misc_feature 1..447: note = derived and/or modified sequence opt4 from anti-HIV_Chain
  source 1..447: mol_type = other RNA
gccgccagactggaccagtggggcaccggcctggtgaagcccagcgagaccctgagcctgaagtgcgccgtgttcggcgtggacttccccgactacacctggacctgggccagacaggcccccggcaagggcctggagtggatcggccacagagaccacagaggcggcagcagctacaaccccagcctgagcggcagagccaccatcagcctggacaccagcaaggcccagttcagcctgcacatcaagagcgtgaccgtggccgacaccgccacctactactgcgccggcgccgtggccggcctgtggttcgaggacgcctacaactggttcggcccctggagccagggcaccctggtgaccgtggccgccgccagcaccaagggccccagcgtgttccccctggcccccagcagcaagagcaccagcggccacgccagcgtgctg

SEQ ID NO: 35188 - RNA, 450 nt, synthetic construct
  misc_feature 1..450: note = derived and/or modified sequence opt4 from anti-HIV_Chain
  source 1..450: mol_type = other RNA
ctggcccagctggagcagagcggcggcggcgtggtgaagcccggcggcagcctgagactgccctgcgccgccagcggcttcaccttcatcgactactacatggcctggatcagactggcccccggcaagggcctggagtggctgagctacatcagcaagaacggcgactacaccaagtacagcgagagcctgaagggcagattcaccatcagcagagacaacgccaagaacctggtgatcctgcagctgaacagactgagagccgacgacaccgccatctacttctgcgccagagccgacggcctgacctacttcggcgagctgctgcagtacatcttcgacctgtggggccagggcgccagagtgatcgtgagcagcgccagcaccaagggccccagcgtgttccccctggcccccagcagcaagagcaccagcggccacgccagcgtg

SEQ ID NO: 35189 - RNA, 459 nt, synthetic construct
  misc_feature 1..459: note = derived and/or modified sequence opt4 from anti-HIV_Chain
  source 1..459: mol_type = other RNA
caggtgcagctggtgcagagcggcgccgaggtgaagaagcccggcgccagcgtgaaggtgagctgcaaggtgagcggctacaccctgaccgagctgagcatccactgggtgagacaggcccccggcaagggcctggagtggatgggcggcttcgacagcgaggacggcgaggccatctacaagcagaacttccagggcagagtgaccatgaccgaggacaccagcaccgacaccgcctacatggagctgagcagactgagaagcgaggacaccgccgtgtactactgcgccaccgccgacagattcaaggtggcccaggacgagggcctgttcgtgatcttcgactactggggccagggcaaccccggccacagactgctgagcctgcaccagggccccatcggcctgccccccggcaccctgccccccaaggccaccagcggccacgccgccagaaga

SEQ ID NO: 35190 - RNA, 462 nt, synthetic construct
  misc_feature 1..462: note = derived and/or modified sequence opt4 from anti-HIV_Chain
  source 1..462: mol_type = other RNA
ctggtgcagctggtgcagagcggcgccgaggtgaagaagcccggcgccagcgtgaaggtgagctgcaaggtgagcggctacagcctgaccgagctgagcatccactgggtgagacaggcccccggcaagggcctggagtggatgggcggcttcgacagcgaggacggcgaggccatctacaagcagaacttccagggcagagtgaccatgaccgaggacaccagcaccgacaccgcctacatggagctgagcagactgagaagcgaggacaccgccgtgtactactgcgccaccgccgaccccttcaaggtggcccaggacgagggcctgttcgtgatcttcgactactggggccagggcaccaccggccacagactgctgagcctgcaccagggcccccacagactgtacagcctgggcaccctgctgagcagagcccccatcgtgcagacccacatggcc

SEQ ID NO: 35191 - RNA, 471 nt, synthetic construct
  misc_feature 1..471: note = derived and/or modified sequence opt4 from anti-HIV_Chain
  source 1..471: mol_type = other RNA
cagatccacctggtgcagagcggcaccgacgtgaagaagcccggcagcagcgtgaccgtgagctgcaaggcctacggcgtgaacaccttcggcctgtacgccgtgaactgggtgagacaggcccccggccagagcctggagtacatcggccagatctggagatggaagagcagcgccagccaccacttcagaggcagagtgctgatcagcgccgtggacctgaccggcagcagcccccccatcagcagcctggagatcaagaacctgaccagcgacgacaccgccgtgtacttctgcaccaccaccagcacctacgaccagtggagcggcctgcaccacgacggcgtgatggccttcagcagcagaggccagggcaccctgatcagcgtgagcgccgccagcaccaagggccccagcgtgttccccctggcccccagcagcaagagcacctacggcctggcccacgtgctg

SEQ ID NO: 35192 - RNA, 477 nt, synthetic construct
  misc_feature 1..477: note = derived and/or modified sequence opt4 from anti-HIV_Chain
  source 1..477: mol_type = other RNA
cagcaccagctggtgccctgcgtggccgaggtgagaaagcccggcgccagcgtgaaggtgagctgcaaggtgagcggctacaccctgaccgagatcagcatgcactgggtgagacaggcccccggcaagggcctggagtggatgggcggcttcgacagagaggacggcgagaccatctacgcccagaagttccagggcagagtgaccatgaccgaggacaccagcaccgacaccgcctacatggagctgagcagcctgagaagcgaggacaccgccgtgtactactgcgccaccacctacctggccgtggtgcccgacggcttcgacggctacagcagcagctggtactggttcgacccctggggccagggcaccctggtgaccgtgagcagcgccagcatgcagggccccatgctgctgagccccaccggcaccctgctgcccagagcccccctggtgcagaccagacccggcccc

SEQ ID NO: 35193 - RNA, 642 nt, synthetic construct
  misc_feature 1..642: note = derived and/or modified sequence opt4 from anti-HIV_LightChain
  source 1..642: mol_type = other RNA
gacatcgtgatcacccagagcaccaagttcatgagcaccagcgtgggcgacagagtgagcatcacctgcaaggccagccaggacgtgagcaccgccgtggcctggtaccagcagaagcccggccagagccccaagctgctgatctactgggccagcaccagacacaccggcgtgcccgacagattcaccggcagcggcagcggcaccgactacaccctgaccatcagcagagtgcaggccgaggacctggccctgtactactgccagcagcactacaccaccccctggaccttcggcggcggcaccaagctggagatcaagagaaccgtggccgcccccagcttcgtgatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35194 - RNA, 651 nt, synthetic construct
  misc_feature 1..651: note = derived and/or modified sequence opt4 from anti-HIV_Chain
  source 1..651: mol_type = other RNA
cagagcgtgctgacccagccccccagcgtgagcgccgcccccggccagaaggtgaccatcagctgcagcggcagcagcagcaacatcggcaacaactacgtgctgtggtaccagcagttccccggcaccgcccccaagctgctgatctacggcaacaacaagagacccagcggcatccccgacagattcagcggcagcaagagcggcaccagcgccaccctgggcatcaccggcctgcagaccggcgacgaggccgactacttctgcgccacctgggacagcggcctgagcgccgactgggtgttcggcggcggcaccaagctgaccgtgctgagccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35195 - RNA, 657 nt, synthetic construct
  misc_feature 1..657: note = derived and/or modified sequence opt4 from anti-HIV_Chain
  source 1..657: mol_type = other RNA
gacatcgtgatgacccagagccccgacagcctggccgtgagcctgggcgagagagtgaccatgaactgcaagagcagccagagcctgctgtacagcaccaaccagaagaactacctggcctggtaccagcagaagcccggccagagccccaagctgctgatctactgggccaacagcaccgagagcggcgtgcccgacagattcagcggcagcggcagcggcaccgacttcaccctgaccatcagcagcgtgcaggccgaggacgtggccgtgtactactgccagcagtactacagctacagaaccttcggcggcggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35196 - RNA, 753 nt, synthetic construct
  misc_feature 1..753: note = derived and/or modified sequence opt4 from anti-HIV_SingleChain
  source 1..753: mol_type = other RNA
atgcaggtgcagctggagcagagcggcgccgaggtgaagaagcccggcgccagcgtgaaggtgagctgccaggccagcggctacagattcagcaacttcaccgtgcactgggtgagacaggcccccggccagagattcgagtggatgggctggatcaacccctacaacggcaacaaggagttcagcgccaagttccaggacagagtgaccttcaccgccgacaccagcgccaacaccgcctacatggagctgagaagcctgagaagcgccgacaccgccgtgtactactgcgccagagtgggcgagtggggctgggacgacagcccccaggacaactactacatggacgtgtggggcaagggcaccaccgtgatcgtgagcagcggcggcggcggcagcggcggcggcggcagcggcggcggcggcagcgacatcgagctgacccagagccccggcaccctgagcctgagccccggcgagagagccaccttcagctgcagaagcagccacagcatcagaagcagaagagtggcctggtaccagcacaagcccggccaggcccccagactggtgatccacggcgtgagcaacagagccagcggcatcagcgacagattcagcggcagcggcagcggcaccgacttcaccctgaccatcaccagagtggagcccgaggacttcgccctgtactactgccaggtgtacggcgccagcagctacaccttcggccagggcaccaagctggagagaaag

SEQ ID NO: 35197 - RNA, 1338 nt, synthetic construct
  misc_feature 1..1338: note = derived and/or modified sequence opt4 from anti-HIV_LightChain
  source 1..1338: mol_type = other RNA
gaggtgaagctggaggagagcggcggcggcctggtgcagcccggcggcagcagaaagctgagctgcgccgccagcggcttcaccttcagcagcttcggcatgcactgggtgagacaggcccccgagaagggcctggagtgggtggcctacatcagcagcggcagcagcaccctgcactacgccgacaccgtgaagggcagattcaccatcagcagagacaaccccaagaacaccctgttcctgcagatgaagctgcccagcctgtgctacggcctgctgggcagcagaaacctgagccacagactgctgagccagaacgacacccccatctgcctgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35198 - RNA, 1380 nt, synthetic construct
  misc_feature 1..1380: note = derived and/or modified sequence opt4 from anti-HIV_Chain
  source 1..1380: mol_type = other RNA
gaggtgcagctggtggagagcggcggcggcctggtgaagcccggcggcagcctgagactgacctgcgtggccagcggcttcaccttcagcgacgtgtggctgaactgggtgagacaggcccccggcaagggcctggagtgggtgggcagaatcaagagcagaaccgacggcggcaccaccgactacgccgccagcgtgaagggcagattcaccatcagcagagacgacagcaagaacaccctgtacctgcagatgaacagcctgaagaccgaggacaccgccgtgtacagctgcaccaccgacggcttcatcatgatcagaggcgtgagcgaggactactactactactacatggacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 35199 - RNA, 1413 nt, synthetic construct
  misc_feature 1..1413: note = derived and/or modified sequence opt4 from anti-HIV_Chain
  source 1..1413: mol_type = other RNA
atggagtggagcggcgtgttcatgttcctgctgagcgtgaccgccggcgtgcacagccaggtgcagctgcagcagagcggccccgaggtggtgaagcccggcgccagcgtgaagatgagctgcaaggccagcggctacaccttcaccagctacgtgatccactgggtgagacagaagcccggccagggcctggactggatcggctacatcaacccctacaacgacggcaccgactacgacgagaagttcaagggcaaggccaccctgaccagcgacaccagcaccagcaccgcctacatggagctgagcagcctgagaagcgaggacaccgccgtgtactactgcgccagagagaaggacaactacgccaccggcgcctggttcgcctactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagttcgagggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgccagcatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35200 - RNA, 645 nt, synthetic construct
  misc_feature 1..645: note = derived and/or modified sequence opt4 from anti-influenza_Fab
  source 1..645: mol_type = other RNA
atcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagcccgaggacttcgccgtgtactactgccagcactacagcaactggccccccagactgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35201 - RNA, 681 nt, synthetic construct
  misc_feature 1..681: note = derived and/or modified sequence opt4 from anti-influenza_Fab
  source 1..681: mol_type = other RNA
gtgcagctggtggagagcggcggcggcgtggtgcagcccggcaagagccccagactgagctgcgccgccagcggccccaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgc

SEQ ID NO: 35202 - RNA, 1515 nt, synthetic construct
  misc_feature 1..1515: note = derived and/or modified sequence opt4 from anti-influenza_Fab
  source 1..1515: mol_type = other RNA
gccggcagcaccgccaccctgtgcctgggccaccacgccgtgcccaacggcaccatcgtgaagaccatcaccaacgaccagatcgaggtgaccaacgccaccgagctggtgcagagcagcagcaccggcgagatctgcgacagcccccaccagatcctggacggcaagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaacaacgagagcttcaactggaccggcgtgacccagaacggcaccagcagcgcctgcatcagaagaagcaagaacagcttcttcagcagactgaactggctgacccacctgaacttcaagtaccccgccctgaacgtgaccatgcccaacaacgagcagttcgacaagctgtacatctggggcgtgcaccaccccggcaccgacaaggaccagatcttcctgtacgcccaggccagcggcagaatcaccgtgagcaccaagagaagccagcagaccgtgagccccaacatcggcagcagacccagagtgagaaacatccccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcagaggccaggccgccgacctgaagagcacccaggccgccatcgaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagaagaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcagcggcagactggtgcccaga

SEQ ID NO: 35203 - RNA, 657 nt, synthetic construct
  misc_feature 1..657: note = derived and/or modified sequence opt4 from anti-influenza_Fab
  source 1..657: mol_type = other RNA
caggtgcagctggtgcagagcggcggcggcgtggtgcagcccggcagaagcctgagactgagctgcgccgccagcgagttcaccttcagaatgtacgccacccactgggtgagacaggcccccggcaagggcctggagtgggtggccctgatcagctacgacggcagcaacaagtactacgccgacagcgtgaagggcagattcaccatcagcagagacaacagcatgaacaccgtgtacctgcagatgaacaccctgagacccgaggacaccgccgtgtactactgcgccagagacctgggcggctacttcatcagaggcatcatggacgtgtggggccagggcaccctggtgaccgtgagcagcgccagcaccaagggccccagcgtgttccccctggcccccagcagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaag

SEQ ID NO: 35204 - RNA, 642 nt, synthetic construct
  misc_feature 1..642: note = derived and/or modified sequence opt4 from anti-influenza_Fab
  source 1..642: mol_type = other RNA
gagctgcagatgacccagagccccagcagcgtgagcgccagcgtgggcgacagagtgaccatcacctgcagagccagccagggcatcagcagctggctggcctggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcaggccaacagcttccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35205 - RNA, 993 nt, synthetic construct
  misc_feature 1..993: note = derived and/or modified sequence opt4 from anti-influenza_Fab
  source 1..993: mol_type = other RNA
gccgaccccggcgacaccatctgcatcggctaccacgccaacaacagcaccgacaccgtggacaccgtgctggagaagaacgtgaccgtgacccacagcgtgaacctgctggaggacagccacaacggcaagctgtgcaagctgaagggcatcgcccccctgcagctgggcaagtgcaacatcgccggctggctgctgggcaaccccgagtgcgacctgctgctgaccgccagcagctggagctacatcgtggagaccagcaacagcgagaacggcacctgctaccccggcgacttcatcgactacgaggagctgagagagcagctgagcagcgtgagcagcttcgagaagttcgagatcttccccaagaccagcagctggcccaaccacgagaccaccaagggcgtgaccgccgcctgcagctacgccggcgccagcagcttctacagaaacctgctgtggctgaccaagaagggcagcagctaccccaagctgagcaagagctacgtgaacaacaagggcaaggaggtgctggtgctgtggggcgtgcaccacccccccaccggcaccgaccagcagagcctgtaccagaacgccgacgcctacgtgagcgtgggcagcagcaagtacaacagaagattcacccccgagatcgccgccagacccaaggtgagagaccaggccggcagaatgaactactactggaccctgctggagcccggcgacaccatcaccttcgaggccaccggcaacctgatcgccccctggtacgccttcgccctgaacagaggcagcggcagcggcatcatcaccagcgacgcccccgtgcacgactgcaacaccaagtgccagaccccccacggcgccatcaacagcagcctgcccttccagaacatccaccccgtgaccatcggcgagtgccccaagtacgtgagaagcaccaagctgagaatggccaccggcctgagaaacatccccagcatccagagcaga

SEQ ID NO: 35206 - RNA, 537 nt, synthetic construct
  misc_feature 1..537: note = derived and/or modified sequence opt4 from anti-influenza_Fab
  source 1..537: mol_type = other RNA
ggcctgttcggcgccatcgccggcttcatcgagggcggctggaccggcatgatcgacggctggtacggctaccaccaccagaacgagcagggcagcggctacgccgccgaccagaagagcacccagaacgccatcgacggcatcaccaacaaggtgaacagcgtgatcgagaagatgaacacccagttcaccgccgtgggcaaggagttcaacaacctggagagaagaatcgagaacctgaacaagaaggtggacgacggcttcctggacatctggacctacaacgccgagctgctggtgctgctggagaacgagagaaccctggacttccacgacagcaacgtgagaaacctgtacgagaaggtgaagagccagctgaagaacaacgccaaggagatcggcaacggctgcttcgagttctaccacaagtgcgacgacgcctgcatggagagcgtgagaaacggcacctacgactaccccaagtacagcgaggagagcaagctgaacagagaggagatcgacggcgtgagcggcaga

SEQ ID NO: 35207 - RNA, 642 nt, synthetic construct
  misc_feature 1..642: note = derived and/or modified sequence opt4 from anti-influenza_Apo
  source 1..642: mol_type = other RNA
cagagcgtgctgacccagccccccagcgtgagcgtggcccccggccagaccgccagaatcacctgcggcggcaacgacatcggcagaaagagcgtgcactggaaccagcagaagcccggccaggcccccgtgctggtggtgtgctacgacagcgacagacccagcggcatccccgagagattcagcggcagcaacagcggcaacaccgccaccctgaccatcagcagagtggaggccggcgacgaggccgactactactgccaggtgtgggacagcagcagcgaccacgtgatcttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35208 - RNA, 687 nt, synthetic construct
  misc_feature 1..687: note = derived and/or modified sequence opt4 from anti-influenza_Apo
  source 1..687: mol_type = other RNA
gaggtgcagctggtgcagagcggcgccgaggtgaagaagcccggcgccagcgtgaaggtgagctgcaaggccagcggctacaccttcaccgactaccacatcaactgggtgagacaggcccccggccagggcctggagtggatgggctggatccaccccaacagcggcgacaccaactacgcccagaagttccagggctgggtgaccatgaccagagacaccgccatcagcaccgcctacatggaggtgaacggcctgaagagcgacgacaccgccgtgtactactgcgccagaggcggcctggagcccagaagcgtggactactactactacggcatggacgtgtggggccagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgc

SEQ ID NO: 35209 - RNA, 333 nt, synthetic construct
  misc_feature 1..333: note = derived and/or modified sequence opt4 from anti-influenza-A_kappa_LightChain_V-Region
  source 1..333: mol_type = other RNA
gacatcgtgatgacccagagccccgacagcctggccgtgagcctgggcgccagagccaccatcaactgcaagagcagccagagcgtgaccttcaactacaagaactacctggcctggtaccagcagaagcccggccagccccccaaggtgctgatctactgggccagcgccagagagagcggcgtgcccgacagattcagcggcagcggcagcggcaccgacttcaccctgaccatcagcagcctgcaggccgaggacgtggccgtgtactactgccagcagcactacagaaccccccccaccttcggccagggcaccaaggtggagatcaag

SEQ ID NO: 35210 - RNA, 333 nt, synthetic construct
  misc_feature 1..333: note = derived and/or modified sequence opt4 from anti-influenza-A_kappa_LightChain_V-Region
  source 1..333: mol_type = other RNA
gacatcgtgatgacccagagccccgacagcctggccgtgagcctgggcgagagagccaccatcaactgcaagagcagccagagcgtgagcagcaacaacaagaactacctggcctggtaccagcagaagcccggccagccccccaaggtgctgatctactgggccagcgccagagagagcggcgtgcccgacagattcagcggcagcggcagcggcaccgacttcaccctgaccatcagcagcctgcaggccgaggacgtggccgtgtactactgccagcagcactacagaaccccccccaccttcggccagggcaccaaggtggagatcaag

SEQ ID NO: 35211 - RNA, 333 nt, synthetic construct
  misc_feature 1..333: note = derived and/or modified sequence opt4 from anti-influenza-A_kappa_LightChain_V-Region
  source 1..333: mol_type = other RNA
gacatcgtgatgacccagagccccgacagcctggccgtgagcctgggcgagagagccaccatcaactgcagaagcagccagagcgtgagcagcaacaacaagaacttcctggcctggtaccaggagaagcccggccagccccccaaggtgctgatctactgggccagcgccagagagagcggcgtgcccgacagattcagcggcagcggcagcggcaccgacttcaccctgaccatcagcggcctgcaggccgaggacgtggccgtgtactactgccagcagcactacagaaccccccccaccttcggccagggcaccaaggtggagatcaag

SEQ ID NO: 35212 - RNA, 333 nt, synthetic construct
  misc_feature 1..333: note = derived and/or modified sequence opt4 from anti-influenza-A_kappa_LightChain_V-Region
  source 1..333: mol_type = other RNA
gacatcgtgatgacccagagccccgacagcctggccgtgagcctgggcgagagagccaccatcaactgcaagagcagccagagcgtgaccttcaactacaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagcactacagaaccccccccaccttcggccagggcaccaaggtggagatcaag

SEQ ID NO: 35213 - RNA, 339 nt, synthetic construct
  misc_feature 1..339: note = derived and/or modified sequence opt4 from anti-influenza-A_kappa_LightChain_V-Region
  source 1..339: mol_type = other RNA
gacatcgtgatgacccagagccccgacagcctggccgtgagcctgggcgagagagccaccatcaactgcaagagcagccagagcgtgctgtacagcagcaacaacaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagtactacagcaccccccccaccttcggccagggcaccaaggtggagatcaag

SEQ ID NO: 35214 - RNA, 333 nt, synthetic construct
  misc_feature 1..333: note = derived and/or modified sequence opt4 from anti-influenza-A_kappa_LightChain_V-Region
  source 1..333: mol_type = other RNA
gacatccagatgacccagagccccgacagcctggccgtgagcctgggcgccagagccaccatcaactgcaagagcagccagagcgtgaccttcaactacaagaactacctggcctggtaccagcagaagcccggccagccccccaaggtgctgatctactgggccagcgccagagagagcggcgtgcccgacagattcagcggcagcggcagcggcaccgacttcaccctgaccatcagcagcctgcaggccgaggacgtggccgtgtactactgccagcagcactacagaaccccccccaccttcggccagggcaccaaggtggagatcaag

SEQ ID NO: 35215 - RNA, 387 nt, synthetic construct
  misc_feature 1..387: note = derived and/or modified sequence opt4 from anti-influenza-A_HeavyChain_V-Region
  source 1..387: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatcagctacgacggcagcaacaagtactacgccgacagcgtgaagggcagattcaccatcagcagagacaacagcaagaacaccctgtacctgcagatgaacagcctgagagccgaggacaccgccgtgtactactgcgccaaggacagccagctgagaagcctgctgtacttcgactggctgagccagggctacttcgactactggggccagggcaccctggtgaccgtgagcagc

SEQ ID NO: 35216 - RNA, 387 nt, synthetic construct
  misc_feature 1..387: note = derived and/or modified sequence opt4 from anti-influenza-A_HeavyChain_V-Region
  source 1..387: mol_type = other RNA
caggtgcagctggtgcagagcggcggcggcgtggtgcagcccggcagaagcctgagactgagctgcgtggccagcggcttcaccttcagcacctacgccatgcactgggtgagacaggcccccggcagaggcctggagtgggtggccgtgatcagctacgacggcaactacaagtactacgccgacagcgtgaagggcagattcagcatcagcagagacaacagcaacaacaccctgcacctggagatgaacaccctgagaaccgaggacaccgccctgtactactgcgccaaggacagccagctgagaagcctgctgtacttcgagtggctgagccagggctacttcgacccctggggccagggcaccctggtgaccgtgagcagc

SEQ ID NO: 35217 - RNA, 387 nt, synthetic construct
  misc_feature 1..387: note = derived and/or modified sequence opt4 from anti-influenza-A_HeavyChain_V-Region
  source 1..387: mol_type = other RNA
caggtgcagctggtgcagagcggcggcggcgtggtgcagcccggcagaagcctgagactgagctgcgccgccagcggcttcaccttcagcacctacggcatgcactgggtgagacaggcccccggcaagggcctggagtgggtggccgtgatcagctacgacggcaactacaagtactacgccgacagcgtgaagggcagattcaccatcagcagagacaacagcaagaacaccctgtacctggagatgaacagcctgagaaccgaggacaccgccctgtactactgcgccaaggacagccagctgagaagcctgctgtacttcgactggctgagccagggctacttcgaccactggggccagggcaccctggtgaccgtgagcagc

SEQ ID NO: 35218 - RNA, 387 nt, synthetic construct
  misc_feature 1..387: note = derived and/or modified sequence opt4 from anti-influenza-A_HeavyChain_V-Region
  source 1..387: mol_type = other RNA
caggtgcagctggtgcagagcggcggcggcgtggtgccccccggcagaagcctgagactgagctgcgccgccagcggcttcaccttcagcacctacggcatgcactgggtgagacaggcccccggcaagggcctggagtgggtggccgtgatcagctacgacggcaactacaagtactacgccgacagcgtgagaggcagattcaccatcagcagagacaacagcaagaacaccctgaacctggacatgaacagcctgagaaccgaggacaccgccctgtactactgcgccaaggacagccagctgagaagcctgctgtacttcgactggctgagccagggctacttcgaccactggggccagggcaccctggtgaccgtgagcagc

SEQ ID NO: 35219 - RNA, 387 nt, synthetic construct
  misc_feature 1..387: note = derived and/or modified sequence opt4 from anti-influenza-A_HeavyChain_V-Region
  source 1..387: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccgtgatcagctacgacgccaactacaagtactacgccgacagcgtgaagggcagattcaccatcagcagagacaacagcaagaacaccctgtacctgcagatgaacagcctgagagccgaggacaccgccgtgtactactgcgccaaggacagccagctgagaagcctgctgtacttcgagtggctgagccagggctacttcgactactggggccagggcaccctggtgaccgtgagcagc

SEQ ID NO: 35220 - RNA, 387 nt, synthetic construct
  misc_feature 1..387: note = derived and/or modified sequence opt4 from anti-influenza-A_HeavyChain_V-Region
  source 1..387: mol_type = other RNA
caggtgcagctggtggagagcggcggcggcgtggtgcagcccggcagaagcctgagactgagctgcgccgccagcggcttcaccttcagcacctacgccatgcactgggtgagacaggcccccggcaagggcctggagtgggtggccgtgatcagctacgacggcaactacaagtactacgccgacagcgtgaagggcagattcaccatcagcagagacaacagcaagaacaccctgtacctgcagatgaacagcctgagagccgaggacaccgccgtgtactactgcgccaaggacagccagctgagaagcctgctgtacttcgagtggctgagccagggctacttcgacccctggggccagggcaccctggtgaccgtgagcagc

SEQ ID NO: 35221 - RNA, 387 nt, synthetic construct
  misc_feature 1..387: note = derived and/or modified sequence opt4 from anti-influenza-A_HeavyChain_V-Region
  source 1..387: mol_type = other RNA
caggtgcagctggtgcagagcggcggcggcgtggtgcagcccggcagaagcctgagactgagctgcgtggccagcggcttcaccttcagcacctacgccatgcactgggtgagacaggcccccggcagaggcctggagtgggtggccgtgatcagctacgacggcaactacaagtactacgccgacagcgtgaagggcagattcagcatcagcagagacaacagcaacaacaccctgcacctggagatgaacaccctgagaaccgaggacaccgccctgtactactgcgccaaggacagccagctgagaagcctgctgtacttcgagtggctgagccagggctacttcgacccctggggccagggcaccctggtgaccgtgaccagc

SEQ ID NO: 35222 - RNA, 330 nt, synthetic construct
  misc_feature 1..330: note = derived and/or modified sequence opt4 from anti-influenza-A_LightChain_V-Region
  source 1..330: mol_type = other RNA
aacttcatgctgacccagccccccagcgccagcggcacccccggccagagagtgaccatcagctgcagcggcagcagcagcaacatcggcggcaacaccgtgcactggttccagcagctgcccggcaccgcccccaagctgctgatctacaccaacagcctgagacccagcggcgtgcccgacagattcagcggcagcaagagcggcaccagcgccagcctggccatcagcggcctgcagagcgaggacgaggccgactactactgcgccgcctgggacgacagcctgaacggccaggtgttcggcggcggcaccaagctgaccgtgctg

SEQ ID NO: 35223 - RNA, 390 nt, synthetic construct
  misc_feature 1..390: note = derived and/or modified sequence opt4 from anti-influenza-A_HeavyChain_V-Region
  source 1..390: mol_type = other RNA
caggtgcagctgctggagagcggcggcggcgtggtgcagcccggcagaagcctgagactgagctgcgccgccagcggcttcaccttcagcaactacggcatgcactgggtgagacaggcccccggcaagggcctggagtgggtggccatcatcagcttcgacggcagcaagaagtactacgccaacagcgtgaagggcagaagcaccatcagcagagacaacagcaagaacaccctgagcctgcagatgaacagcctgggccccgaggacaccgccctgtactactgcgccaagctgcccagcccctactacttcgacagcagattcgtgtgggtggccgccagcgccttccacttctggggccagggcatcctggtgaccgtgagcagc

SEQ ID NO: 35224 - RNA, 132 nt, synthetic construct
  misc_feature 1..132: note = derived and/or modified sequence opt4 from anti-influenza_Chain
  source 1..132: mol_type = other RNA
aacgtgcccgagtggagctacatcgtggagaaggccaaccccgccaacgacctgtgctaccccggcaacttcaacgactacgaggagctgaagcacctgctgagcagaatcaaccacttcgagaagatccag

SEQ ID NO: 35225 - RNA, 162 nt, synthetic construct
  misc_feature 1..162: note = derived and/or modified sequence opt4 from anti-influenza_Chain
  source 1..162: mol_type = other RNA
agcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 35226 - RNA, 291 nt, synthetic construct
  misc_feature 1..291: note = derived and/or modified sequence opt4 from anti-influenza_Chain
  source 1..291: mol_type = other RNA
atgagcctgctgaccgaggtggagacccccatcagaaacgagtggggctgcagatgcaacggcagcagcgaccccctggccatcgccgccaacatcatcggcatcctgcacctgatcctgtggatcctggacagactgttcttcaagtgcatctacagaagattcaagtacggcctgaagggcggccccagcaccgagggcgtgcccaagagcatgagagaggagtacagaaaggagcagcagagcgccgtggacgccgacgacggccacttcgtgagcatcgagctggag

SEQ ID NO: 35227 - RNA, 300 nt, synthetic construct
  misc_feature 1..300: note = derived and/or modified sequence opt4 from anti-influenza_Chain
  source 1..300: mol_type = other RNA
atgaacaacgccaccttcaactgcaccaacatcaaccccatcacccacatcagaggcagcatcatcatcaccatctgcgtgagcctgatcgtgatcctgatcgtgttcggctgcatcgccaagatcttcatcaacaagaacaactgcaccaacaacgtgatcagagtgcacaagagaatcaagtgccccgactgcgagcccttctgcaacaagagagacgacatcagcacccccagagccggcgtggacatccccagcttcatcctgcccggcctgaacctgagcgagggcacccccaac

SEQ ID NO: 35228 - RNA, 300 nt, synthetic construct
  misc_feature 1..300: note = derived and/or modified sequence opt4 from anti-influenza_Chain
  source 1..300: mol_type = other RNA
gagctgacccagagccccagcagcctgagcgccagcgtgggcgacagcgtgaccatcacctgcagaaccagcgagagaatcagcacctacctgaactggtaccagcagaagcccggcaaggcccccagactgctggtgagcggcgccagcaccctgcagggcggcgtgcccagcagattcagcggcagcggcagcggcaccgccttcaccctgaccatcaacagcctgcagcccgaggacttcgccacctactactgccagcagagctacagcacccccctgaccttcggcggcggcacc

SEQ ID NO: 35229 - RNA, 300 nt, synthetic construct
  misc_feature 1..300: note = derived and/or modified sequence opt4 from anti-influenza_Chain
  source 1..300: mol_type = other RNA
atgacccagagccccagcagcatgagcgtgagcctgggcgacaccgtgagcatcacctgccacgccagccaggacatcagcggccacatcggctggctgcagcagaagcccggcaagagcttcaagggcctgatctaccacggcaccaacctggaggacggcgtgcccagcagattcagcggcagcggcagcggcgccgacttcagcctgaccatcagcagcctggagagcgaggacttcgccgactactactgcgtgcagtacgtgcagttcccctggaccttcggcggcggcaccaag

SEQ ID NO: 35230 - RNA, 306 nt, synthetic construct
  misc_feature 1..306: note = derived and/or modified sequence opt4 from anti-influenza_Chain
  source 1..306: mol_type = other RNA
gacatccaggtgacccagagccccagcagcctgagcgccagcgtgggcgacagagtgaccatcagctgcagagcccagagcctgagcagctacctgcactggtaccagcagaagcccggccagccccccaagctgctgatctacgccgccaccaccctgcagagcggcgtgcccagcagattcagcggcagcggcagcggcaccgacttcaccctgaccatcagcaccttccaggccgaggacgtggccacctactactgccagcagagcagaaccttcggccagggcaccaaggtggagatcaag

SEQ ID NO: 35231 - RNA, 306 nt, synthetic construct
  misc_feature 1..306: note = derived and/or modified sequence opt4 from anti-influenza_Chain
  source 1..306: mol_type = other RNA
gacatccagatgacccagagccccagcagcctgagcgccagcgtgggcgacagagtgaccatcagctgcagagcccagagcctgagcagctacctgcactggtaccagcagaagcccggccagccccccaagctgctgatctacgccgccaccaccctgcagagcggcgtgcccagcagattcagcggcagcggcagcggcaccgacttcaccctgaccatcagcaccttccaggccgaggacgtggccacctactactgccagcagagcagaaccttcggccagggcaccaaggtggagatcaag

SEQ ID NO: 35232 - RNA, 309 nt, synthetic construct
  misc_feature 1..309: note = derived and/or modified sequence opt4 from anti-influenza_Chain
  source 1..309: mol_type = other RNA
gacatccagatcacccagagccccagcagcctgagcgccagcgtgggcgacagagtgaccatcacctgcagaaccagccagagcctgagcagctacctgcactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagagcagaaccttcggccagggcaccaaggtggagatcaag

SEQ ID NO: 35233 - RNA, 309 nt, synthetic construct
  misc_feature 1..309: note = derived and/or modified sequence opt4 from anti-influenza_Chain
  source 1..309: mol_type = other RNA
gacatccagatgacccagagccccagcagcctgagcgccagcgtgggcgacagagtgaccatcacctgcagaaccagccagagcctgagcagctacctgcactggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcagagcagaaccttcggccagggcaccaaggtggagatcaag

SEQ ID NO: 35234 - RNA, 309 nt, synthetic construct
  misc_feature 1..309: note = derived and/or modified sequence opt4 from anti-influenza_Chain
  source 1..309: mol_type = other RNA
gacatccaggtgacccagagccccagcagcctgagcgccagcgtgggcgacagagtgaccatcagctgcagagccagccagagactgaacagctacctgcactggtaccagcagacccccggccaggcccccaagctgctgatctacgccaccagcaccctgcagagcggcgtgagccccagattcagcggcagcggcagcggcaccgacttcaccctgaccatcagcagcctgcagcccgaggacgtggccacctactactgccagctgagcagaaccttcggccacggcaccaaggtggagatcaag

SEQ ID NO: 35235 - RNA, 309 nt, synthetic construct
  misc_feature 1..309: note = derived and/or modified sequence opt4 from anti-influenza_Chain
  source 1..309: mol_type = other RNA
gacatccagatgacccagagccccagcagcctgagcgccagcgtgggcgacagagtgaccatcagctgcagagccagccagagactgaacagctacctgcactggtaccagcagacccccggccaggcccccaagctgctgatctacgccaccagcaccctgcagagcggcgtgagccccagattcagcggcagcggcagcggcaccgacttcaccctgaccatcagcagcctgcagcccgaggacgtggccacctactactgccagctgagcagaaccttcggccacggcaccaaggtggagatcaag

SEQ ID NO: 35236 - RNA, 309 nt, synthetic construct
  misc_feature 1..309: note = derived and/or modified sequence opt4 from anti-influenza_Chain
  source 1..309: mol_type = other RNA
gacatccaggtgacccagagccccagcagcctgagcgccagcgtgggcgacagaatcaccatcagctgcagaaccagccagagcctgagaagctacctgcactggtaccagcagaagcccggcaaggcccccaagctgctgatctacgccagcagcaccctgcagagcggcgtgcccagcagattcagcggcagcggcagcggcaccgacttcaccctgaccatcagcaacctgcagcccgaggacttcgccacctactactgccagctgagcagaaccttcggccagggcaccaaggtggagatcaag

SEQ ID NO: 35237 - RNA, 309 nt, synthetic construct
  misc_feature 1..309: note = derived and/or modified sequence opt4 from anti-influenza_Chain
  source 1..309: mol_type = other RNA
gacatccagatgacccagagccccagcagcctgagcgccagcgtgggcgacagaatcaccatcagctgcagaaccagccagagcctgagaagctacctgcactggtaccagcagaagcccggcaaggcccccaagctgctgatctacgccagcagcaccctgcagagcggcgtgcccagcagattcagcggcagcggcagcggcaccgacttcaccctgaccatcagcaacctgcagcccgaggacttcgccacctactactgccagctgagcagaaccttcggccagggcaccaaggtggagatcaag

SEQ ID NO: 35238 - RNA, 309 nt, synthetic construct
  misc_feature 1..309: note = derived and/or modified sequence opt4 from anti-influenza_Chain
  source 1..309: mol_type = other RNA
gacatccagatgacccagagccccagcagcctgagcgccagcgtgggcgacagagtgaccatcacctgcagaaccagccagagcctgagcagctacacccactggtaccagcagaagcccggcaaggcccccaagctgctgatctacgccgccagcagcagactgagcggcgtgcccagcagattcagcggcagcggcagcggcaccgacttcaccctgaccatcagcagcctgcagcccgaggacttcgccacctactactgccagcagagcagaaccttcggccagggcaccaaggtggagatcaag

SEQ ID NO: 35239 - RNA, 309 nt, synthetic construct
  misc_feature 1..309: note = derived and/or modified sequence opt4 from anti-influenza_Chain
  source 1..309: mol_type = other RNA
gacatccagatgacccagagccccagcagcctgagcgccagcgtgggcgacagagtgaccatcacctgcagaaccagccagagcctgagcagctacacccactggtaccagcagaagcccggcaaggcccccaagctgctgatctacgccgccagcagcagaggcagcggcgtgcccagcagattcagcggcagcggcagcggcaccgacttcaccctgaccatcagcagcctgcagcccgaggacttcgccacctactactgccagcagagcagaaccttcggccagggcaccaaggtggagatcaag

SEQ ID NO: 35240 - RNA, 309 nt, synthetic construct
  misc_feature 1..309: note = derived and/or modified sequence opt4 from anti-influenza_Chain
  source 1..309: mol_type = other RNA
gacatccagatgacccagagccccagcagcctgagcgccagcgtgggcgacagagtgaccatcacctgcagaaccagccagagcctgagcagctacgaccactggtaccagcagaagcccggcaaggcccccaagctgctgatctacgccgccagcagcagactgagcggcgtgcccagcagattcagcggcagcggcagcggcaccgacttcaccctgaccatcagcagcctgcagcccgaggacttcgccacctactactgccagcagagcagaaccttcggccagggcaccaaggtggagatcaag

SEQ ID NO: 35241 - RNA, 318 nt, synthetic construct
  misc_feature 1..318: note = derived and/or modified sequence opt4 from anti-influenza_Chain
  source 1..318: mol_type = other RNA
gagatcgtgatgacccagagccccgacaccctgagcgtgagccccggcgagagagccaccctgagctgcagagccagccagagcgtgaacagaagactggcctggtaccagcagaagcccggccaggcccccagactgctgatccacgacgccagcaccagagccaccggcatccccgccagattcagcggcagcggcagcggcaccgagttcaccctgaccatcagcagcctgcagagcgaggacttcgccgtgtactactgccagcagtacgacaactggctgagcttcggccagggcaccagactggagatcaag

SEQ ID NO: 35242 - RNA, 318 nt, synthetic construct
  misc_feature 1..318: note = derived and/or modified sequence opt4 from anti-influenza_Chain
  source 1..318: mol_type = other RNA
gacatccagctgacccagagccccagcagcctgagcgccagcgtgggcgacagagtgaccatcacctgcagagccagccagggcatcctgaactgcctggcctggtaccagcagaagcccggcaaggtgcccaacctgctgatgtacgccgccagcaccctgcagagcggcgtgcccagcagattcagcggcagcggcttcggcaccgacttcaccctgaccatcagcagcctgcagcccgaggacgtggccacctactactgccagacctacggcggcgtgagcaccttcggcggcggcaccaaggtggagatcaga

SEQ ID NO: 35243 - RNA, 318 nt, synthetic construct
  misc_feature 1..318: note = derived and/or modified sequence opt4 from anti-influenza_Chain
  source 1..318: mol_type = other RNA
agctacgtgctgacccagccccccagcgtgagcgtggcccccggccagaccgccagaatcagctgcggcggcagcaacatcggcggcaagagcgtgcactggtaccagcagaagcccggccaggcccccgtgctggtggtgtacgacgacagcggcagacccagcggcatccccgagagattcagcggcagcaacagcggcgacaccgccaccctgaccatcagcagagtggaggccggcgacgaggccgactacttctgccaggtgtgggacaacttcggcggcgtgttcggcaccggcaccaaggtgaccgtgctg

SEQ ID NO: 35244 - RNA, 318 nt, synthetic construct
  misc_feature 1..318: note = derived and/or modified sequence opt4 from anti-influenza_Chain
  source 1..318: mol_type = other RNA
gacatccagatgacccagagccccagcagcctgagcgccagcgtgggcgacagagtgaccatcacctgcagaaccagccagagcatcagcagctacctgaactggtaccagcagaagcccggcaaggcccccaagctgctgatctacgccgccagcagcctgcagagcggcgtgcccagcagattcagcggcagcggcagcggcaccgacttcaccctgaccatcagcggcctgcagcccgaggacttcgccacctactactgccagcagagctacagcatgcccgccttcggccagggcaccaagctggagatcaag

SEQ ID NO: 35245 - RNA, 318 nt, synthetic construct
  misc_feature 1..318: note = derived and/or modified sequence opt4 from anti-influenza_Chain
  source 1..318: mol_type = other RNA
gacatccagatgacccagagccccctgagcgtgagcgtgagcgtgggcgacagagtgaccatcgcctgcagagccagccagagcatcgacaagttcctgaactggtaccagcagaagcccggcaaggcccccaagctgctgatctacggcgccagcaacctgcacagcggcgcccccagcagattcagcgccagcggcagcggcaccgacttcaccctgaccatcaccaacatccagaccgaggacttcgccacctacctgtgccagcagagcttcagcgtgcccgccttcggcggcggcaccaaggtggagatcaag

SEQ ID NO: 35246 - RNA, 318 nt, synthetic construct
  misc_feature 1..318: note = derived and/or modified sequence opt4 from anti-influenza_Chain
  source 1..318: mol_type = other RNA
gacatccagatgacccagagccccagcagcctgagcgccagcgtgggcgacagagtgaccatcacctgcagagccagccagagcatcagcacctacctgaactggtaccagaagagacccggcaaggcccccaagctgctggtgtacggcgccagcaccctgcagagcggcgtgcccagcagattcagcggcagcggcagcggcaccgacttcaccctgaccatcgccagcctgcagcccgaggacagcgccacctactactgccagcagacctacagcatccccctgttcggccagggcaccagactggagatcaag

SEQ ID NO: 35247 - RNA, 318 nt, synthetic construct
  misc_feature 1..318: note = derived and/or modified sequence opt4 from anti-influenza_Chain
  source 1..318: mol_type = other RNA
gacatccagatgacccagagccccagcagcctgagcgccagcgtgggcgacagagtgaccatcacctgcagagccagccagagcatcagcacctacctgaactggtaccagaagagacccggcaaggcccccaagctgctggtgtacggcgccagcagcctgcagagcggcgtgcccagcagattcagcggcagcggcagcggcaccgacttcaccctgaccatcgccagcctgcagcccgaggacagcgccgtgtactactgccagcagacctacagcatccccctgttcggccagggcaccagactggagatcaag

SEQ ID NO: 35248 - RNA, 318 nt, synthetic construct
  misc_feature 1..318: note = derived and/or modified sequence opt4 from anti-influenza_Chain
  source 1..318: mol_type = other RNA
gacatccagatgacccagagccccagcagcctgagcgccagcgtgggcgacagagtgaccatcacctgcagagccagccagagcatcagcagatacctgaactggtaccagcagaagcccggcaaggcccccaagctgctgatctacggcgccagcaccctgcagaacggcgcccccagcagattcagcggcagcggcagcggcaccgacttcaccctgaccatcagcagcctgcagcccgaggacagcgccacctacctgtgccagcagagctacagcgtgcccgccttcggcggcggcaccaaggtggaggtgaag

SEQ ID NO: 35249 - RNA, 318 nt, synthetic construct
  misc_feature 1..318: note = derived and/or modified sequence opt4 from anti-influenza_Chain
  source 1..318: mol_type = other RNA
ggcatccagatgacccagagccccagcagcctgagcgccagcgtgggcgacagagtgaccatcacctgcagagccagccagagcatcagcagatacctgaactggtacctgcagaagcccggcaaggcccccaagctgctgatcagcggcgccagcagcctgcagagcggcgtgcccagcagattcagcggcaccggcagcggcaccgagttcaccctgaccatcagcagcctgcagcccgaggacttcgccacctactactgccagcagaccttcagcatccccctgttcggccagggcaccaaggtggagatcaag

SEQ ID NO: 35250 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgagcatcacctgccaggccagccaggacatcagcagatacctgaactggtaccagcagaagcccggcgaggcccccaagctgctgatctacgacgccagcaacctggagaccggcgtgcccagcagattcagcggcagcggcagcggcaccgacttcaccttcaccatcagcagcctgcagcccgaggacatcgccacctacttctgccagcagtacggctacctgcccctgaccttcggccccggcaccaaggtggacagcaag

SEQ ID NO: 35251 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcttcagcgtgagcctgggcgacagagtgaccatcacctgcaaggccagcgaggacatctacaacagactggcctggtaccagcagaagcccggcaacgcccccagactgctgatcagcgacaccaccaacctgtggatcggcgtgcccagcagattcagcggcagcggcagcggcaaggactacaccctgagcatcaccagcctgcagagcgaggacgtggccacctactactgccagcagtactggagcagcagaaccttcggcggcggcaccaagctggagatcaagaga

SEQ ID NO: 35252 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcttcagcgtgagcctgggcgacagagtgaccatcacctgcaaggccagcgaggacatctacaacagagtggcctggtaccagcagaagcccggcaacgcccccagactgctgatgagcgacgccaccagcctgggcgccggcgtgcccagcagattcagcggcagcggcagcggcaaggaccacaccctgagcatcaccagcctgcagaccgaggacgtggccacctactactgccagcagtactggaacaccagaaccttcggcggcggcaccaagctggagatcaagaga

SEQ ID NO: 35253 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccagccagagcatcagcacctacctgaactggtaccagcagaagcccggcatcccccccaagctgctgatcaacgtggccagcagcctgcagagcggcgtgcccagcagattcagcggcagcggcagcggcaccgacttcaccctgaccatcagcagcctgcagcccgaggacttcgccagctactactgccagcagacctacagcagcccccccaccttcggccagggcaccaaggtggagatcaag

SEQ ID NO: 35254 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcaccctgagcggcagcgtgggcgacagagtgaccatcacctgcagagccagccagaacatcggcccctggctggcctggtaccagcaggagagcggcaaggcccccaagctgctgatcagcagagccagcatcctggagagcggcgtgcccagcagattcagcggcaccggcaccggcaccgagttcaccctgaccatcagcagcctgcagcccgacgacttcgccacctactactgccagcactacaacgcctactggggcaccttcggccagggcaccaaggtggagatcaac

SEQ ID NO: 35255 - RNA, 321 nt, synthetic construct
  misc_feature 1..321: note = derived and/or modified sequence opt4 from anti-influenza_Chain
  source 1..321: mol_type = other RNA
gtgatctggatgacccagagccccagcctgctgagcgccagcaccggcgacagagtgaccatcagctgcagaatgagccagggcatcagcagctacctggcctggtaccagcagaagcccggcaaggcccccgagctgctgatccacaccgcctacaccctgaagagcggcgtgcccagcagattcagcggcagcggcagcggcaaggacttcaccctgaccatcagcggcctgcagagcgaggacttcgccacctactactgccagcagtactacagcttcccctacaccttcggccagggcaccaaggtggagatcaag

SEQ ID NO: 35256 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcgtgagcgccagcgtgggcgacagagtgaccatcacctgcagagccagccaggacgtgagcacctggctggcctggtaccagctgaagcccggcaaggcccccaagctgctgatctacgccgccagcagcctgcagagcggcgtgcccagcagattcagcggcagcggcagcggcaccgacttcaccctgaccgtgagcagcctgcagcccgaggacttcgccacctactactgccagcaggccaacagcttccccttcaccttcggccccggcaccaaggtggacatcaag

SEQ ID NO: 35257 - RNA, 321 nt, synthetic construct
  misc_feature 1..321: note = derived and/or modified sequence opt4 from anti-influenza_Chain
  source 1..321: mol_type = other RNA
gacatccagctgacccagagccccagcttcctgagcgccagcgtgggcgacggcgtgaccatcacctgcagagccagccaggacatctacatctacctggcctggtaccagcagaagcccggcaaggcccccaagctgctgatctacgccgccagcaccctgcagggcggcgtgcccagcagattcagcggcagcggcagcggcaccgagttcaccctgaccatcaacaacctgcagcccgaggacttcgccacctacttctgccagcagctgaacggctaccccctgaccttcggcggcggcaccaaggtggagatcaag

SEQ ID NO: 35258 - RNA, 321 nt, synthetic construct
  misc_feature 1..321: note = derived and/or modified sequence opt4 from anti-influenza_Chain
  source 1..321: mol_type = other RNA
gacatccagctgacccagagccccagcagcctgagcgccagcgtgggcgacagagtgaccctgacctgccaggccagccaggacatcagaaagttcctgaactggtaccagcagaagcccggcaagggccccaagctgctgatctacgacgccagcaacctgcagagaggcgtgcccagcagattcagcggcggcggcagcggcaccgacttcaccctgatcatcagcagcctgcagcccgaggacgtgggcacctactactgccagcagtacgacggcctgcccttcaccttcggcggcggcaccaagctggagatcaag

SEQ ID NO: 35259 - RNA, 321 nt, synthetic construct
  misc_feature 1..321: note = derived and/or modified sequence opt4 from anti-influenza_Chain
  source 1..321: mol_type = other RNA
gacatccagctgacccagagccccagcagcctgagcgccagcatcggcgacagagtgaccatcacctgccaggccagccaggacatcagaaacagcctgaactggtacgagcacaagcccggcaaggcccccaagctgctgatccacgacgccagcaacctggagaccggcgtgcccagcagattcagcggcggcggcagcggcaccgacttcaccctgaccatcagcagcctgcagcccgaggacttcgccacctactactgccagcaggccaacagcttccccctgaccttcggcggcggcaccaaggtggagatcaag

SEQ ID NO: 35260 - RNA, 321 nt, synthetic construct
  misc_feature 1..321: note = derived and/or modified sequence opt4 from anti-influenza_Chain
  source 1..321: mol_type = other RNA
gacatccagctgacccagagccccagcagcctgagcgccagcgtgggcgacagagtgaccatcacctgcagagccagccagggcatcagaaacgacctgggctggtaccagcagaagcccggcaacgcccccaagagactgatcttcggcgccagcagcctgcagagcggcgtgcccagcagattcagcggcagcggcagcggcaccgagttcaccctgaccatcagcagcctgcagcccgaggacttcgccacctactactgcctgcagcacaacagctacccctacaccttcggccagggcaccaagctggagatcaag

SEQ ID NO: 35261 - RNA, 321 nt, synthetic construct
  misc_feature 1..321: note = derived and/or modified sequence opt4 from anti-influenza_Chain
  source 1..321: mol_type = other RNA
gacatccagctgacccagagccccagcagcctgagcgccagcgtgggcgacagagtgaccatcacctgcagagccagccagagcatcagcagatacctgaactggtaccagcagaagcccggcaaggcccccaagctgctgctgttcgccgccagcaccctgctggacggcgtgcccagcagattcagcggcagcggcagcggcaccgacttcaccctgaccatcagcagcctgcagcccgaggacttcgccacctactactgccagagaaaccacagccccagctggaccttcggccagggcaccagagtggagatcaag

SEQ ID NO: 35262 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatgacctgcagagccagccagaacatcagaagctacctgaactggtaccagcagagacccggcaccgcccccaagctgctgatctacgccgccagcaccctgcacagcggcgtgcccagcagattcagcggcggcggcagcggcaccgacttcaccctgaccatcaacaacctgcagcccgaggacttcgccagctactactgccagcagagctacgacaacccccagaccttcggccagggcaccaaggtggagatcaag

SEQ ID NO: 35263 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccaaccaggacatcggcatctacctgaactggtaccagcagaaccccggcaaggtgcccaagctgctgctgcacggcgccagcagcctgcagggcggcgtgcccagcagattcagcgccagcggcagcggcaccgacttcaccctgaccatccacagcctgcagcccgaggacctggccacctactactgccagcagagcagaagactgccctacaccttcggccagggcaccagagtggagctgaag

SEQ ID NO: 35264 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcaccctgagcgccagcatcggcgacagagtgaccatcacctgcagagccagccagagcatcgccagctggctggcctggtaccagcagaagcccggcaaggcccccaagctgctgatctacgaggccgtgaacctggagagcggcgtgcccagcagattcagcggcagcggcagcggcaccgacttcaccctgaccatcagcagcctgcagcccgacgacttcgccacctacttctgccagcactacggcaccatcagccagaccttcggcggcggcaccaaggtggagatcaag

SEQ ID NO: 35265 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccagccagagcatcagcagctacctgaactggtaccagcacaagcccggcaaggcccccaaggtgctgatgtacgccgtgagcatcctgcagagcggcgtgcccagcagattcagcggcagcggcagcggcgccgacttcaccctgaccatcagcagcctgcagcccgaggacttcgccacctactactgccagcagagctacagcagccccctgaccttcggcggcggcaccaaggtggagatcaag

SEQ ID NO: 35266 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccagccagaacatcaagagatacttcaactggtaccagcagaagcccggcaaggcccccaagctgctgatctacgccgccagcaacctggagaacggcgtgcccagcagattcagcggcagcggcagcggcaccgacttcaccctgaccatcagcagcctgcagcccgaggacttcgccacctactactgccagcagagcttcagcaagagctggaccttcggccagggcaccaacgtggacatcaag

SEQ ID NO: 35267 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccagccagaacatctacaagtacctgaactggtaccagcagagacccggcaaggcccccaagggcctgatcagcgccgccagcggcctgcagagcggcgtgcccagcagattcagcggcagcggcagcggcaccgacttcaccctgaccatcaccagcctgcagcccgaggacttcgccacctactactgccagcagagctacagcccccccctgaccttcggcggcggcaccagagtggagatcaag

SEQ ID NO: 35268 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcagcagcgtgggcgacagagtgaccatcacctgcagagccagccagagcatcggcgcctacgtgaactggtaccagcagaaggccggcaaggccccccaggtgctgatcttcggcgccagcaacctgcagagcggcgtgcccagcagattcagcggcagcggcagcggcaccgacttcaccctgaccatcagcagcctgcagcccgaggacttcgccacctacttctgccagcagacctacagcacccccatcaccttcggccagggcaccagactggagatcaag

SEQ ID NO: 35269 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcagctgcagagccagccagagcatcagcacctacctgaactggtaccagcagcagcccggcaaggcccccaaggtgctgatcttcggcgccaccaacctgcagagcggcgtgcccagcagattcagcggcagcggcagcggcaccgacttcaccctgaccatcagcagcctgcagcccgaggacttcgccacctactactgccagcagagctacaacacccccctgatcttcggccagggcaccaagctggagatcaag

SEQ ID NO: 35270 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcagctgcagagccagccagagcatcagcacctacctgaactggtaccagcagcagcccggcaaggcccccaaggtgctgatcagcggcgccaccaacctgcagagcggcgtgcccagcagattcagcggcagcggcagcggcaccgacttcaccctgaccatcagcagcctgcagcccgaggacttcgccacctactactgccagcagagctacaacacccccctgatcttcggccagggcaccaagctggagatcaag

SEQ ID NO: 35271 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagactgaccatcacctgcagagccagccagagcatcagcacctacctgcactggtaccagcagaagcccggcaaggcccccaagctgctgatctacgccgccagcagcctgcagagcggcgtgcccagcagattcagcggcagcagaagcggcaccgacttcaccctgaccatcagcagcctgcagcccgacgacttcgccacctactactgccagcagagctacagcccccccctgaccttcggccccggcaccaaggtggacatgaag

SEQ ID NO: 35272 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccagccagagcatcagcaactacctgaactggtaccagcacaagcccggcgaggcccccaagctgctgaactacgccgccagcagcctgcagagcggcgtgcccagcagattcagcgccagcggcagcggcaccgacttcaccctgaccatcagcagcctgcagcccgaggacttcgccacctactactgccagcagagctacaacacccccatcaccttcggccagggcaccagactggagatcaag

SEQ ID NO: 35273 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccagccagagcatcagcaactacctgaactggtaccagcacaagcccggcgaggcccccaagctgctgaactacgccgccagcagcctgcagagcggcgtgcccagcagattcagcgccagcggcagcggcaccgacttcaccctgagcatcagcggcctgcagcccgaggacttcgccacctactactgccagcagagctacaacacccccatcaccttcggccccggcaccagactggagatcaag

SEQ ID NO: 35274 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccagccagagcatcagcacctacctgaactggtaccagcagaagcccggcaaggcccccaagctgctgatctacgccgccagcagcctgcacagcggcgtgcccagcagattcagcggcagcggcagcggcaccgacttcgccctgaccatcagcagcctgcagcccgaggacttcgccacctactactgccagcagagctacagcccccccatcaccttcggccagggcaccagactggagatcaag

SEQ ID NO: 35275 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcacctgcagagccagccagaccatcagcacctacctgaactggtaccagcagaagagcggcaaggcccccaagctgctgatctacgccgccagcggcctgcagagcggcgtgcccagcagattcagcggcagcggcagcggcaccgacttcaccctgaccatcagcagcctgcagcccgaggacttcgccacctacttctgccagcagagctacaacacccccctgaccttcggccagggcaccaaggtggagatcaag

SEQ ID NO: 35276 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcctgagcgccagcgtgggcgacagagtgaccatcagctgcagagccagccagagcatcagcacctacctgaactggtaccagcagcagcccggcaaggcccccaaggtgctgatcagcggcgccaccgacctgcagagcggcgtgcccagcagattcagcggcagcggcagcggcaccgacttcaccctgaccatcagcagcctgcagcccgaggacttcgccacctactactgccagcagagctacaacacccccctgatcttcggccagggcaccaagctggagatcaag

SEQ ID NO: 35277 - RNA, 321 nt, synthetic construct
  misc_feature 1..321: note = derived and/or modified sequence opt4 from anti-influenza_Chain
  source 1..321: mol_type = other RNA
gacatccaggtgacccagagccccagcagcctgagcgccagcgtgggcgacagagtgaccatcacctgcagagccagccagaacatctacaagtacctgaactggtaccagcagagacccggcaaggcccccaagggcctgatcagcgccgccagcggcctgcagagcggcgtgcccagcagattcagcggcagcggcagcggcaccgacttcaccctgaccatcaccagcctgcagcccgaggacttcgccacctactactgccagcagagctacagcccccccctgaccttcggcggcggcaccagagtggacatcaag

SEQ ID NO: 35278 - RNA, 321 nt, synthetic construct
  misc_feature 1..321: note = derived and/or modified sequence opt4 from anti-influenza_Chain
  source 1..321: mol_type = other RNA
cagagcgtgctgacccagccccccagcgagagcgtgagccccggccagaccgccagcgtgacctgcagcggccacaagctgggcgacaagtacgtgagctggtaccagcagaagcccggccagagccccgtgctgctgatctaccaggacaacagaagacccagcggcatccccgagagattcatcggcagcaacagcggcaacaccgccaccctgaccatcagcggcacccaggccctggacgaggccgactactactgccaggcctgggacagcagcaccgccgtgttcggcggcggcaccaagctgaccgtgctgggc

SEQ ID NO: 35279 - RNA, 321 nt, synthetic construct
  misc_feature 1..321: note = derived and/or modified sequence opt4 from anti-influenza_Chain
  source 1..321: mol_type = other RNA
gacatccagctgacccagagccccagcagcctgagcgccagcgtgggcgacagagtgaccatcacctgcagagccagccagggcatcagcacctacctggcctggtaccagcagaagcccggcaaggtgcccaagctgctgatctacgccgccagcaccctgcagagcggcgtgcccagcagattcagcggcagcggcagcggcaccgacttcaccctgaccatcagcagcctgcagcccgaggacgtggccacctactactgccagaagtacaacagcgcccccagcttcggccccggcaccaaggtggacatcaagaga

SEQ ID NO: 35280 - RNA, 321 nt, synthetic construct
  misc_feature 1..321: note = derived and/or modified sequence opt4 from anti-influenza_Chain
  source 1..321: mol_type = other RNA
agcgtgctgacccagccccccagcgccagcggcagcagaggccagagcatcaccatcagctgcaccggcagcaccagcgacatcggcagctacaactacgtgagctggtaccagcagcaccccggcaccgcccccaaggtgatcctgtacgaggtgagccagagacccagcggcgtgcccgacagattcagcggcagcaagagcggcaacaccgccttcctgaccgtgagcggcctgcaggccgaggacgaggccgactactactgcgccagctacgccggcaacaacatctacgtgttcggcagcggcaccaaggtgacc

SEQ ID NO: 35281 - RNA, 321 nt, synthetic construct
  misc_feature 1..321: note = derived and/or modified sequence opt4 from anti-influenza_Chain
  source 1..321: mol_type = other RNA
agcgccctgacccagccccccagcgccagcggcagcagaggccagagcatcaccatcagctgcaccggcagcaccagcgacatcggcagctacaactacgtgagctggtaccagcagcaccccggcaccgcccccaaggtgatcctgtacgaggtgagccagagacccagcggcgtgcccgacagattcagcggcagcaagagcggcaacaccgccttcctgaccgtgagcggcctgcaggccgaggacgaggccgactactactgcgccagctacgccggcaacaacatctacgtgttcggcagcggcaccaaggtgacc

SEQ ID NO: 35282 - RNA, 321 nt, synthetic construct
  misc_feature 1..321: note = derived and/or modified sequence opt4 from anti-influenza_Chain
  source 1..321: mol_type = other RNA
gagatcgtgctgacccagagccccgccaccctgagcctgagccccggcgagagagccaccctgagctgcagagccagccagagcgtgagcaccttcctggcctggtaccagcagaagcccggccaggcccccagactgctgatgtacgacgccagcaacagagccaccggcatccccgccagattcagcggcagcggcagcggcaccgacttcaccctgaccatcagcagcctggagcccgaggacttcgccatctactactgccagcagagaagccactggccccccatcttcggccagggcaccagactggagatcaag

SEQ ID NO: 35283 - RNA, 321 nt, synthetic construct
  misc_feature 1..321: note = derived and/or modified sequence opt4 from anti-influenza_Chain
  source 1..321: mol_type = other RNA
gacatccagatgacccagagccccgccagcctgagcgtgagcgtgggcgagaccgtgaccatcacctgcagagccagcgagaagatctacagcaacctggcctggtaccagcagaaggagggcaagagcccccagctgctggtgtacgccgccatcagactggccgacggcgtgcccagcagattcagcggcagcggcagcggcacccagttcagcctgaagatcaacagcctgcagagcgaggacttcggcacctactactgccagcacttctggggcacccccctgaccttcggcgccggcaccaagctggagctgaag

SEQ ID NO: 35284 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcgtgagcgccagcgtgggcgacagagtgaccatcacctgcagagccagccaggacatcagcacctggctggcctggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctacttctgccagcaggccaacagcttcccccccaccttcggccagggcaccaagctggagatcaag

SEQ ID NO: 35285 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcgtgagcgccagcgtgggcgacagagtgaccatcacctgcagagccagccaggacatcagcacctggctggcctggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctacttctgccagcaggccaacagcttcccccccaccttcggctgcggcaccaagctggagatcaag

SEQ ID NO: 35286 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcgtgagcgccagcgtgggcgacagagtgaccatcacctgcagagccagccaggacatcagcacctggctggcctggtaccagcagaagcccggcaagtgccccaagctgctgatctacgccgccagcagcctgcagagcggcgtgcccagcagattcagcggcagcggcagcggcaccgacttcaccctgaccatcagcagcctgcagcccgaggacttcgccacctacttctgccagcaggccaacagcttcccccccaccttcggccagggcaccaagctggagatcaag

SEQ ID NO: 35287 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcgtgagcgccagcgtgggcgacagagtgaccatcacctgcagagccagccaggacatcagcacctggctggcctggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcaggccaacagcttcccccccaccttcggccagggcaccaagctggagatcaag

SEQ ID NO: 35288 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcgtgagcgccagcgtgggcgacagagtgaccatcacctgcagagccagccaggacatcagcacctggctggcctggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctactactgccagcaggccaacagcttcccccccaccttcggctgcggcaccaagctggagatcaag

SEQ ID NO: 35289 - RNA, 321 nt, synthetic construct
  misc_feature 1..321: note = derived and/or modified sequence opt4 from anti-influenza_Chain
  source 1..321: mol_type = other RNA
gacatccagatgacccagagccccagcagcgtgagcgccagcgtgggcgacagagtgaccatcacctgcagagccagccaggacatcagcacctggctggcctggtaccagcagaagcccggcaagtgccccaagctgctgatctacgccgccagcagcctgcagagcggcgtgcccagcagattcagcggcagcggcagcggcaccgacttcaccctgaccatcagcagcctgcagcccgaggacttcgccacctactactgccagcaggccaacagcttcccccccaccttcggccagggcaccaagctggagatcaag

SEQ ID NO: 35290 - RNA, 321 nt, synthetic construct
  misc_feature 1..321: note = derived and/or modified sequence opt4 from anti-influenza_Chain
  source 1..321: mol_type = other RNA
gagatcgtgctgacccagagccccgccaccctgagcctgagccccggcgagagagccaccctgagctgcagagccagcagaagcatcaccaccttcctggcctggtaccagcagaagcccggccaggcccccagactgctgatctacgacgccagcaacagagccaccggcgtgcccgccagattcagcggcagcggcagcggcaccgacttcaccctgaccatcaacagcctggagcccgacgacttcgccatctactactgccagcagagagaccactggccccccatcttcggccagggcaccagactggagatcaag

SEQ ID NO: 35291 - RNA, 321 nt, synthetic construct
  misc_feature 1..321: note = derived and/or modified sequence opt4 from anti-influenza_Chain
  source 1..321: mol_type = other RNA
gagatcgtgctgacccagagccccgccaccctgagcctgagccccggcgagagagccaccctgagctgcagagccagcagaagcatcaccaccttcctggcctggtaccagcagaagcccggccaggcccccagactgctgatctacgacgccagcaacagagccaccggcgtgcccgccagattcagcggcagcggcagcggcaccgacttcaccctgaccatcaacagcctggagcccgacgacttcgccatctactactgccagcagagagaccactggccccccatcttcggctgcggcaccagactggagatcaag

SEQ ID NO: 35292 - RNA, 324 nt, synthetic construct
  misc_feature 1..324: note = derived and/or modified sequence opt4 from anti-influenza_Chain
  source 1..324: mol_type = other RNA
gagatcgtgctgacccagagccccggcaccctgagcctgagccccggcgagagagccaccctgagctgcagagccagccagaccgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcaacagcccctacaccttcggccagggcaccaagctggagatcaag

SEQ ID NO: 35293 - RNA, 324 nt, synthetic construct
  misc_feature 1..324: note = derived and/or modified sequence opt4 from anti-influenza_Chain
  source 1..324: mol_type = other RNA
gagatcgtgctgacccagagccccggcaccctgagcgtgagccccggcgagagagccaccctgagctgcagagccagccagagcatcagcagcggctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcaccagcccccagaccttcggccagggcaccaaggtggagatcaag

SEQ ID NO: 35294 - RNA, 324 nt, synthetic construct
  misc_feature 1..324: note = derived and/or modified sequence opt4 from anti-influenza_Chain
  source 1..324: mol_type = other RNA
gaggtggtgctgacccagagccccggcaccctgagcctgagccccggccagagagccaccctgagctgcagagccagccagagcgtgagcagcagctacctggcctggtaccagcagaagcccggccaggcccccagactgctgatctacgacgccagcaacagagccaccggcatccccgacagattcagcggcagcggcagcggcaccgacttcaccctgaccatcagcagactggagcccgaggacttcgccgtgtactactgccagcagtacggcagcagcccctacaccttcggccagggcaccaagctggagatcaag

SEQ ID NO: 35295 - RNA, 324 nt, synthetic construct
  misc_feature 1..324: note = derived and/or modified sequence opt4 from anti-influenza_Chain
  source 1..324: mol_type = other RNA
gacatccagctgacccagagccccagcagcctgagcgccagcgtgggcgacagagtgaccatcacctgcagagccagccagggcatcatcacctacctgaactggtaccagcagaagcccggcaaggcccccaagctgctgatctacgccacctacagcctgcagaacggcgtgcccagcagattcagcggcagcggcagcggcaccgacttcaccctgaccatcagcagcctgcagcccgaggacttcgccacctactactgccagcagagctacagcagcctgatgttcaccttcggccagggcaccaagctggacatcaag

SEQ ID NO: 35296 - RNA, 324 nt, synthetic construct
  misc_feature 1..324: note = derived and/or modified sequence opt4 from anti-influenza_Chain
  source 1..324: mol_type = other RNA
gagaccgtgctgacccagagccccggcaccctgagcctgacccccggcgagagagccaccctgagctgcagagtgggccagagcgtgagcggcagccacctggcctggtaccagcagaagcccggccaggcccccagactgctgatctacggcgccagcagcagagccaccggcatccccgacagattcggcggcagcgtgagcggcaccgacttcaccctgaccatcagcagactggagcccgaggacagcgccgtgtactactgccagcagtacggcgacagcagatacaccttcggccagggcaccaagctggagatcaag

SEQ ID NO: 35297 - RNA, 324 nt, synthetic construct
  misc_feature 1..324: note = derived and/or modified sequence opt4 from anti-influenza_Chain
  source 1..324: mol_type = other RNA
gagatcgtgctgacccagagccccggcaccctgagcctgagccccggcgagagagccaccctgagctgcagagccagccagagcgtgagcagcagccagctggcctggtaccagcagaagcccggccaggcccccagactgatcatctacggcgccagcaccagagccaccggcatccccgacagattcagcggcagcggcagcggcaccgacttcaccctgaccatcggcagactggagcccgaggacttcgccgtgttcttctgccagcagtacagcaccagcccccccaccttcggccagggcaccaaggtggacttcaag

SEQ ID NO: 35298 - RNA, 324 nt, synthetic construct
  misc_feature 1..324: note = derived and/or modified sequence opt4 from anti-influenza_Chain
  source 1..324: mol_type = other RNA
gacatcgtgctgacccagagccccggcaccctgagcctgagccccggcgagagagccaccctgagctgcagagccagccagagcgtgagcagcagctacctggcctggtaccagcagaagcccggccaggcccccagactggtgatgtacggcgccgccaccagagccaccggcatccccgacagattcagcggcagcggcagcggccccgacttcaccctgaccatcagcagactggagcccgaggacttcgccatgtactactgccagcagtacggcaacagccccatcaccttcggccagggcaccagactggagatcaag

SEQ ID NO: 35299 - RNA, 324 nt, synthetic construct
  misc_feature 1..324: note = derived and/or modified sequence opt4 from anti-influenza_Chain
  source 1..324: mol_type = other RNA
gagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagccactggccccccatcaccttcggccagggcaccagactggagatcaag

SEQ ID NO: 35300 - RNA, 324 nt, synthetic construct
  misc_feature 1..324: note = derived and/or modified sequence opt4 from anti-influenza_Chain
  source 1..324: mol_type = other RNA
agctacgagctgacccagccccccagcgtgagcgtgagccccggccagaccgccagaatcacctgcagcggcgacgccctgcccaagcagaacgcctactggtaccagcagaagcccggccaggcccccgtgctgctgatctacaaggacagcgagagacccagcggcatccccgagagattcagcggcagcagcagcggcaccaccgtgaccctgaccatcagcggcgtgcaggccgaggacgaggccgactactactgccagagcgccgacagcagcggcaccagctgggtgttcggcggcggcaccaagctgaccgtgctg

SEQ ID NO: 35301 - RNA, 324 nt, synthetic construct
  misc_feature 1..324: note = derived and/or modified sequence opt4 from anti-influenza_Chain
  source 1..324: mol_type = other RNA
agctacgtgctgacccaggcccccagcgtgagcgtggcccccggccagaccgccagaatcacctgcggcggcaacgccatcggcagcaagaaggtgcactggtaccagcacaaggccggccaggcccccgtgctggtggtgtacgacgacaccgacagacccagcggcatccccgagagattcagcggcagcaacagctggagcaccgccaccctgaccatcaacagagtggaggccggcgacgaggccgactactactgccaggtgtgggacttcaccatcgaccacgtggtgttcggcggcggcaccaagctgaccgtgctg

SEQ ID NO: 35302 - RNA, 324 nt, synthetic construct
  misc_feature 1..324: note = derived and/or modified sequence opt4 from anti-influenza_Chain
  source 1..324: mol_type = other RNA
gagatcgtgctgacccagagccccggcaccctgagcctgagccccggcgagagagccaccctgagctgcagagccagccagagcgtgagcagcagctacctggcctggtaccagaagaagcccggccaggcccccagactgctgatctacggcgccagcaccagagccaccggcatccccgacagattcaccggcagcggcagcggcaccgacttcaccctgagcatcagcagactggagcccgaggacttcgccgtgtactactgccagcacttcggcaccagcgtgttcaccttcggcggcggcaccaaggtggagatcaag

SEQ ID NO: 35303 - RNA, 324 nt, synthetic construct
  misc_feature 1..324: note = derived and/or modified sequence opt4 from anti-influenza_Chain
  source 1..324: mol_type = other RNA
gagatcgtgatgacccagagccccgccaccctgagcgtgagccccggcgagagagccaccctgagctgcagagccagccagagcgtgggcaacagcctggcctggtaccagcagagacccggccaggcccccagactgctgatctacggcgccagcaccagagccaccggcatcccccccagattcagcggcagcggcagcggcaccgagttcaccctgaccatcagcagcctgcagaccgaggacttcgccgtgtactactgccagcagtacatcaactggagacccctgagcttcggcggcggcaccaaggtggagatcaag

SEQ ID NO: 35304 - RNA, 324 nt, synthetic construct
  misc_feature 1..324: note = derived and/or modified sequence opt4 from anti-influenza_Chain
  source 1..324: mol_type = other RNA
caggagagcggcgccgagctggtgagacccggcgccagcgtgaagctgagctgcaaggacagcggctacaccttcaccacctactggatgaactgggtgaagcagagacccgagcagggcctggagtggatcggcagaatcgacccctacgacagcgagacccactacaaccagaagttcaaggacaaggccatcctgaccgtggacaagagcagcaacaccgcctacatgcagctgagcagcctgaccagcgaggacagcgccgtgtactactgcgtgagaggcggcagcaccgtggcctacttcggcgtgtggggccagggc

SEQ ID NO: 35305 - RNA, 324 nt, synthetic construct
  misc_feature 1..324: note = derived and/or modified sequence opt4 from anti-influenza_Chain
  source 1..324: mol_type = other RNA
gagatcgtgctgacccagagccccggcaccctgagcctgagccccggcgagagagccaccctgagctgcagagccagccagagagtgagcagctacctggcctggtaccagcagaagcccggccaggcccccagactgctgatctacggcgccagcaccagagccgccggcatccccgacagattcagcggcagcggcagcggcaccgacttcaccctgaccatcagcagactggagcccgaggacagcgccgtgtactactgccagcagtacggcagaacccccctgaccttcggcggcggcaccaaggtggagatcaagaga

SEQ ID NO: 35306 - RNA, 324 nt, synthetic construct
  misc_feature 1..324: note = derived and/or modified sequence opt4 from anti-influenza_Chain
  source 1..324: mol_type = other RNA
gagatcgtgatgacccagagccccggcaccctgagcctgagccccggcgagagagccaccctgagctgcagagccagccagagcgtgagcagcagctacctggcctggtaccagcagaagcccggccaggcccccagactgctgatcttcggcgccagcagcagagccaccggcatccccgacagattcagcggcagcggcagcggcaccgacttcaccctgaccatcagcagactggagcccgaggacttcgccgtgtactactgccagcagtacggcagcagcctgaccttcggcggcggcaccaagctggagatcaagaga

SEQ ID NO: 35307 - RNA, 324 nt, synthetic construct
  misc_feature 1..324: note = derived and/or modified sequence opt4 from anti-influenza_Chain
  source 1..324: mol_type = other RNA
gagatcgtgctgtaccagagccccggcaccctgagcctgagccccggcgagagagccaccctgagctgcagagccagccagagagtgagcagctacctggcctggtaccagcagaagcccggccaggcccccagactgctgatctacggcgccagcaccagagccgccggcatccccgacagattcagcggcagcggcagcggcaccgacttcaccctgaccatcagcagactggagcccgaggacagcgccgtgtactactgccagcagtacggcagaacccccctgaccttcggcggcggcaccaaggtggagatcaagaga

SEQ ID NO: 35308 - RNA, 324 nt, synthetic construct
  misc_feature 1..324: note = derived and/or modified sequence opt4 from anti-influenza_Chain
  source 1..324: mol_type = other RNA
gacatcgtgctgacccaggcccccagcgtgagcgtgagccccggccagaccgccagcatcacctgcagcggcgacagactgggcgagaagttcgccagctggtaccagcagaagcccggccagagccccgtgctggtgatctacgaggacagcaagagacccagcggcatccccgacagattcagcggcagcaacagcggcaacaccgccaccctgaccatcagcggcacccagatcatggacgagggcgacttcttctgccaggcctgggacagcagcaccgtggtgttcggcggcggcaccaagctgaccgtgctgggccag

SEQ ID NO: 35309 - RNA, 324 nt, synthetic construct
  misc_feature 1..324: note = derived and/or modified sequence opt4 from anti-influenza_Chain
  source 1..324: mol_type = other RNA
gacatcgagctgacccagagccccagcgtgagcgtgagccccggccagaccgccagcatcacctgcagcggcgacaagctgggcgacaagttcgtgtgctggtaccagcagaaggccggccagagccccatcgtggtgatctaccaggacgacaagagacccagcggcatccccgagagattcagcggcagcaacagcggcaacaccgccaccctgaccatcagcggcacccaggccatggacgaggccgactacttctgccaggcctgggacagcaccaccgtggtgttcggcggcggcaccaagctgaccgtgctgggccag

SEQ ID NO: 35310 - RNA, 324 nt, synthetic construct
  misc_feature 1..324: note = derived and/or modified sequence opt4 from anti-influenza_Chain
  source 1..324: mol_type = other RNA
cagagcgtgctgacccagccccccagcgccagcggcagcagaggccagagcatcaccatcagctgcaccggcagcaccagcgacatcggcagctacaactacgtgagctggtaccagcagcaccccggcaccgcccccaaggtgatcctgtacgaggtgagccagagacccagcggcgtgcccgacagattcagcggcagcaagagcggcaacaccgccttcctgaccgtgagcggcctgcagaccgacgacgaggccgactactactgcgccagctacgccggcaacaacatctacgtgttcggcagcggcaccaaggtgacc

SEQ ID NO: 35311 - RNA, 327 nt, synthetic construct
  misc_feature 1..327: note = derived and/or modified sequence opt4 from anti-influenza_Chain
  source 1..327: mol_type = other RNA
aacttcatgctgacccagccccacagcgtgagcgagagccccggcaagaccgtgaccatcagctgcaccggcagcggcggcaacatcgccagaaactacgtgcagtggtaccagcagagacccggcagcgcccccgtgaccgtgatcctggaggacgacaagagacccagcggcatccccgacagattcagcggcagcatcgacagaagcagcaacagcgccagcctgaccatcagcggcctgagaaccgaggacgaggccctgtactactgccagagctacgacgacagcgacctggtggtgttcggcggcggcaccaagctgacc

SEQ ID NO: 35312 - RNA, 327 nt, synthetic construct
  misc_feature 1..327: note = derived and/or modified sequence opt4 from anti-influenza_Chain
  source 1..327: mol_type = other RNA
atgctggagcccctgcagatcctgagcatctgcagcttcatcctgagcgccctgcacttcatggcctggaccatcggccacctgaaccagatcaagagaggcgtgaacctgaagatccagatcagaaaccccaacaaggaggccatcaacagagaggtgagcatcctgagacacaactaccagaaggagatccaggccaaggagaccatgaagaagatcctgagcgacaacatggaggtgctgggcgaccacatcgtggtggagggcctgagcaccgacgagatcatcaagatgggcgagaccgtgctggaggtggaggagctgcag

SEQ ID NO: 35313 - RNA, 327 nt, synthetic construct
  misc_feature 1..327: note = derived and/or modified sequence opt4 from anti-influenza_Chain
  source 1..327: mol_type = other RNA
gacatcagactgacccagagccccgccaccctgagcgtgagccccggcgagagagccaccctgagctgcagagccagccacagcgtgagcagaaacctggcctggtaccagcagaagcccggcagagcccccagactgctggtgtacgacaccagcagcagagccaccggcatccccgccagattcagcggcagcggcagcggcaccgagttcaccctgaccatcagcagcctgcagagcgaggacttcgccgtgtactactgccagcagtacaacaactggcccagaaccttcggccagggcaccaaggtggacatcaagagaacc

SEQ ID NO: 35314 - RNA, 327 nt, synthetic construct
  misc_feature 1..327: note = derived and/or modified sequence opt4 from anti-influenza_Chain
  source 1..327: mol_type = other RNA
gagatcgtgatgacccagagccccggcaccctgagcctgagccccggcgagagagccaccctgagctgcagagccagccagagcgtgagcagcagctacctggcctggtaccagcagaagcccggccaggcccccagactgctgatctacggcgccagcaccagagccaccggcgtgcccgacagattccacggcggcggcagcggcaccgacttcaccctgaccatcagcagactggagcccgaggacttcgccgtgtactactgccagcagtacgacaccagcagcggcctgaccttcggcggcggcaccaaggtggagatcaag

SEQ ID NO: 35315 - RNA, 327 nt, synthetic construct
  misc_feature 1..327: note = derived and/or modified sequence opt4 from anti-influenza_Chain
  source 1..327: mol_type = other RNA
gagatcgtgatgacccagttccccgccaccctgagcgtgagccccggcgagagagtgaccctgagctgcagagccagccagagcgtgagcaacaacctggcctggtaccagcagaagcccggccagccccccagactgctgatctacgacgccagcaccagagccaccggcgtgcccgccaagttcagcggcaccggcagcggcaccgagttcaccctgagcatcagcagcctgcagagcgaggacttcgccgtgtactactgccagcagtaccacaactggccccccagctacagcttcggcctgggcaccaagctggagatcaag

SEQ ID NO: 35316 - RNA, 327 nt, synthetic construct
  misc_feature 1..327: note = derived and/or modified sequence opt4 from anti-influenza_Chain
  source 1..327: mol_type = other RNA
gagatcatcctggcccagagccccggcaccctgagcctgagccccggcgagagagccaccctgagctgcagagccagccagttcgtgagcaccagaagcctggcctggtaccagcagagacccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcactacggctacagccccagatacgccttcggccagggcagcaaggtggagatcaag

SEQ ID NO: 35317 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccggcaccctgagcctgagccccggcgagagagccaccctgagctgcagagccagccacttcgtgaactacagaagcctggcctggtaccagcagacccccggccaggtgcccagactgctgatctacggcgccagcaccagagccaccggcatccccgacagattcagcggcagcggcagcggcaccgacttcaccctgaccatcagcagactggagcccgaggacttcgccgtgtacttctgccagcagtacggcggcagccccagatacaccttcggccagggcaccagactggagatcaag

SEQ ID NO: 35318 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccggcaccctgagcctgagccccggcgagagagccaccctgagctgcagagccagccacttcgtgatcggcagagccgtggcctggtaccagcagaagcccggccaggcccccagactgctgatctacggcgccagcagcagagccaccggcatccccgacagattcagcggcagcggcagcggcaccgacttcaccctgaccatcagcagactggagaccgaggacttcgccgtgttctactgccagcactacggcagcagccccagatacgccttcggccagggcaccaagctggagatcaag

SEQ ID NO: 35319 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcctgagccccggcgagagagccaccctgagctgcagagccagccagagcgtgggcaactacctggcctggtaccagcagaagcccggccaggcccccagactgctgatctacgacagcagcaacagagcccccggcatccccgccagattcagcggcagcggcagcggcaccgacttcaccctgaccatcagcagcctggcccccgaggacttcgccgtgtactactgccagcagagaagcaagtggccccccatgtacagcttcggccacggcaccaagctggagatcaag

SEQ ID NO: 35320 - RNA, 327 nt, synthetic construct
  misc_feature 1..327: note = derived and/or modified sequence opt4 from anti-influenza_Chain
  source 1..327: mol_type = other RNA
caggccgtggtgacccaggagcccagcctgaccgtgagccccggcggcaccgtgaccctgacctgcggcagcagcaccggccccgtgaccagcggccactacccctactggttccagcagaagcccggccaggcccccagaaccctgatcagcgccaccagcaacacccacagctggacccccgccagattcagcggcagcctgctgggcggcagagccgccctgaccctgagcggcgcccagcccgaggacgaggccgactactactgcttcctgagctacagcggcgcctgggtgttcggcggcggcaccaccctgaccgtgctg

SEQ ID NO: 35321 - RNA, 327 nt, synthetic construct
  misc_feature 1..327: note = derived and/or modified sequence opt4 from anti-influenza_Chain
  source 1..327: mol_type = other RNA
gccatccagatgacccagagccccagcagcctgagcgccagcgtgggcgacagagtgaccatcacctgcagagccagccagaacatcagaagctacctgaactggtaccagcagaagcccggcaaggcccccaacctgctgatctacggcaccaccagcctggagagcggcgtgcccagcagattcagcggcagcggcagcggcaccgacttcaccctgaccatcagcagcctgcagcccgaggacttcgccacctactactgccagcagagctaccacaccccccagaccttcggccagggcaccaaggtggagatcaagagaacc

SEQ ID NO: 35322 - RNA, 327 nt, synthetic construct
  misc_feature 1..327: note = derived and/or modified sequence opt4 from anti-influenza_Chain
  source 1..327: mol_type = other RNA
gacatccagatgacccagagccccagcagcctgagcgccagcgtgggcgacagaatcaccatcacctgcagagccagccagggcatcgacaactacctggcctggttccagcagaagcccggcaaggtgcccgagctgctgatctacgccgccagcaccctgcagagcggcgtgcccagcagattcagcggcagcggcagcggcaccggcttcaccctgaccatcagcagcctgcagcccgaggacgtggccacctactactgccagaagtacgacagcgcccccctgaccttcggcggcggcaccaaggtggacatcaagagaacc

SEQ ID NO: 35323 - RNA, 327 nt, synthetic construct
  misc_feature 1..327: note = derived and/or modified sequence opt4 from anti-influenza_Chain
  source 1..327: mol_type = other RNA
gacatccagctgacccagagccccagcagcctgagcgccagcgtgggcgacagagtgaccatcacctgcagagccagccagggcatcaccgactacctggcctggtaccagcagaagcccggcaccatccccaagctgctgatctacgccgccagcaccctgcagagcggcgtgcccagcagattcagcggcggcggctacggcaccgacttcaccctgaccatcagcagcctgcagcccgaggacgtggccacctactactgccagaagtacaacagcgcccccctgaccttcggcggcggcaccaaggtggagatcaagagaacc

SEQ ID NO: 35324 - RNA, 327 nt, synthetic construct
  misc_feature 1..327: note = derived and/or modified sequence opt4 from anti-influenza_Chain
  source 1..327: mol_type = other RNA
gacatcgtgatgacccagagccccttcagcctgagcctgagccccggcgagagagccaccctgagctgcagagccagccagagcatcagcaactacctggcctggtaccagcagaagcccggccaggcccccagactgctgatctacgacagcagcaacagagccaccggcgtgcccgccagattcagcggcagcggcagcggcaccgacttcaccctgaccatcagcagcctggagcccgaggacttcgccgtgtactactgccagcagagaagcaactggatgtacaccttcggccagggcaccaaggtggagatcaagagaacc

SEQ ID NO: 35325 - RNA, 327 nt, synthetic construct
  misc_feature 1..327: note = derived and/or modified sequence opt4 from anti-influenza_Chain
  source 1..327: mol_type = other RNA
gacatccagatgacccagagccccagcagcctgagcgccagcgtgggcgacagagtgaccatcacctgcagagccagccagggcatcagcagctacctggcctggtaccagcagaagcccggcaaggtgcccaccctgctgatctacgacgccagcaccctgagaagcggcgtgcccagcagattcagcggcagcggcagcgccaccgacttcaccctgaccatcagcagcctgcagcccgaggacgtggccacctactactgccagagatacaacagcgccccccccatcaccttcggccagggcaccagactggagatcaagaga

SEQ ID NO: 35326 - RNA, 327 nt, synthetic construct
  misc_feature 1..327: note = derived and/or modified sequence opt4 from anti-influenza_Chain
  source 1..327: mol_type = other RNA
gagatcgtgatgacccagagccccggcaccctgagcctgagccccggcgagagagccaccctgagctgcagagccagccagagcgtgagcagcagctacctggcctggtaccagcagaagcccggccaggcccccagactgctgatctacgacgccagcagcagagccaccgacatccccgacagattcagcggcagcggcagcggcaccgacttcaccctgaccatcagcagactggagcccgaggacttcgccgtgtactactgccagcagtacggcagcagcctgtggaccttcggccagggcaccaaggtggagatcaagaga

SEQ ID NO: 35327 - RNA, 327 nt, synthetic construct
  misc_feature 1..327: note = derived and/or modified sequence opt4 from anti-influenza_Chain
  source 1..327: mol_type = other RNA
agctacgtgctgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccacgccgtgttcggcggcggcacccagctgaccgtgctgggc

SEQ ID NO: 35328 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagccccagaaccttcggcggcggcaccaaggtggagatcaagaga

SEQ ID NO: 35329 - RNA, 327 nt, synthetic construct
  misc_feature 1..327: note = derived and/or modified sequence opt4 from anti-influenza_Chain
  source 1..327: mol_type = other RNA
agctacgtgctgacccagccccccagcgtgagcgtggcccccggccagaccgccagaatcacctgcggcggcaacaacatcggcagcaagggcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccacgtggtgttcggcggcggcaccaagctgaccgtgctgggc

SEQ ID NO: 35330 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccggcaccctgagcctgagccccggcgagagagccaccctgagctgcagagccagccagagcgtgagcagcaactacctgggctggacccagcagaagcccggccaggcccccagactgctgatctacggcgccagcagcagagccagcggcatccccgacagattcagcggcggcggcagcggcaccgacttcaccctgaccatcagcagactggagcccgaggacttcgccgtgtactactgccagcagtacggcagcagccccctgaccttcggcggcggcaccaaggtggagatcaagaga

SEQ ID NO: 35331 - RNA, 327 nt, synthetic construct
  misc_feature 1..327: note = derived and/or modified sequence opt4 from anti-influenza_Chain
  source 1..327: mol_type = other RNA
cagagcgtggtgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccactacgtgttcggcaccggcaccaaggtgaccgtgctgggc

SEQ ID NO: 35332 - RNA, 327 nt, synthetic construct
  misc_feature 1..327: note = derived and/or modified sequence opt4 from anti-influenza_Chain
  source 1..327: mol_type = other RNA
agctacgtgctgacccagccccccagcgagagcgtggcccccggccagaccgccagaatcacctgcggcggcaacaacatcggcagaaacagcgtgcactggtaccagcagaagcccggccaggcccccgtgctggtggtgtacgacgacagcgacagacccagcggcatccccgagagattcagcggcagcaagagcggcaacaccgccaccctgatcatcagcagagtggaggtgggcgacgaggccgactactactgccaggtgtggcacagcagcagcgaccactacgtgttcggcaccggcaccaaggtgaccgtgctgggc

SEQ ID NO: 35333 - RNA, 327 nt, synthetic construct
  misc_feature 1..327: note = derived and/or modified sequence opt4 from anti-influenza_Chain
  source 1..327: mol_type = other RNA
gagatcgtgatgacccagagccccggcaccctgagcctgagccccggccagagagccaccctgagctgcagagccagccagagcgtgagcagcagctacctggcctggtaccagcagaagcccggccaggcccccagactgctgatgtacggcgccagcagcagagccaccggcatccccgacagattcagcggcagcggcagcggcaccgacttcaccctgaccatcagcagactggagcccgaggacttcgccgtgtactactgccagcagtacggcagcagcagcctgaccttcggcggcggcaccaagctggagatcaagaga

SEQ ID NO: 35334 - RNA, 327 nt, synthetic construct
  misc_feature 1..327: note = derived and/or modified sequence opt4 from anti-influenza_Chain
  source 1..327: mol_type = other RNA
caggccggcctgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccacgtggtgttcggcggcggcaccaagctgaccgtgctgggc

SEQ ID NO: 35335 - RNA, 327 nt, synthetic construct
  misc_feature 1..327: note = derived and/or modified sequence opt4 from anti-influenza_Chain
  source 1..327: mol_type = other RNA
cagagcgtggtgacccagccccccagcgagagcgtggcccccggccagaccgccagaatcacctgcggcggccacaacatcggcagcaacagcgtgcactggtaccagcagaagcccggccaggcccccgtgctggtggtgtacgacaacagcgacagacccagcggcatccccgagagattcagcggcagcaacagcggcaacaccgccaccctgaccatcagcagagtggaggccggcgacgaggccgactactactgccaggtgtggggcagcagcagcgaccactacgtgttcggcaccggcaccaaggtgaccgtgctgggc

SEQ ID NO: 35336 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccggcaccctgagcctgagccccggcgagagagccaccctgagctgcagagccagccagagcgtgagcagcaactacctgggctggtaccagcagaagcccggccaggcccccagactgctgatctacggcgccagcagcagagccagcggcatccccgacagattcagcggcggcggcagcggcaccgacttcaccctgaccatcagcagactggagcccgaggacttcgccgtgtactactgccagcagtacggcagcagccccctgaccttcggcggcggcaccaaggtggagatcaagaga

SEQ ID NO: 35337 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccagagcgtggacagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaag

SEQ ID NO: 35338 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccagagcgtgagccacaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactacccccccagactgaccttcggcggcggcagcaaggtggagatcaag

SEQ ID NO: 35339 - RNA, 327 nt, synthetic construct
  misc_feature 1..327: note = derived and/or modified sequence opt4 from anti-influenza_Chain
  source 1..327: mol_type = other RNA
gagatcgtgatgacccagagccccgccaccctgagcgtgagccccggcgagagagccaccctgagctgcagagccagccagagcgtggacagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaag

SEQ ID NO: 35340 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccagagcgtgagcagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaag

SEQ ID NO: 35341 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccagagcgtggaccacaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaag

SEQ ID NO: 35342 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccagagcgtgagccacaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaag

SEQ ID NO: 35343 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccagagcgtgagccacaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaacttcccccccagactgaccttcggcggcggcagcaaggtggagatcaag

SEQ ID NO: 35344 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccagagcgtggacagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaacttcccccccagactgaccttcggcggcggcagcaaggtggagatcaag

SEQ ID NO: 35345 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccagagcgtggacagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactacccccccagactgaccttcggcggcggcagcaaggtggagatcaag

SEQ ID NO: 35346 - RNA, 327 nt, synthetic construct
  misc_feature 1..327: note = derived and/or modified sequence opt4 from anti-influenza_Chain
  source 1..327: mol_type = other RNA
gagaccaccctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaactggccccccagactgaccttcggcggcggcaccaaggtggagatcaag

SEQ ID NO: 35347 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaactggccccccagactgaccttcggcggcggcaccaaggtggagatcaag

SEQ ID NO: 35348 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagcccgaggacttcgccgtgtactactgccagcactacagcaactggccccccagactgaccttcggcggcggcaccaaggtggagatcaag

SEQ ID NO: 35349 - RNA, 327 nt, synthetic construct
  misc_feature 1..327: note = derived and/or modified sequence opt4 from anti-influenza_Chain
  source 1..327: mol_type = other RNA
gagatcgtgatgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaactggccccccagactgaccttcggcggcggcaccaaggtggagatcaag

SEQ ID NO: 35350 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaacttcccccccagactgaccttcggcggcggcaccaaggtggagatcaag

SEQ ID NO: 35351 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaactacccccccagactgaccttcggcggcggcaccaaggtggagatcaag

SEQ ID NO: 35352 - RNA, 327 nt, synthetic construct
  misc_feature 1..327: note = derived and/or modified sequence opt4 from anti-influenza_Chain
  source 1..327: mol_type = other RNA
gagatcgtgctgacccagagccccgccaccctgagcgtgagccccggcgagagagtgaccctgagctgcagagccagccagagcgtggccaacaacctggcctggtaccagcagaagcccggccagagccccagactgctgatctacggcgccagcaccagagacaccggcatccccgccagattcagcggcagcggcagcggcaccgagttcaccctgaccatcagcagcctgcagagcgaggacttcgccgtgtactactgccagcagtacaacaactggccccccatgtacaccttcggccagggcaccaagctggagatcaag

SEQ ID NO: 35353 - RNA, 327 nt, synthetic construct
  misc_feature 1..327: note = derived and/or modified sequence opt4 from anti-influenza_Chain
  source 1..327: mol_type = other RNA
gacatcgtgatgacccagagccccagcaccctgagcgccagcgtgggcgacagagtgaccatcacctgcagagccagccagagcatcggcaactggctggcctggtaccagcagaagcccggcaaggcccccaagctgctgatctacaaggtgagcaccctggagagcggcgtgcccagcagattcagcggcagcggcagcggcaccgagttcaccctgaccatcaacagcctgcagcccgacgacttcgccacctactactgccagagatacaccagcaacagccagggcttcaccttcggccagggcaccaagctggagatcaag

SEQ ID NO: 35354 - RNA, 327 nt, synthetic construct
  misc_feature 1..327: note = derived and/or modified sequence opt4 from anti-influenza_Chain
  source 1..327: mol_type = other RNA
gacatcgtgatgacccagagccccgccaccctgagcgtgagccccggcgagagagccaccctgagctgcagagccagccaggtggtgggcaccaacctggcctggtaccagcagaagcccggccaggcccccagactgctgatctacgccgccagcaccagagccaccggcatccccgccagattcagcggcagcggcttcggcaccgacttcaccctgaccatcagcagcctgcagagcgaggacttcgccgtgtactactgccagcagtacaacaactggcccctgagcttcggcggcggcaccaaggtggagatcagaagaacc

SEQ ID NO: 35355 - RNA, 327 nt, synthetic construct
  misc_feature 1..327: note = derived and/or modified sequence opt4 from anti-influenza_Chain
  source 1..327: mol_type = other RNA
gacatccagatgacccagagccccagcagcctgagcgccagcgtgggcgacagagtgaccatcgtgtgcagagccagccagggcatcaacacccacctgcactggtaccagcagaagcccggcaaggcccccaagctgctgatctacagcgccagcaccctgcacaccggcgtgcccagcagactgagcggcagcggcagcggcaccgacttcaccctgagcatcagcagcctgcagcccgaggacttcgccacctactactgccagcagagctacaactaccccagaaccttcggccagggcaccaacgtggacatcaagagaacc

SEQ ID NO: 35356 - RNA, 327 nt, synthetic construct
  misc_feature 1..327: note = derived and/or modified sequence opt4 from anti-influenza_Chain
  source 1..327: mol_type = other RNA
gacatcctgatgacccagagccccagcagcctgagcgccagcgtgggcgacagagtgaccatcacctgcagagccagccaggacatcagaaacagactggcctggtaccagcagaagcccggcaaggcccccaagagactgatctacgccgccagcagcctgcagagcggcgtgcccagcagattcagcggcagcggcagcggcaccgagttcaccctgaccatcaacagcctgcagcccgaggacttcgccacctactactgcctgcagcacaacagctacccctggaccttcggccccggcaccaaggtggagatcaagagaacc

SEQ ID NO: 35357 - RNA, 327 nt, synthetic construct
  misc_feature 1..327: note = derived and/or modified sequence opt4 from anti-influenza_Chain
  source 1..327: mol_type = other RNA
gacatcgtgatgacccagagccccgccaccctgagcgtgagccccggcgagggcgccaccctgagctgcagagccagccagggcatcggcagcaacctggcctggtaccagcacaagcccggccaggcccccagactgctgatctacgccgccagcaccagagccaccggcgtgcccgccagattcagcggcagcggcagcggcaccgagttcaccctgaccatcagcagcctgcagagcgaggacctggccgtgtacttctgccagcagtacaacacctggcccctgaccttcggcggcggcaccaaggtggagatcatcagaacc

SEQ ID NO: 35358 - RNA, 327 nt, synthetic construct
  misc_feature 1..327: note = derived and/or modified sequence opt4 from anti-influenza_Chain
  source 1..327: mol_type = other RNA
gacatcgtgatgacccagagccccagcaccctgagcgccagcgtgggcgacagagtgaccatcacctgcagagccagccagaccatctacagatggctggcctggtaccagcagaagcccggcaaggcccccaaggtgctgatctacaaggccagcaccctggagagcggcgtgcccagcagattcagcggcagcggcagcggcaccgagttcaccctggccatcagcagcctgcagcccgacgacttcgccacctactactgccagcagtacaacagcttcccctacagattcggccagggcaccaaggtggagatcaagagaacc

SEQ ID NO: 35359 - RNA, 327 nt, synthetic construct
  misc_feature 1..327: note = derived and/or modified sequence opt4 from anti-influenza_Chain
  source 1..327: mol_type = other RNA
gacatcgtgatgacccagagccccagcagcctgagcgccagcgtgggcgacagagtgagcatcacctgcagagccagccagaccatcaccagattcctgaactggtaccagcagaagcccggcaagggccccaagctgctgatctacgccgccagcaccgtgcacagaggcgtgcccagcagattcagcggcagcggcagcggcaccgacttcaccctgaccatcagcagcctgcagcccgaggacttcgccacctactactgccagcagagctacagcgcccccttcaccttcggccccggcaccaccgtggacatcagaagaacc

SEQ ID NO: 35360 - RNA, 327 nt, synthetic construct
  misc_feature 1..327: note = derived and/or modified sequence opt4 from anti-influenza_Chain
  source 1..327: mol_type = other RNA
gacatcgtgatgacccagccccccgccaccctgagcgtgagccccggcgagagagccaccctgagctgcggcgccagccagggcctgggcagcaacctggcctggtaccagcagaagcccggccaggcccccagactgctgatctacgccgccagcaccagagccaccggcatcaccgccagattcagcggcagcggcagcggcaccgagttcaccctgaccatcaacagcctgcagagcgaggacttcgccctgtactactgccagcagtacacctactggcccctgaccttcggcggcggcaccaaggtggagatcaagagaacc

SEQ ID NO: 35361 - RNA, 327 nt, synthetic construct
  misc_feature 1..327: note = derived and/or modified sequence opt4 from anti-influenza_Chain
  source 1..327: mol_type = other RNA
gacatcgtgctgacccagagccccgccaccctgagcgtgagccccggcgagagagccaccctgagctgcagagccagccagagcgtgaacagaaacctggcctggttccagcagatccccggccaggcccccagactgctgatcttcgacgccagcaccagagccgccgacatccccgccagattcagcggcggcggcagcggcgccgagttcaccctgaccgtgagcagcctgcagcccgaggacttcgccgtgtactactgccagcagtacgacaagtggccccccggcttcggccagggcaccaaggtggagatcaagagaacc

SEQ ID NO: 35362 - RNA, 330 nt, synthetic construct
  misc_feature 1..330: note = derived and/or modified sequence opt4 from anti-influenza_Chain
  source 1..330: mol_type = other RNA
cagagcgtgctgacccagccccccagcgccagcggcgcccccggccagagagtgaccctgagctgcagcggcagcggcagcaacatcggcagcaacaccgtgagctggtaccagcagctgcccggcaccgcccccaagctgctggtgttcaccaacaaccagagacccagcggcgtgcccgacagattcagcggcagcaagagcggcaccagcgccagcctggccatcagcggcctgcagagcgaggacgaggccgactactactgcgccgcctgggacgacagcctgaacggccagctgttcggcggcggcaccaagctgaccgtgctg

SEQ ID NO: 35363 - RNA, 330 nt, synthetic construct
  misc_feature 1..330: note = derived and/or modified sequence opt4 from anti-influenza_Chain
  source 1..330: mol_type = other RNA
cagagcgtgctgacccagccccccagcgtgagcgccgcccccggccagagagtgaccatcagctgcagcggcaccagcagcaacatcggcaagaactacgtgagctggtaccagcagctgcccggcgccgcccccaagctgctgatctacgacaacgacaagagacccagcggcatccccgacagattcagcggcagcaagagcggcaccagcgccaccctgggcatcaccggcctgcagaccggcgacgaggccgactactactgcggcacctgggacagcagcctgagcgtgggcatgttcggcggcggcaccagactgaccgtgctg

SEQ ID NO: 35364 - RNA, 330 nt, synthetic construct
  misc_feature 1..330: note = derived and/or modified sequence opt4 from anti-influenza_Chain
  source 1..330: mol_type = other RNA
gagaccaccctgacccagagccccgccaccctgagcgtgagccccggcgagagagccaccctgagctgcagagccagccagagcgtgagcagaaacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagcagcatcaccttcggccagggcaccagactggagatcaagagaaccgtg

SEQ ID NO: 35365 - RNA, 330 nt, synthetic construct
  misc_feature 1..330: note = derived and/or modified sequence opt4 from anti-influenza_Chain
  source 1..330: mol_type = other RNA
cagagcgtgctgacccagccccccagcgccagcggcacccccggccagagagtgaccatcagctgcagcggcagcagcagcaacatcggcagcaacaccgtgaactggtacaagcagctgcccggcaccgcccccagactgctgatctacagcaacgaccagagacccagcggcgtgcccgacagattcagcggcagcaagagcggcaccagcgccagcctggccatcagcggcctgcagagcgaggacgaggccaactactactgcgccgcctgggacgacagcctgagcggctgggtgttcggcggcggcaccaagctgaccgtgctg

SEQ ID NO: 35366 - RNA, 330 nt, synthetic construct
  misc_feature 1..330: note = derived and/or modified sequence opt4 from anti-influenza_Chain
  source 1..330: mol_type = other RNA
cagagcgccctgacccagcccagaagcgtgagcggcagccccggccagagcgtgaccatcagctgcaccggcagcagcagcgacgtgggcgccagcaacagcgtgagctggtaccagcagcaccccggcaaggcccccaagctggtgatctacgacgtgaccgagagacccagcggcgtgccccacagattcagcggcagcaagagcggcaacaccgccagcctgaccgtgagcggcctgcagcccgaggacgaggccgactacttctgctgcgcctacggcggcaagtacctggtggtgttcggcggcggcaccaaggtgaccgtgctg

SEQ ID NO: 35367 - RNA, 330 nt, synthetic construct
  misc_feature 1..330: note = derived and/or modified sequence opt4 from anti-influenza_Chain
  source 1..330: mol_type = other RNA
cagagcgccctgacccagcccgccagcgtgagcggcagccccggccagagcatcaccatcagctgcaccggcaccagcagcgacgtgggcggctacaactacgtgagctggtaccagcagcaccccggcaaggcccccaagctgctgatctacgaggtgaccaactggcccagcggcgtgagcaacagattcagcggcagcaagagcggcaacaccgccagcctgaccatcagcggcctgcaggccgaggacgaggccgactactactgcagcagctacgccggcagcagcacctgggtgttcggcggcggcaccagagtgaccgtgctg

SEQ ID NO: 35368 - RNA, 330 nt, synthetic construct
  misc_feature 1..330: note = derived and/or modified sequence opt4 from anti-influenza_Chain
  source 1..330: mol_type = other RNA
cagaccgtggtgacccaggagcccagcctgaccgtgagccccggcggcaccgtgaccctgacctgcgccagcagcaccggcgccgtgaccagcagctacttccccaactggttccagcagaagcccggccaggcccccagacccctgatctacagcaccaccatcagacacagctggacccccgccagattcagcggcagcctgctgggcggcaaggccgccctgaccctgagcggcgtgcagcccgaggacgaggccgactactactgcctgctgtacagcggcggcgaccccgtggccttcggcggcggcaccaagctgaccgtgctg

SEQ ID NO: 35369 - RNA, 330 nt, synthetic construct
  misc_feature 1..330: note = derived and/or modified sequence opt4 from anti-influenza_Chain
  source 1..330: mol_type = other RNA
cagagcgtgctgacccagagccccagcgtgagcgccgcccccggccagaaggtgaccatcagctgcagcggcagcgacagcaacatcggcgactacttcgtgtgctggtaccagcacctgcccggcaagcccccccagctgctgatctacgagaacaacaagagacccagcggcatccccgacagattcagcggcagcaagagcggcaccagcgccaccctgggcatcaccggcatccagaccggcgacgaggccgactactactgcgccacctgggacggcagcctgagcgcctgggtgttcggcggcggcaccaagctgaccgtgctg

SEQ ID NO: 35370 - RNA, 330 nt, synthetic construct
  misc_feature 1..330: note = derived and/or modified sequence opt4 from anti-influenza_Chain
  source 1..330: mol_type = other RNA
cagagcgccctgacccagcccagaagcgtgagcggcagccccggccagagcatcaccatcagctgcaccggcggcagcagcgacatcggcgccagcaacagcgtgagctggtaccagcagcaccccggcaaggcccccaagctggtgatcttcgacgtgaccgagagacccagcggcgtgccccacagattcagcggcagcaagagcggcaacaccgccagcctgaccgtgagcggcctgcagcccgacgacgaggccgactacttctgctgcgcctacggcggcaagtacctggtggtgttcggcggcggcaccaaggtgaccgtgctg

SEQ ID NO: 35371 - RNA, 330 nt, synthetic construct
  misc_feature 1..330: note = derived and/or modified sequence opt4 from anti-influenza_Chain
  source 1..330: mol_type = other RNA
caggccgtggtgacccaggagcccagcctggccgtgagccccggcggcaccgtgaccctgacctgcggcagcagcaccggcgccgtgaccagaggccactacccctactggttccagcagaagcccggccaggcccccagagccctgatctacgacagcgccggcaacagacacagctggacccccgccagattcagcggcagcctgctgggcggcaaggccgccctgaccctgagcggcgcccagcccgaggacgaggccgagtactactgcctgctgagctacagcggcgtgtgggtgttcggcggcggcaccaagctgaccgtgctg

SEQ ID NO: 35372 - RNA, 330 nt, synthetic construct
  misc_feature 1..330: note = derived and/or modified sequence opt4 from anti-influenza_Chain
  source 1..330: mol_type = other RNA
gagatcgtgatgacccagagccccgccaccctgagcgtgagccccggcgagagagtgaccctgagctgcagagccagccagagcatcaccgacggcctggcctggtaccagcagaagagcggccaggcccccagactgctgatctacggcgccagcaccagagccaccggcatccccgccagattcagcggcagcggcagcggcaccgagttcaccctgaccatcagcagcctgcagagcgaggacttcgccgtgtactactgccagcagtacaacaactggccccccgtgaccttcggccagggcaccaaggtggagatcaagagaacc

SEQ ID NO: 35373 - RNA, 330 nt, synthetic construct
  misc_feature 1..330: note = derived and/or modified sequence opt4 from anti-influenza_Chain
  source 1..330: mol_type = other RNA
agcagcgagctgacccagccccccagcgccagcggcacccccggccagagagtgaccatcagctgcagcggcagcaccagcaacatcggctacaaccccgtgagctggtaccagcaggtgcccggcaccgcccccaagctgctgatctacagcaacaccgagagacccagcggcgtgcccgacagattcagcggcagcaagagcggcaccagcgccagcctggccatcagcggcctgcagagcgaggacgaggccgactactactgcgccgcctgggacgacaccctgaacggccccgtgttcggcggcggcaccaaggtgaccgtgctg

SEQ ID NO: 35374 - RNA, 330 nt, synthetic construct
  misc_feature 1..330: note = derived and/or modified sequence opt4 from anti-influenza_Chain
  source 1..330: mol_type = other RNA
cagagcgccctgacccagcccgccagcgtgagcggcagccccggccagagcatcaccatcagctgcaccggcaccagcagcgacgtgggcggctacaactacgtgagctggtaccagcagcaccccggcgaggcccccaagctgatgatcagcgacgtgagcaacagacccagcggcgtgagcaacagattcagcggcagcaagagcggcaacaccgccagcctgaccatcagcggcctgcaggccgaggacgaggccgactactactgcaccagctacaccagcagcaacaccctggtgttcggcggcggcaccaagctgaccgtgctg

SEQ ID NO: 35375 - RNA, 330 nt, synthetic construct
  misc_feature 1..330: note = derived and/or modified sequence opt4 from anti-influenza_Chain
  source 1..330: mol_type = other RNA
cagagcgtgctgacccagccccccagcgtgagcgccgcccccggccagaaggtgaccatcagctgcagcggcagcagcagcaacatcggccacaacttcgtgagctggtaccagcagctgcccgccaccgcccccaagctgctgatctacgacaccgacaagagacccagcggcatccccgacagattcagcggcagcaagagcggcaccagcgccaccctgggcatcaccggcctgcagaccggcgacgaggccgactactactgcggcacctgggacagcagcctgagcagcgtgatcttcggcggcggcaccaagctgaccgtgctg

SEQ ID NO: 35376 - RNA, 330 nt, synthetic construct
  misc_feature 1..330: note = derived and/or modified sequence opt4 from anti-influenza_Chain
  source 1..330: mol_type = other RNA
gacatccagatgacccagagccccagcaccctgagcgccagcgtgggcgacagagtgaccatcacctgcagagccagccagaccatcaacaactacctggcctggtaccagcagaagcccggcaaggcccccaagctgctgatctacaaggccagcagcctggagagcggcgtgcccagcagattcagcggcagcggcagcggcaccgagttcaccctgaccatcagcagcctgcagcccgacgacttcgccacctactactgccaggagtacaacaacgacagccccctgaccttcggcggcggcaccaaggtggagatcaagagaacc

SEQ ID NO: 35377 - RNA, 330 nt, synthetic construct
  misc_feature 1..330: note = derived and/or modified sequence opt4 from anti-influenza_Chain
  source 1..330: mol_type = other RNA
gacatcgagctgacccaggaccccagcgtgagcgtggcccccggccagaccgccagaatcccctgcgtgagattcaacatgggccccaccagcgtgcactggtaccagcagaagcccggccaggcccccgtgctggtggtgtacgacgacagcgacagacccagcggcatccccgagagattcagcggcagcaacagcggcgacagcgccaccctgaccatcagcagagtggaggccggcgacgaggccgactactactgccaggtgtgggacatgagcagcgacagaagagtgttcggcggcggcaccaccctgaccgtgctgggccag

SEQ ID NO: 35378 - RNA, 330 nt, synthetic construct
  misc_feature 1..330: note = derived and/or modified sequence opt4 from anti-influenza_Chain
  source 1..330: mol_type = other RNA
gacatcgtgatgacccagagccccggcaccctgagcctgagccccggcgagagagccaccctgtactgcagagccagccagagcgtgagaagcggctacctggcctggtaccagcacaagcccggccaggcccccctgctgctgttctacgacgccagcggcagagccaccggcatccccgacagattcagcggcagcggcagcggcaccgacttcaccctgaccatcagcagactggagcccgaggacttcgccgtgtactactgcctgcagtacggcagcagccccagaaccttcggccagggcaccaaggtggagatcaagagaacc

SEQ ID NO: 35379 - RNA, 330 nt, synthetic construct
  misc_feature 1..330: note = derived and/or modified sequence opt4 from anti-influenza_Chain
  source 1..330: mol_type = other RNA
gacatcgtgctgacccagagccccagcttcctgagcgccagcgtgggcgacagagtgaccatcacctgcagagccagccagctgatcagcagctacttcgcctggtaccagcagaagcccggcaagccccccaagctgctgatctacgccgccagcaccctgcagagcggcgtgcccagcagattcagcggcagcggcagcggcacccagttcagcctgaccatcagcagcctgcagcccgaggacttcgccacctactactgccagcagctgaacagctacccccccatcaccttcggccagggcaccagactggagatcaagagaacc

SEQ ID NO: 35380 - RNA, 330 nt, synthetic construct
  misc_feature 1..330: note = derived and/or modified sequence opt4 from anti-influenza_Chain
  source 1..330: mol_type = other RNA
gacatcaccctgacccagagccccgccaccctgagcgtgagccccggcgagagagccaccctgagctgcagagccagccagagcgtgagcagcaacctggcctggtaccagcagaagcccggccaggcccccagactgctgatctacggcgccagcaacagagccaccgacatccccgccagattcagcggcagcggcagcggcaccgagttcaccctgaccatcagcagcctgcagagcgaggacttcgccgtgtactactgccagcagttcaacgactggcccttcctgaccttcggcggcggcaccaaggtggagatcaagagaacc

SEQ ID NO: 35381 - RNA, 330 nt, synthetic construct
  misc_feature 1..330: note = derived and/or modified sequence opt4 from anti-influenza_Chain
  source 1..330: mol_type = other RNA
gacatcgtgatgacccagagccccagcttcctgagcgccagcgtgggcgacagagtgaccatcacctgcagaaccagccaggtgatcagcagctacctggcctggtaccagcagagacccggcaaggcccccaagctgctgatctacgccgccagcaccctgcagagcggcgtgcccagcagattcagcggcagcggcagcggcaccagattcagcctgaccatcagcaacctgcagcccgaggacttcgccacctacttctgccagcagctgaccacctacccccccatcaccttcggccagggcaccagactggagatcaagagaacc

SEQ ID NO: 35382 - RNA, 330 nt, synthetic construct
  misc_feature 1..330: note = derived and/or modified sequence opt4 from anti-influenza_Chain
  source 1..330: mol_type = other RNA
gacatcgtgctgacccagagccccagcgtgagcgtggcccccggccagaccgccagaatcacctgcggcggcaacgacatcggcagcaagagcgtgcactggtaccagcagaagcccggccaggcccccgtgctggtggtgttcgacgacagagacagacccagcggcatccccgagagattcagcggcagcaacagcggcaacaccgccaccctgaccatcagcagagtggaggccggcgacgaggccgactactactgccaggtgtgggacatcaccagcgacctggtggtgttcggcggcggcaccaagctgaccgtggtgggccag

SEQ ID NO: 35383 - RNA, 330 nt, synthetic construct
  misc_feature 1..330: note = derived and/or modified sequence opt4 from anti-influenza_Chain
  source 1..330: mol_type = other RNA
gacatcgtgatgacccagccccccggcaccctgagcgtgagccccggcgagagagccaccctgagctgcagagccagccagagcgtgagcaccaacctggcctggtaccagcagaagcccggccaggcccccagactgctgatccacggcgccagcaccagagccaccggcatccccgccagattcagcggcagcggcagcggcgccgagttcaccctgaccatcagcagcctgcagagcgaggacgtggccgtgtactactgccagcagtacgacaactggctgcccatcaccttcggccccggcaccaaggtggacatccagagaacc

SEQ ID NO: 35384 - RNA, 330 nt, synthetic construct
  misc_feature 1..330: note = derived and/or modified sequence opt4 from anti-influenza_Chain
  source 1..330: mol_type = other RNA
gaccccatgctgacccagaccgccagccccgtgagcgccgccgtgggcggcaccgtgaccatcaactgccaggccagccagagcgtgtacaacaagaacaacctggcctggtaccagcagaagctgggccagccccccaagctgctgatctacgccgccagcaccctgaccagcggcgtgcccagcagattcaagggcagcggcagcggcacccagttcaccctgaccatcagcgacctggagtgcgacgacgccgccacctactactgcgccggcgactacagcggcggcatctacgccttcggcggcggcaccaaggtggagatcaag

SEQ ID NO: 35385 - RNA, 330 nt, synthetic construct
  misc_feature 1..330: note = derived and/or modified sequence opt4 from anti-influenza_Chain
  source 1..330: mol_type = other RNA
gagctggtgatgacccagacccccgccagcgtgagcgccgccgtgggcggcaccgtgaccatcagctgccagagcagcgagagcgtgtacaagaacaacaacctggcctggttccagcagaagctgggccagccccccaagctgctgatctacgacgccagcaagctggccagcggcgtgcccagcagattcagcggcagcggcagcggcacccagttcaccctgaccatcagcgacctggagtgcgacgacgccgccacctactactgcgccggcgactacagcggcagcaactacgccttcggcggcggcaccaagctggagatcaag

SEQ ID NO: 35386 - RNA, 330 nt, synthetic construct
  misc_feature 1..330: note = derived and/or modified sequence opt4 from anti-influenza_Chain
  source 1..330: mol_type = other RNA
gagcccatgctgacccagaccgccagcagcgtgagcgccgccgtgggcggcagcgtgaccatcagctgccagagcagccagagcgtggacagcaacaaccagctgagctggtaccagcagaagcccggccagccccccaagctgctgatctacgccgccagcaccctgaccagcggcgtgcccagcagattcaagggcagcggcagcggcacccagttcaccctgaccatcagcgacctggagtgcgacgacgccgccacctactactgcgccggcgactacagcggcggcatctacgccttcggcggcggcaccgaggtggtggtgaag

SEQ ID NO: 35387 - RNA, 330 nt, synthetic construct
  misc_feature 1..330: note = derived and/or modified sequence opt4 from anti-influenza_Chain
  source 1..330: mol_type = other RNA
gaccccatgctgacccagaccgccgccagcgtgagcgccgccgtgggcggcaccgtgaccatcagctgccagagcagcgagagcgtgtacaagaacaacaacctggcctggttccagcagaagctgggccagccccccaccctgctgatctgggacgccagcaagctggccagcggcgtgcccagcagattcagcggcagcggcagcggcacccagttcaccctgaccatcagcgacctggagtgcgacgacgccgccacctactactgcgccggcgactacagcggcgtgaactacgccttcggcggcggcaccgaggtggtggtgaag

SEQ ID NO: 35388 - RNA, 330 nt, synthetic construct
  misc_feature 1..330: note = derived and/or modified sequence opt4 from anti-influenza_Chain
  source 1..330: mol_type = other RNA
gagctggtgatgacccagacccccgccagcgtgagcgccgccgtgggcggcaccgtgaccatcagctgccagagcagcgagagcgtgtacaagaacaacaacctggcctggttccagcagaagctgggccagccccccaagctgctgatctacgacgccagcaagctggccagcggcgtgcccagcagattcagcggcagcggcagcggcacccagttcaccctgaccatcagcgacctggagtgcgacgacgccgccacctactactgcgccggcgactacagcggcagcaactacgccttcggcggcggcaccgaggtggtggtgaag

SEQ ID NO: 35389 - RNA, 330 nt, synthetic construct
  misc_feature 1..330: note = derived and/or modified sequence opt4 from anti-influenza_Chain
  source 1..330: mol_type = other RNA
gaccccatgctgacccagaccgccagcagcgtgagcgccaccgtgggcggcaccgtgaccatcagctgccagagcagccagagcgtggacaacaacaaggacctggcctggttccagcagaagcccggccacagccccaagctgctgatctacttcgccagcagactggccagcggcgtgcccagcagattcaagggcagcggcagcggcacccacttcaccctgaccatcagcgacctggagtgcgacgacgccgccacctactactgcgccggcgactacagcggcgccaactacgccttcggcggcggcaccaagctggagatcaag

SEQ ID NO: 35390 - RNA, 330 nt, synthetic construct
  misc_feature 1..330: note = derived and/or modified sequence opt4 from anti-influenza_Chain
  source 1..330: mol_type = other RNA
gaccccatgctgacccagaccgccagccccgtgagcgccgccgtgggcggcaccgtgaccatcaactgccagagcagccagagcgtgtacaacaacaacagactgagctggttccagcagaagcccggccagccccccaagctgctgatctacagcgccagcaccctggccagcggcgtgagcagcagattcaagggcagcggcagcggcacccagttcaccctgaccatcagcgacctggagtgcgacgacgccgccacctactactgcgccggcgactacagcggcggcatctacgccttcggcggcggcaccgagctggagatcctg

SEQ ID NO: 35391 - RNA, 330 nt, synthetic construct
  misc_feature 1..330: note = derived and/or modified sequence opt4 from anti-influenza_Chain
  source 1..330: mol_type = other RNA
gagctggtgctgacccagacccccgccagcgtgagcgccgccgtgggcggcaccgtgagcatcagctgccagagcagccagagcgtgtacaagaacaacaacctggcctggttccagcagaagctgggccagccccccaccctgctgatctgggacgccagcaagctggccagcggcgtgcccagcagattcagcggcagcggcagcggcacccagttcaccctgaccatcagcgacctggagtgcgacgacgccgccacctactactgcgccggcgactacagcggcgtgaactacgccttcggcggcggcaccaagctggagatcaag

SEQ ID NO: 35392 - RNA, 330 nt, synthetic construct
  misc_feature 1..330: note = derived and/or modified sequence opt4 from anti-influenza_Chain
  source 1..330: mol_type = other RNA
gagctggacctgacccagacccccgccagcgtgagcgccgccgtgggcggcaccgtgaccatcagctgccagagcagcgagagcgtgtacaagaacaacaacctggcctggttccagcagaagctgggccagccccccaccctgctgatctgggacgccagcaagctggccagcggcgtgcccagcagattcagcggcagcggcagcggcacccagttcaccctgaccatcagcgacctggagtgcgacgacgccgccacctactactgcgccggcgactacagcggcgtgaactacgccttcggcggcggcaccgaggtggtggtgaag

SEQ ID NO: 35393 - RNA, 330 nt, synthetic construct
  misc_feature 1..330: note = derived and/or modified sequence opt4 from anti-influenza_Chain
  source 1..330: mol_type = other RNA
gacatccagatgacccagagccccagcagcctgagcgccagcgtgggcgacagagtgaccatcacctgccagagcagcgagagcgtgtacaagaacaacaacctggcctggtaccagcagaagcccggcaagccccccaagctgctgatctgggacgccagcaagctggccagcggcgtgcccagcagattcagcggcagcggcagcggcaccgacttcaccctgaccatcagcagcctgcagcccgaggacgtggccacctactactgcgccggcgactacagcggcgtgaactacgccttcggcggcggcaccgaggtggtggtgaag

SEQ ID NO: 35394 - RNA, 333 nt, synthetic construct
  misc_feature 1..333: note = derived and/or modified sequence opt4 from anti-influenza_Chain
  source 1..333: mol_type = other RNA
gacatcgtgatgacccagagccccgacagcctggccgtgagcctgggcgagagagccaccatcaactgcaagagcagccagagcgtgaccttcaacaacaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagcactacagaaccccccccaccttcggccagggcaccaaggtggagatcaag

SEQ ID NO: 35395 - RNA, 333 nt, synthetic construct
  misc_feature 1..333: note = derived and/or modified sequence opt4 from anti-influenza_Chain
  source 1..333: mol_type = other RNA
cagagcgccctgacccagcccgccagcgtgagcggcagccccggccagagcatcaccatcagctgcaccggcaccggcagcgacgtgggcagcagcaacctggtgagctggtaccagcagcaccccgccaaggcccccaagctgatcatctacgaggtgaccaagagacccagcggcgtgagcaacagattcagcggcagcaagagcggcaacaccgccagcctgaccatcagcggcctgcaggccgaggacgaggccgactactactgctgcagctacgccggcagcagcagcagcagagtgttcggcaccggcaccaaggtgaccgtgctg

SEQ ID NO: 35396 - RNA, 333 nt, synthetic construct
  misc_feature 1..333: note = derived and/or modified sequence opt4 from anti-influenza_Chain
  source 1..333: mol_type = other RNA
cagagcgtgctgacccagccccccagcgccagcggcacccccggccagagagtgaccatcagctgcagcggcagcaccagcaacatcggcagcaacgccgtgaactggtaccagcagctgcccggcaccgcccccaagctgctgatctacagcaacaaccagagacccagcggcgtgcccgacagattcagcggcagcaagagcggcaccagcgccagcctggccatcagcggcctgcagagcgaggacgaggccgactactactgcgccgcctgggacgacagcctgagcggcagctgggtgttcggcggcggcaccaagctgaccgtgctg

SEQ ID NO: 35397 - RNA, 333 nt, synthetic construct
  misc_feature 1..333: note = derived and/or modified sequence opt4 from anti-influenza_Chain
  source 1..333: mol_type = other RNA
gagaccaccctgacccagagccccggcaccctgagcctgagccccggcgagagagccaccctgagctgcagagtgagccagagcgtgagcagcaactacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcaccagccccagagccttcggccacggcaccaaggtggagatcaagagaaccgtg

SEQ ID NO: 35398 - RNA, 333 nt, synthetic construct
  misc_feature 1..333: note = derived and/or modified sequence opt4 from anti-influenza_Chain
  source 1..333: mol_type = other RNA
cagagcgtgctgacccagccccccagcgtgagcggcgcccccggccagagagtgaccatcagctgcggcggcagcagaagcaacatcggcgccggctacgacgtgcactggtaccagcagttccccggcaccgcccccaaggtggtgatctacggcaacaacaacagacccagcggcgtgcccgacagattcagcggcagcaagagcggcaccagcgccagcctggccatcaccggcctgcaggccgaggacgaggccaactactactgccagagctacgacaccaacctgggcggcagcatcttcggcggcggcacccaggtgaccgtgctg

SEQ ID NO: 35399 - RNA, 333 nt, synthetic construct
  misc_feature 1..333: note = derived and/or modified sequence opt4 from anti-influenza_Chain
  source 1..333: mol_type = other RNA
aacttcatgctgacccagccccacagcgtgagcgagagccccggcaagaccgtgaccatcagctgcaccggcagcagcggcagcatcgccagcaactacgtgcagtggtaccagcagagacccggcagcgcccccaccaccgtgatctacgaggactaccagagacccagcggcgtgcccgacagattcagcggcagcatcgacagcagcagcaacagcgccagcctgaccatcagcggcctgaagaccgaggacgaggccgactactactgccagagctacgacgacagcgaccacctgatcttcggcggcggcaccaagctgaccgtgctg

SEQ ID NO: 35400 - RNA, 333 nt, synthetic construct
  misc_feature 1..333: note = derived and/or modified sequence opt4 from anti-influenza_Chain
  source 1..333: mol_type = other RNA
cagagcatgctgacccagccccccagcgccagcggcacccccggccagagagtgaccatcagctgcagcggcagcagcagcaacatcggcagcaacaccgtgaactggttcaagcacctgcccggcaccgcccccaagctgctgatctacagaaacgacctgagacccagcggcgtgcccgacagattcagcggcagcaagagcggcaccagcgccagcctggccatcagcggcctgcagagcgaggacgaggccgactactactgcgccacctgggacgacagcctgaacggcttctacgtgttcggcaccggcaccaaggtgaccgtgctg

SEQ ID NO: 35401 - RNA, 333 nt, synthetic construct
  misc_feature 1..333: note = derived and/or modified sequence opt4 from anti-influenza_Chain
  source 1..333: mol_type = other RNA
gacatccagctgacccagagccccagcagcctgagcgccagcgccggcgacagagtgagcatgacctgcagagccagccagatcatcagcagcagcctgaactggtaccagcagaagcccggcaaggcccccaagctgctgatctacgccgccagcaacctgcagagcggcgtgcccagcagattcagcggcagcggcagcggcaccgacttcaccctgaccatcagcagcctgcagcccgaggacttcgccacctactactgccagcagagctacagcaccccccccgagctgaccttcggcggcggcaccaaggtggacatcaagagaacc

SEQ ID NO: 35402 - RNA, 333 nt, synthetic construct
  misc_feature 1..333: note = derived and/or modified sequence opt4 from anti-influenza_Chain
  source 1..333: mol_type = other RNA
agctacgtgctgacccagccccccagcgccagcggcacccccggccagagagtgaccatcagctgcagcggcagcaccttcaacatcggcagcaacgccgtggactggtacagacagctgcccggcaccgcccccaagctgctgatctacagcaacaaccagagacccagcggcgtgcccgacagattcagcggcagcagaagcggcaccagcgccagcctggccatcagcggcctgcagagcgaggacgaggccgactactactgcgccgcctgggacgacatcctgaacgtgcccgtgttcggcggcggcaccaagctgaccgtgctgggc

SEQ ID NO: 35403 - RNA, 333 nt, synthetic construct
  misc_feature 1..333: note = derived and/or modified sequence opt4 from anti-influenza_Chain
  source 1..333: mol_type = other RNA
cagagcgccctgacccagcccgccgccgtgagcggcagccccggccagagcatcaccatcagctgcaccggcaccagcagcgacgtgggcggctacaactacgtgagctggtaccagcagcaccccggcaaggcccccaagctgatgatctacgaggtgagcaacagacccagcggcgtgagcaacagattcagcggcagcaagagcggcaacaccgccagcctgaccatcagcggcctgcaggccgaggacgaggccgactactactgcagcagctacaccagcagcagcacctacgtgttcggcaccggcaccaaggtgaccgtgctgggc

SEQ ID NO: 35404 - RNA, 333 nt, synthetic construct
  misc_feature 1..333: note = derived and/or modified sequence opt4 from anti-influenza_Chain
  source 1..333: mol_type = other RNA
agctacgtgctgacccagccccccagcgtgagcggcacccccggccagagagtgaccatcagctgcagcggcagcagaagcaacgtgggcgacaacagcgtgtactggtaccagcacgtgcccgagatggcccccaagctgctggtgtacaagaacacccagagacccagcggcgtgcccgccagattcagcggcagcaagagcggcaccagcgccagcctggccatcatcggcctgcagagcggcgacgaggccgactactactgcgtggcctgggacgacagcgtggacggctacgtgttcggcagcggcaccaaggtgaccgtgctgggc

SEQ ID NO: 35405 - RNA, 333 nt, synthetic construct
  misc_feature 1..333: note = derived and/or modified sequence opt4 from anti-influenza_Chain
  source 1..333: mol_type = other RNA
agcgtgctgacccagccccccagcgtgagcgccgcccccggccagaaggtgaccatcagctgcagcggcagcagcagcaacatcggcaacgactacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccaactactactgcgccacctgggacagaagacccaccgcctacgtggtgttcggcggcggcaccaagctgaccgtgctgggc

SEQ ID NO: 35406 - RNA, 333 nt, synthetic construct
  misc_feature 1..333: note = derived and/or modified sequence opt4 from anti-influenza_Chain
  source 1..333: mol_type = other RNA
cagagcgccctgacccagcccagaagcgtgagcggcagccccggccagagcgtgaccatcagctgcaccggcaccagcagcgacgtgggcggctacaactacgtgagctggtaccagcagcaccccggcaaggcccccaagctgatgatctacgacgtgagcaagagacccagcggcgtgcccgacagattcagcggcagcaagagcggcaacaccgccagcctgaccatcagcggcctgcaggccgaggacgaggccgactactactgcagcagctacaccagcagcagcacccacgtgttcggcaccggcaccaaggtgaccgtgctgggc

SEQ ID NO: 35407 - RNA, 333 nt, synthetic construct
  misc_feature 1..333: note = derived and/or modified sequence opt4 from anti-influenza_Chain
  source 1..333: mol_type = other RNA
agctacgtgctgacccagccccccagcgccagcggcacccccggccagagagtgaccatcagctgcagcggcagcagcagcaacatcggcagcaactacgtgtactggtaccagcagctgcccggcaccgcccccaagctgctgatctacagagacggccagagacccagcggcgtgcccgacagattcagcggcagcaagagcggcaccagcgccagcctggccatcagcggcctgagaagcgacgacgaggccgactactactgcgccacctgggacgacaacctgagcggccccgtgttcggcggcggcaccaagctgaccgtgctgggc

SEQ ID NO: 35408 - RNA, 333 nt, synthetic construct
  misc_feature 1..333: note = derived and/or modified sequence opt4 from anti-influenza_Chain
  source 1..333: mol_type = other RNA
cagagcgccctgacccagcccgccagcgtgagcggcagccccggccagagcatcaccatcagctgcaccggcaccagcagcgacgtgggcggctacaactacgtgagctggtaccagcagcaccccggcaaggcccccaagctgatgatctacgaggtgagcaacagacccagcggcgtgagcaacagattcagcggcagcaagagcggcaacaccgccagcctgaccatcagcggcctgcaggccgaggacgaggccgactactactgcagcagctacaccagcagcagcaccctggtgttcggcaccggcaccaaggtgaccgtgctgggc

SEQ ID NO: 35409 - RNA, 333 nt, synthetic construct
  misc_feature 1..333: note = derived and/or modified sequence opt4 from anti-influenza_Chain
  source 1..333: mol_type = other RNA
accgtgctgacccagccccccagcgtgagcggcgcccccggccagagagtgaccatcagctgcaccggcagcagcagcaacatcggcgccggctacgacgtgcactggtaccagcagctgcccggcaccgcccccaagctgctgatctacggcaacagcaacagacccagcggcgtgcccgacagattcagcggcagcaagagcggcaccagcgccaccctgggcatcaccggcctgcagaccggcgacgaggccgactactactgcggcacctgggacagcagcctgagcgcctacgtgttcggcaccggcaccaaggtgaccgtgctgggc

SEQ ID NO: 35410 - RNA, 333 nt, synthetic construct
  misc_feature 1..333: note = derived and/or modified sequence opt4 from anti-influenza_Chain
  source 1..333: mol_type = other RNA
ggcagcgccctgacccagcccagaagcgtgagcggcagccccggccagagcgtgaccatcagctgcaccggcaccagcagcgacgtgggcggctacaactacgtgagctggtaccagcagcaccccggcaaggcccccaagctgatgatctacgacgtgagcaagagacccagcggcgtgcccgacagattcagcggcagcaagagcggcaacaccgccagcctgaccatcagcggcctgcaggccgaggacgaggccgactactactgcagcagctacaccagcagcagcacccacgtgttcggcaccggcaccaaggtgaccgtgctgggc

SEQ ID NO: 35411 - RNA, 333 nt, synthetic construct
  misc_feature 1..333: note = derived and/or modified sequence opt4 from anti-influenza_Chain
  source 1..333: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatcttcggcgccagcaccagagccaccggcatccccgacagattcagcggcagcggcagcggcaccgacttcaccctgaccatcagcagactggagcccgaggacttcgccgtgttctactgccagcagtacggcagcctgcccctgaccttcggcggcggcaccaaggtggagatcaagggcaccgtg

SEQ ID NO: 35412 - RNA, 333 nt, synthetic construct
  misc_feature 1..333: note = derived and/or modified sequence opt4 from anti-influenza_Chain
  source 1..333: mol_type = other RNA
gagatcgtgctgacccagagccccggcaccctgagcctgagccccggcgagagagccaccctgagctgcagagccagccagagcgtgagaagcaacaacctggcctggtaccagcacaagcccggccaggcccccagactgctgatcttcggcgccagcagcagagccaccggcatccccgacagattcagcggcagcggcagcggcaccgacttcaccctgaccatcagcagactggagcccgaggacttcgccgtgtactactgccagcagtacggcagcagccccgccctgaccttcggcggcggcaccaaggtggagatcaagagaacc

SEQ ID NO: 35413 - RNA, 333 nt, synthetic construct
  misc_feature 1..333: note = derived and/or modified sequence opt4 from anti-influenza_Chain
  source 1..333: mol_type = other RNA
cagagcctggaggagagcggcggcggcctggtgaagcccggcggcagcctgaccctgacctgcaccgtgagcggcctgagcctgtacagcaacgagatcaactgggtgagacaggcccccggcaacggcctggagtggatcggcgccatcgccggcagcggcagcgccgactacgccagctgggccaagggcagaagcaccatcaccagaaacaccgacctgaacaccgtgaccctgaagatgaccagcctgaccgccgccgacaccgccacctacttctgcgccagcttctgggacctgtggggccccggcaccctggtgaccgtgagcagc

SEQ ID NO: 35414 - RNA, 333 nt, synthetic construct
  misc_feature 1..333: note = derived and/or modified sequence opt4 from anti-influenza_Chain
  source 1..333: mol_type = other RNA
cagagcgtggaggagagcggcggcggcctggtgaagcccggcggcagcctgaccctgacctgcaccgtgagcggcctgagcctgtacagcaacgagatcaactgggtgagacaggcccccggcaacggcctggagtggatcggcgccatcgccggcagcggcagcgccgactacgccagctgggccaagagcagaagcaccatcaccagaaacaccaacctgaacaccgtgaccctgaagatgaccagcctgaccgccgccgacaccgccacctacttctgcgccagcttctgggacctgtggggccccggcaccctggtgaccgtgagcagc

SEQ ID NO: 35415 - RNA, 333 nt, synthetic construct
  misc_feature 1..333: note = derived and/or modified sequence opt4 from anti-influenza_Chain
  source 1..333: mol_type = other RNA
cagagcctggaggagagcggcggcggcctggtgaagcccggcggcagcctgaccctgacctgcaccgtgagcggcctgagcctgtacagcaacgagatcaactgggtgagacaggcccccggcaacggcctggagtggatcggcgccatcgccggcagcggcagcgccgactacgccagctgggccaagagcagaagcaccatcaccagaaacaccaacctgaacaccgtgaccctgaagatgaccagcctgaccgccgccgacaccgccacctacttctgcgccagcttctgggacctgtggggccccggcaccctggtgaccgtgagcagc

SEQ ID NO: 35416 - RNA, 333 nt, synthetic construct
  misc_feature 1..333: note = derived and/or modified sequence opt4 from anti-influenza_Chain
  source 1..333: mol_type = other RNA
aacatcgtgctgacccagagccccgccagcctggccgtgagcctgggccagagagccaccatcagctgcagagccagcgagagcgtggacatctacggcaacagcttcatgcactggtaccagcagaagcccggccagccccccaagctgctgatctacctggccagcaagctggagtgcggcgtgtgcgccagattcaacggcagcggctgcagaaccgacttcaccctggccatcgaccccgtggagggcgacgacggcgccacctactactgccagcagaactacgaggacccctggaccttcggcggcggcaccaagctggagatcaag

SEQ ID NO: 35417 - RNA, 333 nt, synthetic construct
  misc_feature 1..333: note = derived and/or modified sequence opt4 from anti-influenza_Chain
  source 1..333: mol_type = other RNA
aacatcgtgctgacccagagccccgccagcctggccgtgagccccggccagagagccaccatcagctgcagagccagcgagagcatcgacatctacggcaacagcttcatgcactggtaccagaagaagcccggccagccccccaagctgctgatctacagagccagcaacctggagagcggcgtgcccgccagattcaacggcagcggcagcagaaccgacttcaccctgaccatcgaccccgtggagggcgacgacggcgccacctactactgccagcagaactacgaggacccctggaccttcggcggcggcaccaagctggagatcaag

SEQ ID NO: 35418 - RNA, 333 nt, synthetic construct
  misc_feature 1..333: note = derived and/or modified sequence opt4 from anti-influenza_Chain
  source 1..333: mol_type = other RNA
gagatcgtgctgacccagagccccgccaccctgagcctgtaccccggcgagagagccaccctgagctgcagagccagccagagcgtgagcagatacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggctgaagatcaccttcggccagggcaccagactggagatcaagggcaccgtg

SEQ ID NO: 35419 - RNA, 336 nt, synthetic construct
  misc_feature 1..336: note = derived and/or modified sequence opt4 from anti-influenza_Chain
  source 1..336: mol_type = other RNA
gacatcgtgatgacccagagccccgacagcctggccgtgagcctgggcgagagagccaccatcaactgcaagagcagccagagcgtgctgtacagcagcaacaacaagaactacctggcctggtaccagcagaagcccggccagccccccaagctgctgatcgactgggccagcaccagagagagcggcgtgcccgacagattcagcggcagcggcagcggcaccgacttcaccctgaccatcagcaacctgcaggtggaggacgtggccgtgtactactgccagcagtactacagaagccccagcttcggccagggcaccaagctggagatcaag

SEQ ID NO: 35420 - RNA, 336 nt, synthetic construct
  misc_feature 1..336: note = derived and/or modified sequence opt4 from anti-influenza_Chain
  source 1..336: mol_type = other RNA
gacatcgtgatgacccagacccccctgagcctgagcgtgacccccggccagcccgccagcatcagctgcaagagcagccagagcctgctgcacagcgacggcaagacctacctgtactggtacctgcagaagcccggccagagcccccagctgctgatctacgaggtgagcaacagattcagcggcgtgcccgacagattcagcggcagcggcagcggcaccgacttcaccctgaagatcagcagagtggaggccgaggacgtgggcgtgtactactgcatgcagaacatcctgctgcccctgaccttcggcggcggcaccaaggtggagatcaag

SEQ ID NO: 35421 - RNA, 336 nt, synthetic construct
  misc_feature 1..336: note = derived and/or modified sequence opt4 from anti-influenza_Chain
  source 1..336: mol_type = other RNA
gagatcgtgatgacccagacccccctgagcctgagcgtgacccccggccagcccgccagcatcagctgcagaagcagccagagcctgctgcacagcgacggcaagacctacctgtactggtacctgcagaagcccggccagcccccccagctgctgatcagcgaggtgttcaacagattcagcggcgtgcccgacagattcagcggcagcggcagcggcaccgacttcaccctgaagatcagcagagtggaggccgaggacgtgggcgtgtactactgcatgcagagcctgcagctgcccctgaccttcggcggcggcaccaaggtggagatcaag

SEQ ID NO: 35422 - RNA, 336 nt, synthetic construct
  misc_feature 1..336: note = derived and/or modified sequence opt4 from anti-influenza_Chain
  source 1..336: mol_type = other RNA
gacatcgtgatgacccagagccccctgagcctgcccgtgacccccggcgagcccgccagcatcagctgcagagccagccagagcctgctgcacagcaacggctacaactacctggactggtacctgcagaagcccggccagagcccccagctgctgatccagctgggcagcaccagagccagcggcgtgcccgacagattcagcggcagcggcagcggcaccgacttcaccctggagatcagcagagtggaggccgaggacgtgggcgtgtactactgcatgcaggccctgcagctgcccctggccttcggccagggcaccagactggagatcaag

SEQ ID NO: 35423 - RNA, 336 nt, synthetic construct
  misc_feature 1..336: note = derived and/or modified sequence opt4 from anti-influenza_Chain
  source 1..336: mol_type = other RNA
gacatcgtgatgacccagagccccctgagcctgcccgtgagccccggcgagcccgccagcatcagctgcagaagcagccagagcctgctgcacggcaacggctacaactacctggactggtacctgcagaagcccggccagagccccagactgctgatctacctgggcagcaacagagccagcggcgtgcccgacagattcagcggcagcggcagcggcaccgacttcaccctgaagatcagcagagtggaggccgaggacgtgggcgtgtactactgcatgcaggccctgcagacccccctgaccttcggcggcggcaccaaggtggagatcaag

SEQ ID NO: 35424 - RNA, 336 nt, synthetic construct
  misc_feature 1..336: note = derived and/or modified sequence opt4 from anti-influenza_Chain
  source 1..336: mol_type = other RNA
cagagcgtgctgacccagccccccagcgtgagcggcgcccccggccagagagtgaccatcagctgcaccggcagcagcagcaacatcggcgccggctacgacgtgcactggtaccagcagctgcccggcaccgcccccaagctgctgatctacgacaacaacaacagacccagcggcgtgcccgacagattcagcggcagcaagagcggcgccagcgccagcctggccatcaccggcctgcaggccgaggacgaggcccactactactgccagagctacgacaacagcctgagcggcagcgtgttcggcggcggcacccagctgaccgtgctgagc

SEQ ID NO: 35425 - RNA, 336 nt, synthetic construct
  misc_feature 1..336: note = derived and/or modified sequence opt4 from anti-influenza_Chain
  source 1..336: mol_type = other RNA
cagagcgtgctgacccagccccccagcgtgagcggcgcccccggccagagagtgaccatcagctgcaccggcagcagcagcaacatcggcagcgactacgacgtgcactggtacaagcagctgcccggcaccgcccccaagctgctgatcttcggcaacagcaacagacccagcggcgtgcccgacagattcagcggcagcaagagcggcaccagcgccagcctggccatcaccggcctgcaggccgaggacgaggccgactactactgccagagctacgacagcagcctgagcggcttccacgtgttcggcagcggcaccaaggtgaccgtgctg

SEQ ID NO: 35426 - RNA, 336 nt, synthetic construct
  misc_feature 1..336: note = derived and/or modified sequence opt4 from anti-influenza_Chain
  source 1..336: mol_type = other RNA
cagagcgtgctgacccagccccccagcgtgagcgccgcccccggccagaaggtgaccatcagctgcagcggcagcagcagcaacatcggcaacgactacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccaactactactgcgccacctgggacagaagacccaccgcctacgtggtgttcggcggcggcaccaagctgaccgtgctgggc

SEQ ID NO: 35427 - RNA, 336 nt, synthetic construct
  misc_feature 1..336: note = derived and/or modified sequence opt4 from anti-influenza_Chain
  source 1..336: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcaccagagccaccggcatccccgacagattcagcggcagaggcagcggcaccgacttcaccctgaccatcagcagcctggagcccgaggacttcgccgtgtactactgccagaactacggcagccccttcctgttcaccttcggccccggcaccaaggtggacatcaagagaaccgtg

SEQ ID NO: 35428 - RNA, 336 nt, synthetic construct
  misc_feature 1..336: note = derived and/or modified sequence opt4 from anti-influenza_Chain
  source 1..336: mol_type = other RNA
gacatccagctgacccagagccccctgagcccccccgtgaccctgggccagcccgccagcatcagctgcagaagcagccagagcctgctgtacaccgacggcttcacctacctgagctggtaccaccagagacccggccagagccccagaagactgatctacaagatcagcaacagagacagcggcgtgcccgacagattcagcggcagcggcagcggcaccgacttcaccctgaagatcagcagagtggaggccgaggacgtgggcgtgtactactgcatgcaggccacccactggcccctgaccttcggcgagggcaccaaggtggagatcaag

SEQ ID NO: 35429 - RNA, 336 nt, synthetic construct
  misc_feature 1..336: note = derived and/or modified sequence opt4 from anti-influenza_Chain
  source 1..336: mol_type = other RNA
gacatcgagctgacccaggagcccagcgccagcggcacccccggccagagagtgaccatcagctgcagcggcgacaccagcaacatcggcagcaacaccgtgagctggttccagctgctgcccggcaccgcccccaagctgctgatcttcaccgacaaccagagacccagcggcgtgcccggcagattcagcggcagcaagagcggcaccagcgccagcctggccatcagcggcctgcagagcgaggacgagaccgactactactgcgccgcctgggacgacagcctgaacggctgggtgttcggcggcggcaccaagctgaccgtgctgggccag

SEQ ID NO: 35430 - RNA, 336 nt, synthetic construct
  misc_feature 1..336: note = derived and/or modified sequence opt4 from anti-influenza_Chain
  source 1..336: mol_type = other RNA
gacatcgtgctgacccagagccccagcgccagcggcagccccggccagagcgtgaccatcagctgcaccggcaccagcagcgacgtgggcggctacgactacgtgagctggtaccagcagcaccccggcaaggcccccaagctgatgatctacgaggtgagaaagagacccagcggcgtgcccgacagattcagcggcagcaagagcggcaacaccgccagcctgaccgtgagcggcctgcaggccgaggacgaggcctactactactgcgccagctacgccggcacctacatccacctgttcggcggcggcaccaagctgaccgtgctgggccag

SEQ ID NO: 35431 - RNA, 336 nt, synthetic construct
  misc_feature 1..336: note = derived and/or modified sequence opt4 from anti-influenza_Chain
  source 1..336: mol_type = other RNA
caggagcagctgatggagagcggcggcggcctggtgaagcccggcggcagcctgaccctgacctgcaccgtgagcggcctgagcctgtacagcaacgagatcaactgggtgagacaggcccccggcaacggcctggagtggatcggcgccatcgccggcagcggcagcgccgactacgccagctgggccaagagcagaagcaccatcaccagaaacaccaacctgaacaccgtgaccctgaagatgaccagcctgaccgccgccgacaccgccacctacttctgcgccagcttctgggacctgtggggccccggcaccctggtgaccgtgagcagc

SEQ ID NO: 35432 - RNA, 336 nt, synthetic construct
  misc_feature 1..336: note = derived and/or modified sequence opt4 from anti-influenza_Chain
  source 1..336: mol_type = other RNA
cagcagcagctgatggagagcggcggcggcctggtgaagcccggcggcagcctgaccctgacctgcaccgtgagcggcctgagcctgtacagcaacgagatcaactgggtgagacaggcccccggcaacggcctggagtggatcggcgccatcgccggcagcggcagcgccgactacgccagctgggccaagagcagaagcaccatcaccagaaacaccgacctgaacaccgtgaccctgaagatgaccagcctgaccgccgccgacaccgccacctacttctgcgccagcttctgggacctgtggggccccggcaccctggtgaccgtgagcagc

SEQ ID NO: 35433 - RNA, 336 nt, synthetic construct
  misc_feature 1..336: note = derived and/or modified sequence opt4 from anti-influenza_Chain
  source 1..336: mol_type = other RNA
cagcagcagctggtggagagcggcggcggcctggtgaagcccggcggcagcctgaccctgacctgcagagtgagcggcctgagcctgttcagcaacgagatcaactgggtgagacaggcccccggcaacggcctggagtggatcggcgccatcggcggcggcggcagcgccgactacgccagctgggccaagagcagaagcaccatcaccagaaacaccaacctgaacaccgtgaccctgagaatgaccagcctgaccgccgccgacaccgccgcctacttctgcgccagcttctgggacctgtggggccccggcaccctggtgaccgtgagcagc

SEQ ID NO: 35434 - RNA, 336 nt, synthetic construct
  misc_feature 1..336: note = derived and/or modified sequence opt4 from anti-influenza_Chain
  source 1..336: mol_type = other RNA
gaggtgcagctggtggagagcggcggcggcctggtgaagcccggcggcagcctgagactgagctgcgccgccagcggcctgagcctgttcagcaacgagatcaactgggtgagacaggcccccggcaagggcctggagtggatcggcgccatcggcggcggcggcagcgccgactacgccagctgggccaagagcagattcaccatcagcagagacaacgccaagaacagcctgtacctgcagatgaacagcctgagagccgaggacaccgccgtgtacttctgcgccagcttctgggacctgtggggccccggcaccctggtgaccgtgagcagc

SEQ ID NO: 35435 - RNA, 336 nt, synthetic construct
  misc_feature 1..336: note = derived and/or modified sequence opt4 from anti-influenza_Chain
  source 1..336: mol_type = other RNA
gacatcgtgatgacccagagccccctgagcctgcccgtgacccccggcgagcccgccagcatcagctgcagaagcagccagagcctgctgagaagcaacggctacaactacctggactggtacctgcagaagcccggccagagcccccagctgctgatctacctgggcagcaacagagccagcggcgtgcccgacagattcagcggcagcggcagcggcaccgacttcaccctgaagatcagcagagtggaggccgaggacgtgggcgtgtactactgcatgcaggccctgcagaccccctacaccttcggccagggcaccaagctggagatcaag

SEQ ID NO: 35436 - RNA, 339 nt, synthetic construct
  misc_feature 1..339: note = derived and/or modified sequence opt4 from anti-influenza_Chain
  source 1..339: mol_type = other RNA
gacatcgtgatgacccagagccccgacttcctgcccgtgagcctgggcgagagagccaccatcaactgcaagagcagccagagagtgctgtacagcagcaacaacaagaactacctggcctggtaccagctgaagcccggccagccccccaagctgatcatctactgggccagcaccagagagagcggcgtgcccgacagattcagcggcagcggcagcggcaccgagttcaccctgaccatcagcagcctgcaggccgaggacgtggccgtgtactactgccagcagtactacagcagaccctacaccttcggccagggcaccaagctggagatcaag

SEQ ID NO: 35437 - RNA, 339 nt, synthetic construct
  misc_feature 1..339: note = derived and/or modified sequence opt4 from anti-influenza_Chain
  source 1..339: mol_type = other RNA
gacatcgtgatgacccagagccccgacagcctggccgtgagcctgggcgagagagccaccatcaactgcaagagcagccagagcgtgctgtacagcagcaacaacaagaactacctggcctggtaccagcagaagcccggccagccccccaagctgctgatctactgggccagcaccagagagagcggcgtgcccgacagaatcagcggcagcggcagcggcgccgacttcaccctgaccatcagcagcctgcaggccgaggacgtggccgtgtactactgccagcagtacttcgccacccccagaaccttcggccagggcaccaaggtggagatcaag

SEQ ID NO: 35438 - RNA, 339 nt, synthetic construct
  misc_feature 1..339: note = derived and/or modified sequence opt4 from anti-influenza_Chain
  source 1..339: mol_type = other RNA
gacatcgtgatgacccagagccccgacagcctggccgtgagcctgggcgagagagccaccatcaactgcaagagcagccagagcgtgctgtacagcagcaacaacaagagccacctggcctggtaccagcagaagcccggccagccccccaagctgctgatctactgggccagcaccagagagagcggcgtgcccgacagattcagcggcagcggcagcggcaccgacttcaccctgatcatcagcagcctgcaggccgaggacgtggccgtgtactactgccagcagtactacttcagccccctgaccttcggcggcggcaccaaggtggagatcaag

SEQ ID NO: 35439 - RNA, 339 nt, synthetic construct
  misc_feature 1..339: note = derived and/or modified sequence opt4 from anti-influenza_Chain
  source 1..339: mol_type = other RNA
gacatcgtgatgacccagagccccgacagcctggccgtgagcctgggcgagagagccaccatcaactgcagaagcagccagagcatcttccacaacagcaacaacgagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtacttctgccagcagtactacaacgcccccctgaccttcggcggcggcaccaaggtggagatcaag

SEQ ID NO: 35440 - RNA, 339 nt, synthetic construct
  misc_feature 1..339: note = derived and/or modified sequence opt4 from anti-influenza_Chain
  source 1..339: mol_type = other RNA
gagatcgtgctgacccagagccccctgagcctgcccgtgacccccggcgagcccgccagcatcagctgcagaagcagccagagcctgctgcacagcaacggctacaactacctggactggtacctgcagaagcccggccagagcccccagctgctgatctacctgggcagcaacagagccagcggcgtgcccgacagattcagcggcagcggcagcggcaccgacttcaccctgaagatcagcagagtggaggccgaggacgtgggcgtgtactactgcatgcaggccctgcagacccccctgaccttcggcggcggcaccaaggtggagatcaagaga

SEQ ID NO: 35441 - RNA, 339 nt, synthetic construct
  misc_feature 1..339: note = derived and/or modified sequence opt4 from anti-influenza_Chain
  source 1..339: mol_type = other RNA
gacatcgtgctgacccagccccccagcgtgagcgtggcccccggccagaccgccaccatcacctgcggcggcaactacatcggcagcaagagcgtgaactggtaccagcagagacccggccacgcccccgtgctggtggtgtacgacgacagcgacagacccagcggcatccccgacagattcagcggcagcaacagcagaagcaccgccaccaccgccaccctgaccatcagcagagtggaggccggcgacgaggccgactactactgccaggtgtgggagaccagcgaggacctgtgggtgttcggcggcggcaccaagctgaccgtgctgggccag

SEQ ID NO: 35442 - RNA, 342 nt, synthetic construct
  misc_feature 1..342: note = derived and/or modified sequence opt4 from anti-influenza_Chain
  source 1..342: mol_type = other RNA
gacgtggtgatgacccagagccccgacagcctggccgtgagcctgggcgagagagccaccatcaactgcaagagcagccagagcgtgctgtacagcagcaacaacaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagtactacagcacccccctgaccttcggcggcggcaccaaggtggacatcaagaga

SEQ ID NO: 35443 - RNA, 342 nt, synthetic construct
  misc_feature 1..342: note = derived and/or modified sequence opt4 from anti-influenza_Chain
  source 1..342: mol_type = other RNA
gacatccagatgacccagagccccgacagcctggccgtgagcctgggcgagaaggccaccatcaactgcaagagcagccagagcatcctgaacagcagcaacaacaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagtactacagcagcccccccaccttcggccagggcaccaaggtggagatcaagaga

SEQ ID NO: 35444 - RNA, 342 nt, synthetic construct
  misc_feature 1..342: note = derived and/or modified sequence opt4 from anti-influenza_Chain
  source 1..342: mol_type = other RNA
gagatcgtgctgacccagagccccgccaccctgagcctgtaccccggcgagagagccaccctgagctgcagagccagccagagcgtgagcagatacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgctgcgacagacagcagagaagcaactggctgaagatcaccttcggccagggcaccagactggagatcaagggcaccgtg

SEQ ID NO: 35445 - RNA, 342 nt, synthetic construct
  misc_feature 1..342: note = derived and/or modified sequence opt4 from anti-influenza_Chain
  source 1..342: mol_type = other RNA
gacatcgtgatgacccagagccagaagttcgtgagcaccagcgtgggcgacagagtgagcgtgacctgcaaggccagccagaacgtgggcagcaacgtggcctggtaccagcacaagcccggccacagccccaccgccctgatctacagcgccagccacagatacagcggcgtgcccgacagattcaccggcagcgagagcggcaccgacttcaccctgaccatcagcaacgtgcagagcgaggacctggccgagtacttctgccagcagtactacagctacccctacaccttcggcggcggcaccaagctggagatcaagagagccgacgccgcccccacc

SEQ ID NO: 35446 - RNA, 342 nt, synthetic construct
  misc_feature 1..342: note = derived and/or modified sequence opt4 from anti-influenza_Chain
  source 1..342: mol_type = other RNA
gacatcgagatgacccagagccccctgagcctgcccgtgacccccggcgagagcgccagcatcagctgcagaagcagccagagcctgctgcacagcaacggctacaactacctggactggtacctgcagaagcccggccagagcccccagctgctgatctacctgggcagcagcagagccagcggcgtgcccgacagattcagcggcagcggcagcggcaccgacttcaccctgaagatcagcagagtggaggccgaggacgtgggcgtgtactactgcatgcagggcctgcagaccccctacaccttcggccagggcaccaagctggagatcaagagaacc

SEQ ID NO: 35447 - RNA, 342 nt, synthetic construct
  misc_feature 1..342: note = derived and/or modified sequence opt4 from anti-influenza_Chain
  source 1..342: mol_type = other RNA
gacatcgagatgacccagagccccctgagcctgcccgtgacccccggcgagcccgccagcatcagctgcagaagcagccagagcctgctgcacagcaacggctacaaccacctggcctggtacctgcagaagcccggcagaagcccccacctgctgatctacctggccagcaccagagccagcggcgtgcccgacagattcagcggcagcggcagcggcaccgacttcaccctgaagatcagcagagtggaggccgaggacgtgggcatctactactgcatgcagagcctgcagaccagcatcaccttcggccagggcaccagactggagatcaagagaacc

SEQ ID NO: 35448 - RNA, 345 nt, synthetic construct
  misc_feature 1..345: note = derived and/or modified sequence opt4 from anti-influenza_Chain
  source 1..345: mol_type = other RNA
caggtgcagctggtgcagagcggcgccgaggtgaagaagcccggcagcagcgtgagagtgagctgcaagaccagcggcggcaccttcagcagctacgccgtgacctgggtgagacaggcccccggccagggcctggagtggatgggcggcatcatcggcatgttcggcaccaccaactacgcccagaagttccagggcagactgaccatcaccgccgacgagatgaccagcaccgcctacatggagctgagcagcctgagaagcgaggacaccgccgtgtactactgcgccagaggcagctactactacgagaccaccctggactactggggcagaggcaccctg

SEQ ID NO: 35449 - RNA, 345 nt, synthetic construct
  misc_feature 1..345: note = derived and/or modified sequence opt4 from anti-influenza_Chain
  source 1..345: mol_type = other RNA
gaggtgcagctggtgcagagcggcgccgaggtgaagaagcccggcagcagcgtgaaggtgagctgcaagaccagcggcggcaccttcagcagctacgccgtgacctgggtgagacaggcccccggccagggcctggagtggatgggcgccatcatcggcatgttcggcaccaccaactacgcccagaagttccagggcagagtgaccatcaccgccgacgagctgaccagcaccgcctacatggagctgagcagcctgagaagcgacgacaccgccgtgtactactgcgccagaggcagctactactacgagagcagcctggactactggggcaagggcaccctg

SEQ ID NO: 35450 - RNA, 345 nt, synthetic construct
  misc_feature 1..345: note = derived and/or modified sequence opt4 from anti-influenza_Chain
  source 1..345: mol_type = other RNA
caggtgcagctggtgcagagcggcgccgaggtgaagaagcccggcagcagcgtgaaggtgagctgcaagaccagcggcggcaccttcagcagctacgccgtgacctgggtgagacaggcccccggccagggcctggagtggatgggcggcatcatcggcatgttcggcaccaccaactacgcccagaagttccagggcagagtgaccatcaccgccgacgagctgaccagcaccgcctacatggagctgagcagcctgagaagcgaggacaccgccgtgtactactgcgccagaggcagctactactacgagagcagcctggactactggggcagaggcaccctg

SEQ ID NO: 35451 - RNA, 345 nt, synthetic construct
  misc_feature 1..345: note = derived and/or modified sequence opt4 from anti-influenza_Chain
  source 1..345: mol_type = other RNA
gaggtgcagctggtgcagagcggcgccgaggtgaagaagcccggcgccagcgtgaaggtgagctgcaaggccagcggctacaccttcaccggctactacgtgtactgggtgagacaggcccccggccagggcctggagtggatgggctggatcagcgcctacaacggcaacaccaactacgcccagaagttccagggcagagtgaccatcaccgccgacaagagcaccagcaccgcctacatggagctgagcagcctgagaagcgaggacaccgccgtgtactactgcgccagaagcagaagcctggacgtgtggggccagggcaccaccgtgaccgtgagcagc

SEQ ID NO: 35452 - RNA, 345 nt, synthetic construct
  misc_feature 1..345: note = derived and/or modified sequence opt4 from anti-influenza_Chain
  source 1..345: mol_type = other RNA
gacatcgtgatgacccagagccccctgagcctgcccgtgacccccggcgagcccgccagcatcagctgcagaagcagccagagcctgctgcacagcaacggccacatctacttcgactggtacctgcagaagcccggccagagcccccagctgctgatctacctggtgagcaagagagccagcggcgtgcccgacagattcagcggcagcggcagcggcaccgacttcaccctgaagatcagcagagtggaggccgaggacgtgggcgtgtactactgcatgcaggccctggagacccccttcaccttcggccccggcaccaaggtgcacatcaagagaaccgtg

SEQ ID NO: 35453 - RNA, 345 nt, synthetic construct
  misc_feature 1..345: note = derived and/or modified sequence opt4 from anti-influenza_Chain
  source 1..345: mol_type = other RNA
cagagcgccctgacccagcccgccagcgtgagcggcagccccggccagagcatcaccatcagctgcaccggcaccagcagcgacgtgggcgcctacaactacgtgagctggtaccagcaccaccccggcaaggcccccaagctgatgatctacgacgtgacctacagacccagcggcgtgagcaccagattcagcggcagcaagagcggcaacaccgccagcctgaccatcagcggcctgcaggccgaggacgaggccgactactactgcagcagccagagcagaagcagcaccctggtgatcttcggcggcggcaccaagctgaccgtgctgggccagcccaag

SEQ ID NO: 35454 - RNA, 345 nt, synthetic construct
  misc_feature 1..345: note = derived and/or modified sequence opt4 from anti-influenza_Chain
  source 1..345: mol_type = other RNA
gacatcgtgctgacccagagccccgtgagcctggccgtgagcctgggcgagagcgccaccgtgaactgcaagagcagccagagcgtgctgagcaacagcaagaacctgaactacctggcctggtaccagcacaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagcactacagcatccccctgaccttcggccccggcaccaaggtggacatcaagagaacc

SEQ ID NO: 35455 - RNA, 348 nt, synthetic construct
  misc_feature 1..348: note = derived and/or modified sequence opt4 from anti-influenza_Chain
  source 1..348: mol_type = other RNA
gacatcgtgctgacccagagccccctgagcctgcccgtgacccccggcgagcccgccagcatcagctgcagaagcagccagagcctgctggacagcaacggctacaactacctggactggtacctgcagaagcccggccagagcccccagctgctgatctacctggccagctacagagcccccggcgtgcccgacagattcagcggcagcggcagcggcaccgacttcaccctgaagatcagcagagtggaggccgaggacgtgggcctgtactactgcatgcaggccctgcagaccccccccatgtacaccttcggccagggcaccaagctggagatcaagagaacc

SEQ ID NO: 35456 - RNA, 351 nt, synthetic construct
  misc_feature 1..351: note = derived and/or modified sequence opt4 from anti-influenza_Chain
  source 1..351: mol_type = other RNA
ctggagagcggcggcggcctggtgcagcccggcggcagcctgagactgagctgcgccgccagcggcatcaccttcagcagctacgccatgagctgggtgagacaggcccccggcaagggcctggagtgggtgagcaccgtgaacagcggcggcggcagcacctactacggcgacagcgtgagaggcagattcaccatcagcagagacaacagcaagagcaccctgtacctgcagctgaacagcctgagagccgaggacaccgccatctactactgcgccaaggacaagggcagacccatcttcggcctggtgacccccagctactacatggacgtgtggggcaacggcacc

SEQ ID NO: 35457 - RNA, 351 nt, synthetic construct
  misc_feature 1..351: note = derived and/or modified sequence opt4 from anti-influenza_Chain
  source 1..351: mol_type = other RNA
caggagcagctggtgcagagcggcgccgaggtgaagaagcccggcgccagcgtgaaggtgagctgcaaggccagcagaaagagcttcatcggctactacgtgcactgggtgagacaggcccccggccagggcctggagtggatgggctggatcagccccgacagcgacgccaccaagtacgcccagaagttccagggcagcgtgatcatgaccagagacaccagcgtgagcaccgtgtacatggagctgagcagactgaccagcgacgacaccgccctgtactactgcctgctgttcagaggcggcaacagcctgagctggggccagggcaccctggtgaccgtgagcagc

SEQ ID NO: 35458 - RNA, 351 nt, synthetic construct
  misc_feature 1..351: note = derived and/or modified sequence opt4 from anti-influenza_Chain
  source 1..351: mol_type = other RNA
caggtgcagctgcaggagagcggccccggcctggtgaagcccagcgagaccctgagcctgacctgcaccgtgagcggcagcagcatcagcaactactactggagctggatcagacagagccccggcaagggcctggagtggatcggcttcatctactacggcggcaacaccaagtacaaccccagcctgaagagcagagtgaccatcagccaggacaccagcaagagccaggtgagcctgaccatgagcagcgtgaccgccgccgagagcgccgtgtacttctgcgccagagccagctgcagcggcggctactgcatcctggactactggggccagggcaccctggtgacc

SEQ ID NO: 35459 - RNA, 351 nt, synthetic construct
  misc_feature 1..351: note = derived and/or modified sequence opt4 from anti-influenza_Chain
  source 1..351: mol_type = other RNA
gaggtgcagctggtggagagcggcggcggcctggtgcagcccggcggcagcctgagactgagctgcgccgccagcggcttcaccttcagcatctacgccatgagctgggtgagacaggcccccggcaagggcctggagtgggtgagcgccatcagcagcagcggcgacagcacctactacgccgacagcgtgaagggcagattcaccatcagcagagacaacgccagaaacaccctgtacctgcagatgaacagcctgagagccgaggacaccgccgtgtactactgcgccagagcctacggctacaccttcgacccctggggccagggcaccctggtgaccgtgagcagc

SEQ ID NO: 35460 - RNA, 354 nt, synthetic construct
  misc_feature 1..354: note = derived and/or modified sequence opt4 from anti-influenza_Chain
  source 1..354: mol_type = other RNA
caggtgcagctgcaggagagcggccccggcctggtgaagcccagcgagaccctgagcctgacctgcaccgtgagcggctacagcttcgacagcggctactactggggctggctgagacagccccccggcaagggcctggagtggatcggcagcatctaccacagcagaaacacctactacaaccccagcctgaagagcagagtgaccatcagcgtggacaccagcaagaaccagttcagcctgcagctgagcagcgtgaccgccgccgacaccgccgtgtactactgcgccagaggcacctggtacagcagcaacctgagatactggttcgacccctggggcaagggcaccctg

SEQ ID NO: 35461 - RNA, 354 nt, synthetic construct
  misc_feature 1..354: note = derived and/or modified sequence opt4 from anti-influenza_Chain
  source 1..354: mol_type = other RNA
cagcccgtgctgacccagccccccagcgccagcgccagcctgggcgccagcgtgaccctgacctgcaccctgagcagcgcctacagcaactacaaggtggactggtaccagcagagacccggcaagggccccagattcgtgatgagagtgggcaccggcggcatcgtgggcagcaagggcgacggcatccccgacagattcagcgtgctgggcagcggcctgaacagatacctgaccatcaagaacatccaggaggaggacgagagcgactaccactgcggcgccgaccacggcagcggcagcaacttcgtgagcccctacgtgttcggcggcggcaccaagctgaccgtgctg

SEQ ID NO: 35462 - RNA, 354 nt, synthetic construct
  misc_feature 1..354: note = derived and/or modified sequence opt4 from anti-influenza_Chain
  source 1..354: mol_type = other RNA
caggtgcagctggtgcagagcggcgccgacgtgaagaagcccggcagcagcgtgaccgtgagctgcaaggccagcggcggcagcttcagcaactacggcatcaactgggtgagacaggcccccggccagggcctggagtggatgggcggcatcatccccctgatcaacgcccccaactacgcccccaagttccagggcagagtgaccatcaccgccgacatgttcagcaacatcgtgagcctgcagctgaccagcctgagaaccgacgacaccgccgtgtactactgcgccagaagaaagatgaccaccgccatcgactactggggccagggcaccctggtgaccgtgagcagc

SEQ ID NO: 35463 - RNA, 354 nt, synthetic construct
  misc_feature 1..354: note = derived and/or modified sequence opt4 from anti-influenza_Chain
  source 1..354: mol_type = other RNA
caggtgcagctggtgcagagcggcgccgaggtgaagaagcccggcagcagcgtgaaggtgagctgcagagagagcggcggcaccttcaacggctacaccatcacctgggtgagacaggcccccggccagggcctggagtggatgggcggcatcatccccatgatgggcaccgtgaactacgcccagaagctgcagggcagagtgaccatcaccaccgactacttcaccaagaccgcctacatggacctgaacaacctgagaagcgaggacaccgccatgtactactgcgtgaagatcagatacaccggccagcagctgctgtggggccagggcaccctggtgaccgtgagcagc

SEQ ID NO: 35464 - RNA, 354 nt, synthetic construct
  misc_feature 1..354: note = derived and/or modified sequence opt4 from anti-influenza_Chain
  source 1..354: mol_type = other RNA
caggtgcagctggtgcagagcggcgccgaggtgaagaagcccggcgccagcgtgaaggtgagctgcaaggccagcggccacaccttcaccggctactacatccactgggtgagacaggcccccggccagggcctggagtggatgggctggatcaaccccgacagcggcgccaccagcagcgcccagaacttccagggcagagtgaccatgaccggcgacaccagcagcagcaccgcctacatggagctgagcagactgagcttcgacgacaccgccgtgtactactgcgccagagtgctgttcaccagccccttcgacttctggggcgagggcaccctggtgaccgtgagcagc

SEQ ID NO: 35465 - RNA, 354 nt, synthetic construct
  misc_feature 1..354: note = derived and/or modified sequence opt4 from anti-influenza_Chain
  source 1..354: mol_type = other RNA
cagcccgtgctgagccagccccccagcgccagcgccagcctgggcgccagcgtgaccctgacctgcaccctgagcagcggcttcgacaactaccaggtggcctggtaccagcagagacccggcaagggccccagattcgtgatgagagtgggcaacggcggcaacgtggccagcaagggcgacggcatccccgacagattcagcgtgagcggcagcggcctgaacagatacctgaccatcaagaacatccaggaggacgacgagagcgactactactgcggcgccgaccacggcagcggcaacaacttcgtgagcccctacgtgttcggcggcggcaccaagctgaccgtgctg

SEQ ID NO: 35466 - RNA, 354 nt, synthetic construct
  misc_feature 1..354: note = derived and/or modified sequence opt4 from anti-influenza_Chain
  source 1..354: mol_type = other RNA
gaggtgcagctggtggagagcggcgccgaggtgaagaagcccggcgccagcgtgaaggtgagctgcaaggccagcggctacaccttcagcagatactacatccactgggtgagacaggcccccggccaggagctggagtggatgggctggatcaaccccgacagcggcgacaccaactacgcccagaagttcagaggcagagtgaccatggccagagacaccagcatcagcaccgtgtacatggagctgaacagcctgagatacgacgacaccgccgtgtacttctgcgccagaatcatctggagcagcagcggcatggacgtgtggggccagggcaccaccgtgaccgtgagc

SEQ ID NO: 35467 - RNA, 354 nt, synthetic construct
  misc_feature 1..354: note = derived and/or modified sequence opt4 from anti-influenza_Chain
  source 1..354: mol_type = other RNA
gaggtgcagctgctggagagcggcggcggcgtggtgcagcccggcagaagcctgagactgagctgcgccgccagcggcttcaccttcagaacctacggcatgcactgggtgagacaggcccccggcaagggcctggagtgggtggccgtgatcagccacgacggcaacctgaagtactacggcggcagcgtgaagggcagattcaccatcagcagagacaacagcaagaacgccctgtacctgcagatgaacagcctgagagtggacgacaccgccctgtactactgcgccagaggcatcggcatcaccgacgccttcgacatcagaggccagggcaccatggtggtggtgagc

SEQ ID NO: 35468 - RNA, 354 nt, synthetic construct
  misc_feature 1..354: note = derived and/or modified sequence opt4 from anti-influenza_Chain
  source 1..354: mol_type = other RNA
gaggtgcagctggtggagagcggcggcggcctggtgcagcccggcggcagcctgagactgagctgcaccgccagcggcctgagcgtgagcagcacctacatgaactgggtgagacaggcccccggcaagggcctggagtgggtgagcgtgttctacagcgagaccagaacctactacgccgacagcgtgaagggcagattcaccgtgagcagacacaacagcaacaacaccctgtacctgcagatgaacagcctgagagtggaggacaccgccgtgtactactgcgccagagtgcagagactgagctacggcatggacgtgtggggccagggcaccaccgtgaccgtgagcagc

SEQ ID NO: 35469 - RNA, 354 nt, synthetic construct
  misc_feature 1..354: note = derived and/or modified sequence opt4 from anti-influenza_Chain
  source 1..354: mol_type = other RNA
gaggtgcagctggtggagagcggcggcggcctggtgcagcccggcggcagcctgagactgagctgcaccgccagcggcctgagcgtgagcagcacctacatgaactgggtgagacaggcccccggcaagggcctggagtgggtgagcgtgttctacagcgagaccagaacctactacgccgacagcgtgaagggcagattcaccgtgagcagacacaacagcaacaacaccctgtacctgcagatgaacagcctgagagccgaggacaccgccgtgtactactgcgccagagtgcagagactgagctacggcatggacgtgtggggccagggcaccaccgtgaccgtgagcagc

SEQ ID NO: 35470 - RNA, 354 nt, synthetic construct
  misc_feature 1..354: note = derived and/or modified sequence opt4 from anti-influenza_Chain
  source 1..354: mol_type = other RNA
gacatgcagctggtggagagcggcggcggcctggtgccccccggcggcagcctgagactgagctgcgccgccagcggcttcagcgtgagcgacaactacatcaactgggtgagacaggcccccggcaagggcctggactgggtgagcgtgttctacagcgccgacagaaccagctacgccgacagcgtgaagggcagattcaccgtgagcagccacgacagcaagaacaccgtgtacctgcagatgaacagcctgagagccgaggacaccgccgtgtactactgcgccagagtgcagaagagctactacggcatggacgtgtggggccagggcaccaccgtgaccgtgagcagc

SEQ ID NO: 35471 - RNA, 357 nt, synthetic construct
  misc_feature 1..357: note = derived and/or modified sequence opt4 from anti-influenza_Chain
  source 1..357: mol_type = other RNA
gaggtgcagctggtggagagcggccccgtgctggtgaagcccaccgagaccctgaccgtgacctgcaccgtgagcggcttcagcgtggacaacgacagaatgggcgtgagctggatcagacagccccccggcaaggccctggagtggctggcccacatcttcagcaacgacgagaagagctacagcaccagcctgagaagcagactgaccatcagcaaggacaccagcaagagacaggtggtgctgagcatgaccgacatggaccccgtggacaccgccacctactactgcgccagagcccccagcgagtacgccgccatggacgtgtggggccagggcaccatggtgaccgtgagc

SEQ ID NO: 35472 - RNA, 357 nt, synthetic construct
  misc_feature 1..357: note = derived and/or modified sequence opt4 from anti-influenza_Chain
  source 1..357: mol_type = other RNA
caggtgcaggtggtgcagagcggcaccgaggtgaagaagcccggcagcagcgtgaaggtgagctgccagaccagcggcggcagattcatgagctacgccatcacctgggtgagacaggcccccggccagggcctggagtggatgggcggcatcgtgcccgtgttcggcaccgccaactacgcccagaagttccagggcagagtgaccatcaccaccgacgacagcaccagaaccgcctacatggagctgagcagcctgagaagcgaggacaccgccgtgtactactgcggcttcagatacggcagcggctacggcttcgacagctggggccagggcaccctggtgaccgtgagcagc

SEQ ID NO: 35473 - RNA, 357 nt, synthetic construct
  misc_feature 1..357: note = derived and/or modified sequence opt4 from anti-influenza_Chain
  source 1..357: mol_type = other RNA
gaggtgcagctggtggagagcggcgccggcgtgaagaagcccggcagcagcgtgaaggtgagctgcaaggccagcggcaacaccttcagcagcaacgccatcagctgggtgagacaggcccccggccagggcctggagtggatgggcggcatcctgggcatgctgagaaccaccaactacgcccagaagttccagggcagagtgaccatcaccgccgacgagttcatgaacaccgcctacatggagctgagcagcctgaccagcgaggacaccgccgtgtactactgcgccagaagcagcggctactaccccgactacttccacctgtggggccagggcaccctggtgaccgtgagc

SEQ ID NO: 35474 - RNA, 357 nt, synthetic construct
  misc_feature 1..357: note = derived and/or modified sequence opt4 from anti-influenza_Chain
  source 1..357: mol_type = other RNA
caggtgcagctgcaggagagcggccccggcctggtgaagcccagcgagaccctgagcctgacctgcaccgtgagcggcagcagcatcagcaactactactggagctggatcagacagagccccggcaagggcctggagtggatcggcttcatctactacggcggcaacaccaagtacaaccccagcctgaagagcagagtgaccatcagccaggacaccagcaagagccaggtgagcctgaccatgagcagcgtgaccgccgccgagagcgccgtgtacttctgcgccagagccagctgcagcggcggctactgcatcctggactactggggccagggcaccctggtgaccgtgagc

SEQ ID NO: 35475 - RNA, 357 nt, synthetic construct
  misc_feature 1..357: note = derived and/or modified sequence opt4 from anti-influenza_Chain
  source 1..357: mol_type = other RNA
gaggtgcagctggtggagagcggcggcggcctggtgcagcccggcggcagcctgagaatcagctgcgccgccagcggcttcaccgtgagcagcaactacatgagctgggtgagacaggcccccggcaagggcctggagtgggtgagcgtgatctacagcggcggcagcacctactacgccgacagcgtgaagggcagattcagcttcagcagagacaacagcaagaacaccgtgttcctgcagatgaacagcctgagagccgaggacaccgccgtgtactactgcgccagatgcctgagcagaatgagaggctacggcctggacgtgtggggccagggcaccaccgtgaccgtgagc

SEQ ID NO: 35476 - RNA, 357 nt, synthetic construct
  misc_feature 1..357: note = derived and/or modified sequence opt4 from anti-influenza_Chain
  source 1..357: mol_type = other RNA
caggtgcagctgcaggagagcggccccggcctggtgaagcccagcgagaccctgagcctgacctgcaccgtgagcggcgccagcatcagcagcgactactggagctggatcagactgccccccggcaagggcctggagtggatcggctacatctacaacagaggcagcaccaagtacacccccagcctgaagagcagagtgaccatcagcctggacaccgccgagaaccagttcagcctgagactgagaagcgtgaccgccgccgacaccgccatctactactgcgccagacacgtgggcggccacacctacggcatcgactactggggccagggcaccctggtgaccgtgagcagc

SEQ ID NO: 35477 - RNA, 357 nt, synthetic construct
  misc_feature 1..357: note = derived and/or modified sequence opt4 from anti-influenza_Chain
  source 1..357: mol_type = other RNA
caggtgcagctgcaggagagcggccccggcctggtgaagcccagcgagaccctgagcctgacctgcaccgtgagcggcgccagcatcagcagcgactactggagctggatcagactgccccccggcaagggcctggagtggatcggctacatctacaacagaggcagcaccaagtacacccccagcctgaagagcagagtgaccatcagcctggacaccgccgagaaccagttcagcctgagactgagaagcgtgaccgccgccgacaccgccgtgtactactgcgccagacacgtgggcggccacacctacggcatcgactactggggccagggcaccctggtgaccgtgagcagc

SEQ ID NO: 35478 - RNA, 357 nt, synthetic construct
  misc_feature 1..357: note = derived and/or modified sequence opt4 from anti-influenza_Chain
  source 1..357: mol_type = other RNA
caggtgcagctgcaggagagcggccccagactggtgaagcccagcgagagcctgagcctgacctgcaccgtgagcggcggcagcatcagcaacagcttctggggctggatcagacagccccccggcgagggcctggagtggatcggctacgtgtacaacagcggcaacaccaagtacaaccccagcctgaagagcagagtgaccatcagcagagacaccagcaagagccagctgtacatgaagctgagaagcgtgaccgccgccgacaccgccgtgtactactgcgccagacacgacgacgccagccacggctacagcatcagctggggccacggcaccctggtgaccgtgagcagc

SEQ ID NO: 35479 - RNA, 357 nt, synthetic construct
  misc_feature 1..357: note = derived and/or modified sequence opt4 from anti-influenza_Chain
  source 1..357: mol_type = other RNA
gaggtgcacctgcagcagagcggccccgagctggtgaagcccggcgccagcgtgaagatgagctgcgaggccagcggctacaccttcaccgactactacgtggcctgggtgaagcagagccccggcgagagcttcgagtggatcggcagagtgaacccctacagcggcggcaccagctacaaccagaagttcaagggcaaggccaccctgatcgtggacaagagcagcagcaccgcctacatggagctgagcagcctgaccagcgaggacagcgccgtgtactactgcgccagatgggactacggcgtgtacgagggctacatcgactactggggccagggcagcgccctgaccgtg

SEQ ID NO: 35480 - RNA, 360 nt, synthetic construct
  misc_feature 1..360: note = derived and/or modified sequence opt4 from anti-influenza_Chain
  source 1..360: mol_type = other RNA
caggtgcagctggtgcagcccggcgccgaggtgaagaagcccggcagcagcgtgaaggtgagctgcaaggccagcggcggcatcttcagcccctacgccatcagctgggtgagacaggcccccggccagggcctggagtggatgggcggcatcatcgccatcttcggcaccaccaactacgcccagaagttccagggcagagtgaccatcaccgccgacaagagcaccaccaccgcctacctggagctgaacagcctgagattcgaggacaccgccgtgtactactgcgccagaggcggcagatactacgtggactacttcgactactggggccagggcaccctggtgagcgtgagcagc

SEQ ID NO: 35481 - RNA, 360 nt, synthetic construct
  misc_feature 1..360: note = derived and/or modified sequence opt4 from anti-influenza_Chain
  source 1..360: mol_type = other RNA
caggtgcagctgcaggagagcggccccgacctggtgaagcccggcgccagcgtgaagatgagctgcaaggccagcggctacagcttcacctactaccacatgcactgggtgaagcagacccacggcaagagcctggagtggatcggcagaatcccctacaacggcggcaccaactacagccagagattcaagggcaaggccgtgttcaccgtggacatgagcagcagcaccgcctacatggagctgagaagcctgaccagcgaggacagcgccgtgtactactgcgccagagacgccaactacgagggcgactggtacttcgacgtgtggggccagggcaccaccgtgaccgtgagcagc

SEQ ID NO: 35482 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcgccgaggtgaaggagcccggcagcgccatgaaggtgagctgcaaggccagcggcggcaccttcagcagcgacgccttctgctgggtgagacaggcccccggcagaggcctggagtggatgggcggcatcatccccgtgttccagaccgccaactacggccccaacttccagggcagagtgaccatcagcgccgacgtgtacaccaccaccctgtacctggagctgagcggcctgaccagcgaggacaccgccgtgtacttctgcgccagaagcggcgacggctacaactactacttccccctgtggggccagggcaccctggtgaccgtgagcagc

SEQ ID NO: 35483 - RNA, 360 nt, synthetic construct
  misc_feature 1..360: note = derived and/or modified sequence opt4 from anti-influenza_Chain
  source 1..360: mol_type = other RNA
cagatcaccctgagagagagcggccccaccctggtgaagcccacccagaccctgaccctgacctgcaccttcagcggcttcagcctgagcaccaacggcgtgaacgtgggctggatcagacagccccccggcaaggccctggagtggctggccctgatctactgggacgacgacaagagatacagccccagcctgaagagaagactgaccatcaccaaggacaccagcaagaaccaggtggtgctgaccctgaccaacatggaccccgtggacaccgccacctactactgcgcccacagacccgacttctacggcgacttcgagtactggggccccggcaccctggtgaccgtgagcagc

SEQ ID NO: 35484 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcagcgaggtgaagaagcccggcaccagcgtgaaggtgagctgcaccgccagcggcagcgtgttcaccaactacggcatcagctgggtgagacaggcccccggccagggcctggagtggatgggcggcatcatccccctgttcggcgccgccaagtacgcccagaagttccagggcagagtgaccatcaccgccgacgagagcaccaagaccgtgtacatggagctgagcagactgaccagcaaggacaccgccatctacttctgcgccaaggcccccagagtgtacgagtactacttcgaccagtggggccagggcacccccgtgaccgtgagcagc

SEQ ID NO: 35485 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcgccgacctgaagaagcccggcgccagcgtgaaggtgagctgcaaggccagcggctacaccttcaccgactactacatccactgggtgagacaggcccccggccagggcctggagtggatgggctggatcaaccccgagagcggcgacaccaagtacgcccagaagttccagggcagagtgaccatgaccagagacaccagcatcaccaccgcctacatggagctgggcagactgagaagcgacgacaccgccgtgtactactgcgccagagacgtgagcaccacctggagctggttcgccccctggggccagggcaccctggtgaccgtgagcagc

SEQ ID NO: 35486 - RNA, 360 nt, synthetic construct
  misc_feature 1..360: note = derived and/or modified sequence opt4 from anti-influenza_Chain
  source 1..360: mol_type = other RNA
caggtgcagctgcaggagagcggccccggcctggtgaagcccagcgagaccctgagcctgacctgcagcgtgagcggcggcagcatcaactactactactggagctggatcagacagccccccggcaagggcctggagtgcatcggctacatcagcgacaccggcagaacctactacaaccccagcctgagaagcagagtgaccatcagcgtggacaccagcaagaaccagttcagcctgaacctgaccagcatgaccgccgccgacaccgccgtgtactactgcgccagagaccccaccggcagcagacagaagaacgccttcgacatgtggggccagggcaccatggtgaccgtgagc

SEQ ID NO: 35487 - RNA, 360 nt, synthetic construct
  misc_feature 1..360: note = derived and/or modified sequence opt4 from anti-influenza_Chain
  source 1..360: mol_type = other RNA
caggtgcagctgcaggagagcggccccagagtggtgagacccagcgagaccctgagcctgacctgcaccgtgagcggcggcagcatcagcagctacaactggatctggatcagacagccccccggcaagggcctggagtggatcggccacatctacgactacggcagaaccttctacaacagcagcctgcagagcagacccaccatcagcgtggacgccagcaagaaccagctgagcctgagactgaccagcgtgaccgccagcgacaccgccgtgtactactgcgccagacccctgggcatcctgcactactacgccatggacctgtggggccagggcaccaccgtgaccgtgagcagc

SEQ ID NO: 35488 - RNA, 360 nt, synthetic construct
  misc_feature 1..360: note = derived and/or modified sequence opt4 from anti-influenza_Chain
  source 1..360: mol_type = other RNA
caggtgcagctgcaggagagcggccccggcctggtgaagcccagcgagaccctgagcctgacctgcagcgtgagcggcggcagcatcagcagcgacttctggagctggatcagacagccccccggcaagggcctggagtggatcggctacgtgtacaacagaggcagcaccaagtacagccccagcctgaagagcagagtgaccatcagcgccgacatgagcaagaaccagttcagcctgaacatgagcagcgtgaccgccgccgacaccgccgtgtactactgcgccaagaacggcagaagcagcaccagctggggcatcgacgtgtggggcaagggcaccaccgtgaccgtgagcagc

SEQ ID NO: 35489 - RNA, 360 nt, synthetic construct
  misc_feature 1..360: note = derived and/or modified sequence opt4 from anti-influenza_Chain
  source 1..360: mol_type = other RNA
caggtgcagctgcaggagagcggccccggcctggtgaagcccagcgagaccctgagcctgacctgcaccgtgagcggcggcagcatcagcgcctaccactggagctggatcagacagccccccggcaagggcctggagtggatcggccacatcttcgacagcggcagcacctactacaaccccagcctgaagagcagagtgaccatcagcctggacgccagcaagaaccagctgagcctgagactgaccagcgtgaccgccagcgacaccgccatctactactgcgccagacccctgggcagcagatactactacggcatggacgtgtggggccagggcaccaccgtgaccgtgagcagc

SEQ ID NO: 35490 - RNA, 360 nt, synthetic construct
  misc_feature 1..360: note = derived and/or modified sequence opt4 from anti-influenza_Chain
  source 1..360: mol_type = other RNA
gaggtgcagctggtggagagcggcggcggcctggtgcagcccggcggcagcctgagaatcagctgcgccgccagcggcttcaccgtgagcagcaactacatgagctgggtgagacaggcccccggcaagggcctggagtgggtgagcgtgatctacagcggcggcagcacctactacgccgacagcgtgaagggcagattcagcttcagcagagacaacagcaagaacaccgtgttcctgcagatgaacagcctgagagccgaggacaccgccgtgtactactgcgccagatgcctgagcagaatgagaggctacggcctggacgtgtggggccagggcaccaccgtgaccgtgagcagc

SEQ ID NO: 35491 - RNA, 360 nt, synthetic construct
  misc_feature 1..360: note = derived and/or modified sequence opt4 from anti-influenza_Chain
  source 1..360: mol_type = other RNA
caggtgcagctgcaggagagcggccccggcctggtgaagcccagcgagaccctgagcctgacctgcaccgtgagcggcagcagcatcagcaactactactggagctggatcagacagagccccggcaagggcctggagtggatcggcttcatctactacggcggcaacaccaagtacaaccccagcctgaagagcagagtgaccatcagccaggacaccagcaagagccaggtgagcctgaccatgagcagcgtgaccgccgccgagagcgccgtgtacttctgcgccagagccagctgcagcggcggctactgcatcctggactactggggccagggcaccctggtgaccgtgagcagc

SEQ ID NO: 35492 - RNA, 360 nt, synthetic construct
  misc_feature 1..360: note = derived and/or modified sequence opt4 from anti-influenza_Chain
  source 1..360: mol_type = other RNA
caggtgcagctgcagcagagcggcgccgaggtgaagaagcccggcagcagcgtgaaggtgagctgcaaggtgagcggcgtgatcttcagcggcagcgccatcagctgggtgagacaggcccccggccagggcctggagtggatgggcggcatcagccccctgttcggcaccaccaactacgcccagaagttccagggcagagtgaccatcaccgccgaccagagcaccaacaccacctacatggaggtgaacagcctgagatacgaggacaccgccgtgtacttctgcgccagaggccccaagtactacagcgagtacatggacgtgtggggcaagggcaccaccgtgaccgtgagcagc

SEQ ID NO: 35493 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcatgggcatgttcggcaccaccaactacgcccagaagttccagggcagagtgaccatcaccgccgacgagttcaccagcgccgcctacatggagctgagaagcctgagaagcgaggacaccgccgtgtactactgcgccagaagcagcggctactaccccgagtacttccaggactggggccagggcaccctggtgaccgtgagcagc

SEQ ID NO: 35494 - RNA, 360 nt, synthetic construct
  misc_feature 1..360: note = derived and/or modified sequence opt4 from anti-influenza_Chain
  source 1..360: mol_type = other RNA
cagatgcagctggtgcagagcggcgccgaggtgaagaagcccggcagcagcgtgaaggtgagctgcaaggccagcggcggcaccttcagcagctacgccatcacctgggtgagacaggcccccggccagggcctggagtggatgggcggcatcatcggcatgttcggcagcaccaactacgcccagaacttccagggcagagtgaccatcaccgccgacgagagcaccagcaccgcctacatggagctgagcagcctgagaagcgaggacaccgccgtgtactactgcgccagaagcaccggctactaccccgcctacctgcaccactggggccagggcaccctggtgaccgtgagcagc

SEQ ID NO: 35495 - RNA, 360 nt, synthetic construct
  misc_feature 1..360: note = derived and/or modified sequence opt4 from anti-influenza_Chain
  source 1..360: mol_type = other RNA
gaggtgcagctggtggagagcggcgccgaggtgaagaagcccggcagcagcgtgaaggtgagctgcaaggccagcggcggcaccttcagcagctacggcatcagctgggtgagacaggcccccggccagggcctggagtggatgggcgacatcatcggcatgttcggcagcaccaactacgcccagaacttccagggcagactgaccatcaccgccgacgagagcaccagcaccgcctacatggagctgagcagcctgagaagcgaggacaccgccgtgtactactgcgccagaagcagcggctactaccccgcctacctgccccactggggccagggcaccctggtgaccgtgagcagc

SEQ ID NO: 35496 - RNA, 360 nt, synthetic construct
  misc_feature 1..360: note = derived and/or modified sequence opt4 from anti-influenza_Chain
  source 1..360: mol_type = other RNA
gaggtgcagctggtggagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcatcggcatgttcggcaccgccaactacgcccagaagttccagggcagagtgaccatcaccgccgacgagttcaccagcaccgcctacatggagctgagcagcctgagaagcgaggacaccgccgtgtactactgcgccagaggcaactactactacgagagcagcctggactactggggccagggcaccctggtgaccgtgagcagc

SEQ ID NO: 35497 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcgccgaggtgaagaagcccggcagcagcgtgaaggtgagctgcaaggccagcggcggccccttcagaaacttcgccatcaactgggtgagacaggcccccggccagggcctggagtggatgggcggcatcatcgccgtgttcggcaccaccaagtacgcccacaagttccagggcagagtgaccatcaccgccgacgacagcaccaacaccgcctacatggagctgggcagcctgaagagcgaggacaccgccgtgtactactgcgccagaggcccccactactacagcagctacatggacgtgtggggcgagggcaccaccgtgaccgtgagcagc

SEQ ID NO: 35498 - RNA, 360 nt, synthetic construct
  misc_feature 1..360: note = derived and/or modified sequence opt4 from anti-influenza_Chain
  source 1..360: mol_type = other RNA
gaggtggccctggtggagaccggcgccgaggtgaagaagcccggcagcagcgtgaaggtgccctgcaagagcagcggcagccccttcagaagcaacgccgtgagctgggtgagacaggcccccggccagggcctggagtgggtgggcggcatcctgggcgtgttcggcagccccagctacgcccagaagttccagggcagagtgaccatcaccgccgacgagagcaccaacaccgtgcacatggagctgagaggcctgagaagcgaggacaccgccgtgtactactgcgccagaggccccacctactactacagctacatggacgtgtggggcaagggcaccaccgtgaccgtgagcagc

SEQ ID NO: 35499 - RNA, 360 nt, synthetic construct
  misc_feature 1..360: note = derived and/or modified sequence opt4 from anti-influenza_Chain
  source 1..360: mol_type = other RNA
cagatgcagctggtgcagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcttcggcatgttcggcaccgccaactacgcccagaagttccagggcagagtgaccatcaccgccgacgagttcaccagcgccgcctacatggagctgagcagcctgggcagcgaggacaccgccatgtactactgcgccagaagcagcggctactacccccagtacttccaggactggggccagggcaccctggtgaccgtgagcagc

SEQ ID NO: 35500 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcgccgaggtgaagaagcccggcagcagcgtgaaggtgagctgcaaggccagcggcgtgaccttcagctactacgccatgagctgggtgagacaggcccccggccagggcctggagtggatgggcggcatcagccccatgttcggcaccaccacctacgcccagaagttccagggcagagtgaccatcaccgccgacgacagcaccagcaccgcctacatggaggtgagaagcctgagaagcgaggacaccgccgtgtactactgcgccagaagcagcaactactacgacagcgtgtacgactactggggccagggcaccctggtgaccgtgagcagc

SEQ ID NO: 35501 - RNA, 360 nt, synthetic construct
  misc_feature 1..360: note = derived and/or modified sequence opt4 from anti-influenza_Chain
  source 1..360: mol_type = other RNA
gaggtgcagctggtggagaccggcgccgaggtgaagaagcccggcagcagcgtgaaggtgccctgcaagagcagcggcagccccttcagaagcaacgccgtgagctgggtgagacaggcccccggccagggcctggagtgggtgggcggcatcctgggcgtgttcggcagccccagctacgcccagaagttccagggcagagtgaccatcaccgccgacgagagcaccaacaccgtgcacatggagctgagaggcctgagaagcgaggacaccgccgtgtactactgcgccagaggccccacctactactacagctacatggacgtgtggggcaagggcaccaccgtgaccgtgagcagc

SEQ ID NO: 35502 - RNA, 360 nt, synthetic construct
  misc_feature 1..360: note = derived and/or modified sequence opt4 from anti-influenza_Chain
  source 1..360: mol_type = other RNA
caggtgcacctggtgcagagcggcgccgaggtgagaaagcccggcgccagcgtgaaggtgagctgcaaggtgagcggctacaccctgaacgagctgagcatccactggctgagacaggcccccggcagaggcctggagtggatgggcagcttcgaccccgaggacggcgagaccatctacgcccagaagttccagggcagagtgaccatgaccggcgacaccagcaccgacaccgcctacctggagctgaccagcctgagaagcgaggacaccgccctgtactactgcgccagaggctggggcgccgtgaccagccccttcgacttctggggccagggcaccctggtgaccgtgagcagc

SEQ ID NO: 35503 - RNA, 360 nt, synthetic construct
  misc_feature 1..360: note = derived and/or modified sequence opt4 from anti-influenza_Chain
  source 1..360: mol_type = other RNA
gaggtgcagctggtgcagagcggcgccgaggtgaagaagcccggcagcagcatgaaggtgagctgcaaggccagcggcagcatcttcagcaactacggcatcagctgggtgagacaggcccccggccagggcctggagtggatgggcggcatcatccccatcttcggcgccgccaactacgcccagaagttccagggcagagtgaccatcaccgccgacgagagcaccagcaccgtgtacatggaggtgagaagcctgagaagcgaggacaccgccgtgtactactgcgccagaagacagcagctgtacaagggctactaccaccactggggccagggcaccctggtgaccgtgagcagc

SEQ ID NO: 35504 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcgccggcgtgaagaagcccggcagcagcatgaaggtgagctgcaaggccagcggcagcatcttcagcaactacggcatcagctgggtgagacaggcccccggccagggcctggagtggatgggcggcatcatccccatcttcggcgccgccaactacgcccagaagttccagggcagagtgaccatcaccgccgacgagagcaccagcaccgtgtacatggaggtgagaagcctgagaagcgaggacaccgccgtgtactactgcgccagaagacagcagctgtacaagggctactaccaccactggggccagggcaccctggtgaccgtgagcagc

SEQ ID NO: 35505 - RNA, 360 nt, synthetic construct
  misc_feature 1..360: note = derived and/or modified sequence opt4 from anti-influenza_Chain
  source 1..360: mol_type = other RNA
caggtgcagctgcaggagagcggccccggcctggtgaagcccagcgagaccctgagcctgacctgcaccgtgagcggcggcctgatcggcaccggcagctactactggggctggatcagacagacccccggcaagggcatggagtggatcggcagcatcagctacagcggcagcacctactaccaccccagcctgaagagcagagtgaccatcagcgacgacaccagcaagaaccagctgttcctgaagctgagaagcgtgaccgccgccgacaccgcccagtactactgcgccagatacaactggggcatcagatacttcgacttctggggcagaggcaccctggtgaccgtgagcagc

SEQ ID NO: 35506 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcgccgaggtgagaaagcccggcagcagcgtgaaggtgagctgcaaggtgagcggcggcatcatcagaaagtacgccatcaactgggtgagacaggcccccggccagggcctggagtggatgggcggcatcatcgccatcttcaacaccgccaactacgcccagaagttccagggcagagtgaccatcaccgccgacgagagcaccagcaccgtgtacatggagctgagcagcctgagaagcgaggacaccgccctgtactactgcgccagaggcatgaactactacagcgactacttcgactactggggccagggcagcctggtgaccgtgagcccc

SEQ ID NO: 35507 - RNA, 360 nt, synthetic construct
  misc_feature 1..360: note = derived and/or modified sequence opt4 from anti-influenza_Chain
  source 1..360: mol_type = other RNA
caggtgcagctggtgcagagcggcggcggcgtggtgcagcccggcagaagcctgagactgagctgcgccgccagcggcttcaccttcagaagccacgccatgcactgggtgagacaggcccccggcaagggccccgagtgggtggccctgatcagctacgacgaggtgaacaagttctacgccgacagcgtgaagggcagattcaccatcagcagagacgtgagcaagaacaccgtgttcctgcagatgaacagcctgagcgccgacgacaccgccgtgtactactgcgccagaggccacagcggcagctacagactgttcgacttctggggccagggcaccctggtgaccgtgagcagc

SEQ ID NO: 35508 - RNA, 360 nt, synthetic construct
  misc_feature 1..360: note = derived and/or modified sequence opt4 from anti-influenza_Chain
  source 1..360: mol_type = other RNA
caggtgcagctggtggagagcggcggcggcctggtgcagcccggcggcagcctgagactgagctgcgccgccagcggcttcatcttcggcgacttcgccatccactgggtgagacaggccagcggcaagggcctggagtgggtggccagaatcagaagcggcctgaacagattcgagaccgcctacgccgccagcgtggagggcagactgaccatcagcagagacgacagcaagagcatggcctacctgcagatgaacaacgtgaaggccgaggacaccgccgtgtacctgtgcacctacctggtgggcgccgtgggcttccagcactggggccagggcaccctggtgaccgtgagcagc

SEQ ID NO: 35509 - RNA, 360 nt, synthetic construct
  misc_feature 1..360: note = derived and/or modified sequence opt4 from anti-influenza_Chain
  source 1..360: mol_type = other RNA
caggtgcagctggtggagagcggcggcggcgtggtgcagcccggcagaagcctgagactgagctgcgccgccagcggcttcaccttcagcagctacggcatctactgggtgagacaggcccccggcaagggcctggagtgggtggccttcatcagctacgacgagatcaacaagttctacgccgacagcgtgaagggcagattcaccatcagcagagacaacagcaagaacaccgtgttcctgcagatgaacagcctgagagacgaggacaccgccgtgtactactgcgccaagcccctgagaggcagctacagatacttcgacctgtggggcagaggcaccgtggtgaccgtgagcagc

SEQ ID NO: 35510 - RNA, 363 nt, synthetic construct
  misc_feature 1..363: note = derived and/or modified sequence opt4 from anti-influenza_Chain
  source 1..363: mol_type = other RNA
caggtgcagctgcaggagagcggccccgacctggtgaagcccggcgccagcgtgatgatcagctgcaaggccagcggctacagcttcacctactactacatgcactgggtgaagcagagccacggcaagaccctggagtggatcggcagaatctacccctacaacggcgacaccaactacaacagaagattcaaggacaaggccatcctgaccgtggacgagagcagcagcaccgcctacatggagctgagaagcctgaccagcgaggacagcgccgtgtacttctgcgccagagacgccaactacgagggcgactggtacttcgacgtgtggggccagggcaccaccgtgaccgtgagcagc

SEQ ID NO: 35511 - RNA, 363 nt, synthetic construct
  misc_feature 1..363: note = derived and/or modified sequence opt4 from anti-influenza_Chain
  source 1..363: mol_type = other RNA
caggtgcagctggtgcagagcggcggcggcgtggtgcagcccggcagaagcctgagactgagctgcgccgccagcggcttcaccttcagcagctacgccatgcactgggtgagacaggcccccggcaagggcctggagtgggtggccatcatcagctacgacggcaacgaccagtactacaccgacagcgtgaagggcagattcaccatcagcagagacagcagcaaggtgtacctgcagatgcacagactgagacccgaggacaccgccgtgtactactgcgccaaggagttcgagaccagcggctacttccacggcagcttcgactactggggccagggcatcctggtgaccgtgagcagc

SEQ ID NO: 35512 - RNA, 363 nt, synthetic construct
  misc_feature 1..363: note = derived and/or modified sequence opt4 from anti-influenza_Chain
  source 1..363: mol_type = other RNA
caggtgcaggtggtgcagagcggcgccgaggtgaagaagcccggcagcagcgtgagagtgagctgccaggccagcggcggcaccttcatgaactacgccatcatctgggtgagaagagcccccggccagggcctggagtggatgggcggcatcatccccgtgttccccacccccaactacgcccagatgttccagggcagagtgaccatcagcaccgacgagagcagaagcaccagcttcctggagctgaccaacctgagatacgaggacaccgccgtgtactactgcgccagaagaatctaccacggcggcaacagcggcttcgacttctggggccagggcaccctggtgaccgtgagcagc

SEQ ID NO: 35513 - RNA, 363 nt, synthetic construct
  misc_feature 1..363: note = derived and/or modified sequence opt4 from anti-influenza_Chain
  source 1..363: mol_type = other RNA
caggtgcagctgcaggagagcggccccggcctgctgaagcccagcgacaccctggccctgacctgcaccgtgagcggcggcagcatcaccagcgactactggagctggatcagacagccccccggcagaggcctggactggatcggcttcttctacaacggcggcagcaccaagtacaaccccagcctgaagagcagagtgaccatcagcgccgacaccagcaagaaccagctgagcctgaagctgaccagcgtgaccgccgccgacaccggcgtgtactactgcgccagacacgacgccaagttcagcggcagctactacgtggccagctggggccagggcaccagagtgaccgtgagcagc

SEQ ID NO: 35514 - RNA, 363 nt, synthetic construct
  misc_feature 1..363: note = derived and/or modified sequence opt4 from anti-influenza_Chain
  source 1..363: mol_type = other RNA
caggtgcagctgcaggagagcggccccggcctgctgaagcccagcgacaccctggccctgacctgcaccgtgagcggcggcagcatcaccagcgactactggagctggatcagacagccccccggcagaggcctggactggatcggcttcttctacaacggcggcagcaccaagtacaaccccagcctgaagagcagagtgaccatcagcgccgacaccagcaagaaccagctgagcctgaagctgaccagcgtgaccgccgccgacaccggcgtgtactactgcgccagacacgacgtgaagttcagcggcagctactacgtggccagctggggccagggcaccagagtgaccgtgagcagc

SEQ ID NO: 35515 - RNA, 363 nt, synthetic construct
  misc_feature 1..363: note = derived and/or modified sequence opt4 from anti-influenza_Chain
  source 1..363: mol_type = other RNA
caggtgcagctgcaggagagcggccccggcctggtgaagcccagcgagaccctgagcgtgacctgcaaggtgagcggcgacagcatcagcagctacagctggagctggatcagacagccccccggcaagggcctggagtgggtgggctacctgtactacagcggcagcaccaagtacaaccccagcctgaagagcagaaccaccatcagcgtggacaccagcaccaaccagctgagcctgaagctgagcttcgtgaccgccgccgacaccgccgtgtacttctgcgccagaaccggcagcgagagcaccaccggctacggcatggacgtgtggggccagggcaccaccgtgaccgtgagcagc

SEQ ID NO: 35516 - RNA, 363 nt, synthetic construct
  misc_feature 1..363: note = derived and/or modified sequence opt4 from anti-influenza_Chain
  source 1..363: mol_type = other RNA
gaggtgcagctggtggagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagc

SEQ ID NO: 35517 - RNA, 363 nt, synthetic construct
  misc_feature 1..363: note = derived and/or modified sequence opt4 from anti-influenza_Chain
  source 1..363: mol_type = other RNA
caggtgcagctggtgcagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagc

SEQ ID NO: 35518 - RNA, 363 nt, synthetic construct
  misc_feature 1..363: note = derived and/or modified sequence opt4 from anti-influenza_Chain
  source 1..363: mol_type = other RNA
gaggtgcagctggtggagaccggcgccgaggtgaagaagcccggcgccagcgtgaaggtgagctgcaaggccagcggctacaccttcaccagctactacatgcactgggtgagacaggcccccggccagggcctggagtggatgggctggatcaaccccaacagcggcggcaccaactacgcccagaagttccagggcagagtgaccatgaccagagacaccagcatcagcaccgcctacatggagctgagcagactgagaagcgacgacaccgccgtgtactactgcgccagagagggcaagtggggcccccaggccgccttcgacatctggggccagggcaccatggtgaccgtgagcagc

SEQ ID NO: 35519 - RNA, 363 nt, synthetic construct
  misc_feature 1..363: note = derived and/or modified sequence opt4 from anti-influenza_Chain
  source 1..363: mol_type = other RNA
gaggtgcagctggtggagagcggcgccgaggtgaagaagcccggcagcagcgtgaaggtgagctgcaaggccagcggcggcaccttcagcttctacagcatgagctgggtgagacaggcccccggccagggcctggagtggatgggcggcatcatccccatgttcggcaccaccaactacgcccagaagttccagggcagagtgaccatcaccgccgtggagagcaccagcaccgcctacatggaggtgagcagcctgagaagcgaggacaccgccgtgtactactgcgccagaggcgacaagggcatctactactactacatggacgtgtggggcaagggcaccaccgtgaccgtgagcagc

SEQ ID NO: 35520 - RNA, 363 nt, synthetic construct
  misc_feature 1..363: note = derived and/or modified sequence opt4 from anti-influenza_Chain
  source 1..363: mol_type = other RNA
gaggtgcagctggtggagaccggcgccgaggtgaagaagcccggcagcagcgtgaaggtgagctgcaaggccagcggcggcaccttcagaacccacgccatcagctgggtgagacaggcccccggccagggcctggagtggatgggcggcatcatcgccatcttcggcaccgccaactacgcccagaagttccagggcagaatcaccatcaccgccgacgagagcaccagcaccgcctacatggagctgagcagcctgagaagcgaggacaccgccgtgtacttctgcgccagaggcagcggctaccacatcagcacccccttcgacaactggggccagggcaccctggtgaccgtgagcagc

SEQ ID NO: 35521 - RNA, 363 nt, synthetic construct
  misc_feature 1..363: note = derived and/or modified sequence opt4 from anti-influenza_Chain
  source 1..363: mol_type = other RNA
gaggtgcagctggtgcagagcggcgccgaggtgaagaagcccggcagcagcgtgaaggtgagctgcaaggccagcggcggcatcttcagaagcaacagcatcagctgggtgagacaggcccccggccagggcctggagtggatgggcggcatcttcgccctgttcggcaccaccgactacgcccagaagttccagggcagagtgaccatcaccgccgacgagagcagcaccaccgtgtacctggagctgagcagcctgaccagcgaggacaccgccgtgtactactgcgccagaggcagcggctacaccaccagaaactacttcgactactggggccagggcaccctggtgaccgtgagcagc

SEQ ID NO: 35522 - RNA, 363 nt, synthetic construct
  misc_feature 1..363: note = derived and/or modified sequence opt4 from anti-influenza_Chain
  source 1..363: mol_type = other RNA
gaggtgcagctggtggagagcggcgccgaggtgaagaagcccggcagcagcgtgaaggtgagctgcaaggccagcggcggcatcttcaacagctacgccatcagctgggtgagacaggcccccggccagggcctggagtggatgggcggcatcatcgccatcttccacacccccaagtacgcccagaagttccagggcagagtgaccatcaccgccgacgagagcaccaacaccgcctacatggagctgagaagcctgaagagcgaggacaccgccctgtactactgcgccagaggcagcacctacgacttcagcagcggcctggactactggggccagggcaccctggtgaccgtgagcagc

SEQ ID NO: 35523 - RNA, 363 nt, synthetic construct
  misc_feature 1..363: note = derived and/or modified sequence opt4 from anti-influenza_Chain
  source 1..363: mol_type = other RNA
caggtgcagctggtgcagagcggcgccgaggtgaagaagcccggcagcagcgtgaaggtgagctgcaagagcagcggcggcaacttcaacaactacgccgtgagctgggtgagacaggcccccggccagggcctggagtggatgggcggcatcagccccatcttcggcagcaccaaccacgcccagaagttccagggcagagtgaccatcagcgccgacatcttcaccaacaccgcctacatggagctgagcagcctgagaagcgacgacaccgccatctactactgcgccagaggcagaggctactacttctaccacgccatggacgtgtggggccagggcagcaccgtgaccgtgagcagc

SEQ ID NO: 35524 - RNA, 363 nt, synthetic construct
  misc_feature 1..363: note = derived and/or modified sequence opt4 from anti-influenza_Chain
  source 1..363: mol_type = other RNA
caggtgcagctggtgcagagcggcgccgaggtgaagaagcccggcagcagcgtgaaggtgagctgcaaggccagcggcggcaccttcaacaactacgccatcaactgggtgagacaggcccccggccagggcctggagtggatgggcggcatcagccccatcttcggcagcgtgaactacgcccagaagctgcagggcagagtgaccatcaccgccgacgtgttcaccagcaccgcctacatggagctgagcagcctgagaagcgaggacaccgccgtgtactactgcgccaagggcagcggctactactactactacggcctggacgtgtggggcctgggcaccaccgtgaccgtgagcagc

SEQ ID NO: 35525 - RNA, 363 nt, synthetic construct
  misc_feature 1..363: note = derived and/or modified sequence opt4 from anti-influenza_Chain
  source 1..363: mol_type = other RNA
caggtgcagctggtggagagcggcggcggcgtggtgcagcccggcagaagcctgagactgagctgcgccgccagcggcttcaccttcaccaactacgccatgcactgggtgagacaggcccccggcaagggcctggagtgggtggccgtgatcagcttcgacgaggacaacaagagctacgccgactacgtgaagggcagattcaccatcagcagagacaacagcaacaacagactgtacctgcagatgaacagcctgagagccgaggacaccgccgtgtactactgcgccagaggccccgagggcgtgtggggcagaagcatcgacagctggggccagggcaccctggtgaccgtgagcagc

SEQ ID NO: 35526 - RNA, 363 nt, synthetic construct
  misc_feature 1..363: note = derived and/or modified sequence opt4 from anti-influenza_Chain
  source 1..363: mol_type = other RNA
caggtgcagctggtgcagagcggcggcgacctggtgcagcccggcggcagcctgagactgagctgcgccgccagcggcttcaccttcagcagatacagcatgaactgggtgagacaggcccccggcatgggcctggagtgggtggcctacatcagcgacaccagcagaaccatctactacgccgacagcgtgaagggcagattcaccatcagcagagacaacgccaagaacagcctgtacctgcagatgaagagcctgagagacgaggacaccgccgtgtactactgcgccagagaccccgacacccccttcgtgagagccttcgacagctggggccagggcaccctggtgaccgtgagcagc

SEQ ID NO: 35527 - RNA, 363 nt, synthetic construct
  misc_feature 1..363: note = derived and/or modified sequence opt4 from anti-influenza_Chain
  source 1..363: mol_type = other RNA
caggtgcagctggtggagagcggcggcggcctggtgcagcccggcggcagcctgagactgagctgcgtggccagcggcttcaccttcagcagattcagcatgaactgggtgagacaggcccccggcatgggcctggagtgggtgagctacatcagcgacaccggcagaaccatctactacgccgacagcgtgaagggcagattcaccatcagcagagacaacgacaagaacaccctgtacctgcagatgaagagcctgagagacgaggacagcgccttctactactgcgccagagaccccgacacccccttcgtgagagccttcgacagctggggccagggcgtgctggtgaccgtgagcagc

SEQ ID NO: 35528 - RNA, 363 nt, synthetic construct
  misc_feature 1..363: note = derived and/or modified sequence opt4 from anti-influenza_Chain
  source 1..363: mol_type = other RNA
caggtgcagctgcaggagagcggccccgacctggtgaagcccggcgccagcgtgaagatgagctgcaaggccagcggctacagcttcacctactaccacatgcactgggtgaagcagacccacggcaagagcctggagtggatcggcagaatctacccctacaacggcggcaccaactacagccagagattcaagggcaaggccgtgttcaccgtggacatgagcagcagcaccgcctacatggagctgagaagcctgaccagcgaggacagcgccgtgtactactgcgccagagacgccaactacgagggcgactggtacttcgacgtgtggggccagggcaccaccgtgaccgtgagcagc

SEQ ID NO: 35529 - RNA, 366 nt, synthetic construct
  misc_feature 1..366: note = derived and/or modified sequence opt4 from anti-influenza_Chain
  source 1..366: mol_type = other RNA
cagggccagctggtgcagagcggcgccgaggtgaagaagagcggcagcagcgtgaaggtgagctgcaagaccagcggcggcaccttcaacagccacgccatcagctgggtgagacaggcccccggccagggcctggagtggatcggcggcatcatccccatgttcggcaccaccaactacgcccagaagctgaagggcagaatcgccatcaccgccgaccagctgcccaccaccgcctacctggagctgagcagcctgagaagcgaggacaccgccgtgtactactgcgccagaggccagagatactactacgacagagacggcatggacgtgtggggccagggcaccatggtgaccgtgagcagc

SEQ ID NO: 35530 - RNA, 366 nt, synthetic construct
  misc_feature 1..366: note = derived and/or modified sequence opt4 from anti-influenza_Chain
  source 1..366: mol_type = other RNA
caggtgcacctggtgcagagcggcgccgaggtgaagaagcccggcagcagcgtgagactgagctgcagcgccagcggcggccccttcagcggcttcgccatcagctggctgagacaggcccccggccagggcctggagtggctgggcggcatcagcgccgtgttcggcaccgccacctacgcccagaagttccagggcagagtgaccatcaccgccgaccagttcaccagcaccagccacatggacctgagcagactgacctacgacgacaccgccgtgtactactgcgccagaagcggcggctacctgccccagaacaactggatcgacccctggggccagggcaccctggtgatcgtgagcagc

SEQ ID NO: 35531 - RNA, 366 nt, synthetic construct
  misc_feature 1..366: note = derived and/or modified sequence opt4 from anti-influenza_Chain
  source 1..366: mol_type = other RNA
caggtgcagctggtgcagagcggcgccgaggtgaagaaggccggcagcagcgtgaaggtgagctgccagagcagcggcgtgaccttcagcatgtacgccgtgagctgggtgagacaggcccccggccagggcctggagtggatgggcggcatcatccccctgttcggcaccaccacctacgcccagaagttcgagggcagactgaccatcaccgccgacaccagcaccaacatggcctacctggagctgagaagcctgagaagcgaggacaccgccgtgtacttctgcgccagagccggcaccaccgtgaccagattcaactggttcgacccctggggccagggcaccctggtgaccgtgagcagc

SEQ ID NO: 35532 - RNA, 366 nt, synthetic construct
  misc_feature 1..366: note = derived and/or modified sequence opt4 from anti-influenza_Chain
  source 1..366: mol_type = other RNA
caggtgcagctggtgcagagcggcgccgaggtgaagaagcccggcagcagcctgaaggtgagctgcaaggccagcggcgtgaccttcagcatgtacaccatcagctgggtgagacaggcccccggccagggcctggagtggatgggcggcatcatccccctgttcggcaccgccaactacgagcagaagttccagggcagagtgaccatcaccgccgacaccagcaccaacaccgcctacatggagctgagcagcctgagaagcgaggacaccgccgtgtactactgcgccagagccggcaccaccctgaccagattcaactggttcgacccctggggccagggcaccctggtgaccgtgagcagc

SEQ ID NO: 35533 - RNA, 366 nt, synthetic construct
  misc_feature 1..366: note = derived and/or modified sequence opt4 from anti-influenza_Chain
  source 1..366: mol_type = other RNA
atggccgacaacatgaccaccacccagatcgagtggagaatgaagaagatggccatcggcagcagcacccacagcagcagcgtgctgatgaaggacatccagagccagttcgagcagctgaagctgagatgggagagctaccccaacctggtgaagagcaccgactaccaccagaagagagagaccatcagactggccaccgaggagctgtacctgctgagcaagagaatcgacgacagcatcctgttccacaagaccgtgatcgccaacagcagcatcatcgccgacatgatcgtgagcctgagcctgctggagaccctgtacgagatgaaggacgtggtggaggtgtacagcagacagtgcctg

SEQ ID NO: 35534 - RNA, 366 nt, synthetic construct
  misc_feature 1..366: note = derived and/or modified sequence opt4 from anti-influenza_Chain
  source 1..366: mol_type = other RNA
gaggtgcagctggtgcagagcggcggcggcctggtgcagcccggcggcagcctgagactggcctgcgtggtgagcggcttcaccgtgaccagcaactacatcacctgggtgagacaggcccccggcaagggcctggagtgggtgagcgtgatctacagccacggcagagcctactacagcgccagcgtgaacggcagattcaccatcagcagacacaccagcaagaacaccgtgtacctggagatgaacagcctgagacccgaggacaccgccgtgtactactgcgccggcggcggcctggtgggcggctacgacgagtacttcttcgactactggggccagggcaccctggccaccgtgagcagc

SEQ ID NO: 35535 - RNA, 366 nt, synthetic construct
  misc_feature 1..366: note = derived and/or modified sequence opt4 from anti-influenza_Chain
  source 1..366: mol_type = other RNA
caggtgcagctggtgcagagcggcgccgaggtgaagaagcccggcgccagcgtgaaggtgagctgcaaggccagcggctacaccttcaccggctactacatgcactgggtgagacaggcccccggccagggcctggagtggatgggctggatcaaccccaacagcggcgacaccaactacgcccagaagttccagggcagagtgaccatgaccagagacaccagcatcaccaccgcctacatggagctgagcagcctgagaagcgacgacaccgccgtgtactactgcgccagagacagcccctacagcagcagctggagcttcttcgactactggggccagggccccctggtgaccgtgagcagc

SEQ ID NO: 35536 - RNA, 366 nt, synthetic construct
  misc_feature 1..366: note = derived and/or modified sequence opt4 from anti-influenza_Chain
  source 1..366: mol_type = other RNA
gaggtgcagctggtggagagcggcggcggcctggtgcagcccggcggcagcctgagactgagctgcgccgccagcggcttcatcttcagaaactactggatgagctgggtgagacaggcccccggcaagggcctggagtgggtggccaacatcaagcaggacggcagagagaagtactacgtggacagcctgagaggcagagtgaacatcagcagagacaacgccgagaacagcctgtacctgcacatgaacagcctgagagtggaggacaccgccgtgtacttctgcgccagagccagaatggtggtggtgaccggcgacggcttcgacgtgtggggccacggcaccatggtgaccgtgagcagc

SEQ ID NO: 35537 - RNA, 366 nt, synthetic construct
  misc_feature 1..366: note = derived and/or modified sequence opt4 from anti-influenza_Chain
  source 1..366: mol_type = other RNA
gaggtgcagctgctggagagcggcggcggcctggtgcagcccggcggcagcctgagactgagctgcgccgccagcggcttcgccttcagcagctacggcatgagctgggtgagacaggcccccggcaagggcctggagtgggtgagcgccttcagcggcagcggcaccagcacctactacgccgacagcgtgaagggcagattcaccatcagcagagacaagagcaagaacaccctgtacctgcagatgaacagcctgagagccgaggacaccgccatctactactgcgccaagccccccggcccctacatcgtggtggccggcctgttcgagaactggggcagaggcaccctggtgaccgtgagc

SEQ ID NO: 35538 - RNA, 366 nt, synthetic construct
  misc_feature 1..366: note = derived and/or modified sequence opt4 from anti-influenza_Chain
  source 1..366: mol_type = other RNA
gaggtgcagctggtggagagcggcggcggcgtggtgcagcccggcagaagcctgagactgagctgcgccgccagcggcttcagcttcagcaactacgccatgcactgggtgagacaggcccccggcaagggcctggagtgggtggccctgatcagcttcgacggcagcgacaagtactacgccgacagcgtgaagggcagattcaccatgagcagagacaacagcaagaacaccctgtacctgcagatgaacagcctgagagccgaggacaccgccgtgtactactgcgccagagacgagccctactgcggcggcgactgcttcgccttcgacgtgtggggccagggcaccatggtgaccgtgagc

SEQ ID NO: 35539 - RNA, 366 nt, synthetic construct
  misc_feature 1..366: note = derived and/or modified sequence opt4 from anti-influenza_Chain
  source 1..366: mol_type = other RNA
caggtgcagctgcagcagagcggccccggcctggtgaagcccagccagaccctgagcctgacctgcaccgtgagcggcggccccgtgagcggcggcggctacagctggaactggatcagacagagacccggccagggcctggagtgggtgggcttcatgttccacagcggcagccccagatacaaccccaccctgaagagcagaatcaccatcagcgtggacaccagcaagaacctggtgagcctgaagctgagcagcgtgaccgccgccgacaccgccgtgtacttctgcgccagagtgggccagatggacaagtactacgccatggacgtgtggggccagggcaccaccgtgaccgtgagcagc

SEQ ID NO: 35540 - RNA, 366 nt, synthetic construct
  misc_feature 1..366: note = derived and/or modified sequence opt4 from anti-influenza_Chain
  source 1..366: mol_type = other RNA
caggtgcagctggtgcagagcggcggcggcctggtgaagcccggcggcagcctgagactgagctgcgccgccagcggcttcaccttcagcagctacagcatgaactgggtgagacaggcccccggcaagggcctggagtgggtgagcagcatcagcagcagcagcagctacatctactacgtggacagcgtgaagggcagattcaccatcagcagagacaacgccaagaacagcctgtacctgcagatgaacagcctgagagccgaggacaccgccgtgtactactgcgccagaggcggcggcagctacggcgcctacgagggcttcgactactggggccagggcaccctggtgaccgtgagcagc

SEQ ID NO: 35541 - RNA, 366 nt, synthetic construct
  misc_feature 1..366: note = derived and/or modified sequence opt4 from anti-influenza_Chain
  source 1..366: mol_type = other RNA
caggtgcagctggtgcagagcggcggcggcgtggtgcagcccggcagaagcctgagactgagctgcgccgccagcggcttcaacttcagcagctacggcatgcactgggtgagacaggcccccggcaagggcctggagtggctgagcgtgatctggagcggcggcagcaacaagtactacgccgacagcgtgaagggcagattcaccatcagcagagacgacagcaagaacaccgtgtacctgcagatgaacagcctgagagacgaggacaccgccgtgtactactgcgccagagcccacaccgccctgaccagattcagatggctggacccctggggccagggcatcctggtgaccgtgagcagc

SEQ ID NO: 35542 - RNA, 366 nt, synthetic construct
  misc_feature 1..366: note = derived and/or modified sequence opt4 from anti-influenza_Chain
  source 1..366: mol_type = other RNA
caggtgcagctggtgcagagcggcggcggcgtggtgcagagaggcagaagcctgagactgagctgcgccgccagcggcttcaccttcagaacctacggcatgcactgggtgagacaggcccccggcaagggcctggagtgcgtggccctgatcagctacgacggcaccaacaagtactacgccgacagcgtgaagggcagattcaccatcagcagagacaacagcaaggacaccctgtacctgcagatgaacagcctgagagccgaggacaccggcgtgtactactgcgccagcctggactacgacttcagctactactaccacagagacgtgtggggccccggcaccaccgtgaccgtgagcagc

SEQ ID NO: 35543 - RNA, 366 nt, synthetic construct
  misc_feature 1..366: note = derived and/or modified sequence opt4 from anti-influenza_Chain
  source 1..366: mol_type = other RNA
caggtgcagctggtggagagcggcggcggcctggtgcagcccggcggcagcctgagactgagctgcgccgccagcggcttcaccttcagcgactactggatggtgtgggtgagacaggcccccggcaagggcctggtgtgggtgagcagaatcagcagcgacggcagcaccaccagctacgccgacagcgtgaagggccccttcaccatcagcagagacaacgccaagaacaccctgtacctgcagatgaacagcctgagagccgaggacaccgccgtgtactactgcgccagagtggccaccccctactactacgagagcggcttcgactactggggccagggcgccctggtgaccgtgagcagc

SEQ ID NO: 35544 - RNA, 369 nt, synthetic construct
  misc_feature 1..369: note = derived and/or modified sequence opt4 from anti-influenza_Chain
  source 1..369: mol_type = other RNA
cagttccagctggtgcagagcggccccgaggtgaagaagcccggcaccagcgtgaaggtgagctgcaaggccagcggctacaccagcaccacctacggcatcagctgggtgagacaggtgcccggccagggcctggagtggatgggctggatcaacccctacaacggcaacccccactacggccagaagttccagggcagagtgaccctgaccagagacaccagcaccaacaccgcctacctggagatcctgagcctgagaagcgacgacaccgccgtgtactactgcgccagagacggctggggccagcagctggtgccctactacttcgactactggggccagggcaccctggtgaccgtgagcagc

SEQ ID NO: 35545 - RNA, 369 nt, synthetic construct
  misc_feature 1..369: note = derived and/or modified sequence opt4 from anti-influenza_Chain
  source 1..369: mol_type = other RNA
caggtgcagctggcccagagcggcgccgaggtgaagagacccggcagcagcgtgaaggtgagctgcaccgccagcggcggcatcttcagaaagaacgccatcagctgggtgagacaggcccccggccagggcctggagtggatgggcggcatcatcgccgtgttcaacaccgccaactacgcccagaagttccagggcagagtgaagatcaccgccgacgagagcggcaacaccgcctacatggagctgagcagcctgagaagcgacgacaccgccgtgtactactgcgccagccaccccaagtacttctacggcagcggcagctaccccgacttctggggccagggcaccctggtgaccgtgagcagc

SEQ ID NO: 35546 - RNA, 369 nt, synthetic construct
  misc_feature 1..369: note = derived and/or modified sequence opt4 from anti-influenza_Chain
  source 1..369: mol_type = other RNA
caggtgcagctgcaggagagcggccccggcctggtgaagcccagcgagaccctgagcctgacctgcaccgtgagcagaggcagcatcggccactacttctggagctggatcagacagccccccggcaagggcctggagtggatcggctacatcagctacagcggcagcaccaagtacaaccccagcctgagaagcagagtgaccatcagcgtggacaccagcaagaaccagttcagcctgaacctgaacagcgtgaccgccaccgacaccgccctgtactactgcgccagagaggactacgacatcctgaccggcgccggccccggcatggaggtgtggggccagggcaccaccgtgaccgtgagcagc

SEQ ID NO: 35547 - RNA, 369 nt, synthetic construct
  misc_feature 1..369: note = derived and/or modified sequence opt4 from anti-influenza_Chain
  source 1..369: mol_type = other RNA
caggtgcagctgcaggagagcggccccggcctggtgaagcccagcgagaccctgagcctgacctgcaccgtgagcggcgccagcatcaacagccactactggagctggatcagacagccccccggcaagggcctggagtggatcggctacgtgtactacagcggcagcaccacctacaaccccagcctgaagagcagagtgaccctgagcgtggacaccagcaagaaccagttcagcctgaacctgagcagcgtgaccgccgccgacaccgccttctactactgcgccagacacccctacgacgtgctgaccggcagcggcgactggttcgacccctggggccagggcaccctggtgaccgtgagcagc

SEQ ID NO: 35548 - RNA, 369 nt, synthetic construct
  misc_feature 1..369: note = derived and/or modified sequence opt4 from anti-influenza_Chain
  source 1..369: mol_type = other RNA
caggtgcagctggtgcagagcggcgccgaggtgaagagacccggcagcagcgtgaaggtgagctgcaccgccagcggcggcatcttcagaaagaacgccatcagctgggtgagacaggcccccggccagggcctggagtggatgggcggcatcatcgccgtgttcaacaccgccaactacgcccagaagttccagaacagagtgaagatcaccgccgacgagagcggcaacaccgcctacatggagctgagcagcctgaccagcgacgacaccgccgtgtactactgcgccagccaccccaagtacttctacggcagcggcagctaccccgacttctggggccagggcaccctggtgaccgtgagcagc

SEQ ID NO: 35549 - RNA, 369 nt, synthetic construct
  misc_feature 1..369: note = derived and/or modified sequence opt4 from anti-influenza_Chain
  source 1..369: mol_type = other RNA
gaggtgcagctggtggagagcggcgccgaggtgaagaagcccggcagcagcgtgaaggtgagctgcaaggccagcggcggcaccttcagaagctacgccgtgagctgggtgagacaggcccccggccagggcctggagtggatgggcggcatcatcgccatcttcggcaccaccaactacgcccagaagttccaggacagagtgaccatcaccgccgacgacctgcccagcaccgcctacatggagctgaccagcctgagaagcgaggacaccgccgtgtacttctgcgtgagaggcagaggctactacctgggcggcgactacggcagcctggacagctggggccagggcaccctggtgaccgtgagc

SEQ ID NO: 35550 - RNA, 369 nt, synthetic construct
  misc_feature 1..369: note = derived and/or modified sequence opt4 from anti-influenza_Chain
  source 1..369: mol_type = other RNA
gaggtgcagctggtggagagcggcggcggcctggtgcagcccggcagaagcctgagactgagctgcgtgggcagcggcttcaacttcgacggctacgccatgcagtgggtgagacaggtgcccggcaagggcctggagtgggtgagcggcatcagctggcacagcgacagcaccggctacgccgacagcgtgagaggcagattcaccatcagcagagacaacgccaagaacagcctgtacctgcagatggacagcctgagacccgaggacaccgccttctactactgcggcaagagcatcggccacgtgggcggcagctacagacaccccatcgactactggggccagggcaccctggtgaccgtgagc

SEQ ID NO: 35551 - RNA, 369 nt, synthetic construct
  misc_feature 1..369: note = derived and/or modified sequence opt4 from anti-influenza_Chain
  source 1..369: mol_type = other RNA
caggtgcagctgcaggccagcggccccggcctggtgaagcccagcgagaccctgagcctgacctgcaccgtgagcggcgacagcatcaccagcggcgcctactactggacctggatcagacagcaccccggcaagggcctggagtggatcggctacatctactacagcggcaacacctactacaaccccagcctgaagagcagagtgaccatcagcctggacaccagcaagaaccagttcagcctgaaggtgaacagcgtgaccgccgccgacaccgccgtgtactactgcgccagagccgccagcaccagcgtgctgggctacggcatggacgtgtggggccagggcaccaccgtgaccgtgagcagc

SEQ ID NO: 35552 - RNA, 369 nt, synthetic construct
  misc_feature 1..369: note = derived and/or modified sequence opt4 from anti-influenza_Chain
  source 1..369: mol_type = other RNA
caggtgcagctggtgcagagcggcgccgaggtgaagaagcccggcagcagcgtgagagtgagctgcaaggccagcggcagcatcttcagaaactacgccatgagctgggtgagacaggcccccggccagggcctggagtggatgggcggcatcatcgccatcttcggcacccccaagtacgcccagaagttccagggcagagtgaccatcaccgccgacgagagcaccagcaccgtgtacatggagctgagcggcctgagaagcgaggacaccgccatgtactactgcgccagaatcccccactacaacttcggcagcggcagctacttcgactactggggccagggcaccctggtgaccgtgagcagc

SEQ ID NO: 35553 - RNA, 369 nt, synthetic construct
  misc_feature 1..369: note = derived and/or modified sequence opt4 from anti-influenza_Chain
  source 1..369: mol_type = other RNA
cagctgcagctgcaggagagcggccccagactggtgaagcccagcgagaccctgagcctgacctgcagcgtgagcggcgtgagcatcagcagcagcaactactactggggctggatcagacagccccccggcaagggcctggagtggatcggcaccatctaccacagcggcagcacctactacaaccccagcctgaagagcagactgatcatcagcgtggacaccagcaagaaccagttctacctgcagctgaccagcctgaccgccgccgacagcgccgtgtactactgcgccaccggcggcggcttcggctggagccagacctacttcggctactggggccagggcaccctggtgaccgccagcagc

SEQ ID NO: 35554 - RNA, 369 nt, synthetic construct
  misc_feature 1..369: note = derived and/or modified sequence opt4 from anti-influenza_Chain
  source 1..369: mol_type = other RNA
gaggtgcagctgcagcagagcggccccgagctggtgaagcccggcgccagcgtgaagatgagctgcaaggccagcggctacaccttcaccagcttcatcatgtactgggtgaagcagaagcccggccagggcctggagtggctgggctacatcgacccctacaacgacggcaccaagtacaacgagaagttcgagggcaaggccaccctgaccagcgacaagagcagcagcaccgcctacatggagctgagcagcctgaccagcgaggacagcgccgtgtactactgcgccaagagaggcaactacggcaacggcttcgcctactggggccagggcaccctggtgaccgtgagcgccgccaagaccagc

SEQ ID NO: 35555 - RNA, 369 nt, synthetic construct
  misc_feature 1..369: note = derived and/or modified sequence opt4 from anti-influenza_Chain
  source 1..369: mol_type = other RNA
caggtgcagctgctggagagcggcggcgacgtggtgcagcccggcaccagcctgagactgagctgcgccgccagcggcttcagcctgtggaccagcggcatgcactgggtgagacaggcccccggcaagggcctggagtgggtggccgtgatgagctacgacgagaccaagaagtactacgccgacagcgtgagaggcagattcagcatcagcagagacaacagcagaaacaccctgtacctgcagatgaacagcctgagagtggaggacaccgccgtgtacttctgcgccaagcccagactggactacctggactacttccacgccgccgacagctggggccagggcaccctggtgagcgtgagcagc

SEQ ID NO: 35556 - RNA, 369 nt, synthetic construct
  misc_feature 1..369: note = derived and/or modified sequence opt4 from anti-influenza_Chain
  source 1..369: mol_type = other RNA
caggtgcagctggtggagagcggcgccgaggtgagaaagcccggcgagagcctgagaatcagctgcaaggcccacggcgacagcttcaccagctactggatcggctgggtgagacagctgcccggcaagggcctggagtggatggccgtgatctaccccagagacagcgagaccaagttcagccccgccttccacggccaggtgagcatcagcgtggacaagagcaccagcaccgtgcacctgcagtggaacagcctgaaggccagcgacaccgccgtgtactactgcgccagaagccccggctacagcggctacctgtacggctggttcgacccctggggccagggcacccccgtgaccgtgagcagc

SEQ ID NO: 35557 - RNA, 369 nt, synthetic construct
  misc_feature 1..369: note = derived and/or modified sequence opt4 from anti-influenza_Chain
  source 1..369: mol_type = other RNA
caggtgcagctggtggagagcggccccggcctggtgaagcccagcgagaccctgagcctgacctgcaccgtgagcggcgacagcgtgatcaacagcgcctactactgggactggatcagacagccccccggcaagggcctggagtgggtgggcagcgtgtactacagcggcatcacctactacaaccccagcctgaagagcagagtgaccatcagcgtggacaccagcaagaaccagttcagcctgagactgagctacgtgaccgccgccgacaccgccctgtactactgcgccagaagaggcggcggctggcagtactactacggcatggacgtgtggggccagggcaccaccgtgaccgtgagcagc

SEQ ID NO: 35558 - RNA, 369 nt, synthetic construct
  misc_feature 1..369: note = derived and/or modified sequence opt4 from anti-influenza_Chain
  source 1..369: mol_type = other RNA
caggtgcagctggtgcagagcggcgccgaggtgaagaagcccggcgccagcgtgaaggtgagctgcaaggccagcggctacatcttcaccggctactacatccactgggtgagacaggcccccggccagggcctggagtggatgggcagaatcgaccccaacggcagcggcaccacctacgcccagaagttccagggcagagtgaccctgaccatggacaccagcatcaccaccgcctacatggagctgagcagactgagattcgacgacaccgccatctactactgcgccagatgggactggaacttcgacctgtacctgggctggttcgacccctggggccagggcacccccgtgaccgtggccagc

SEQ ID NO: 35559 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgccagcgtgaaggtgagctgcaaggccagcggctacatcttcaccggctactacatccactgggtgagacaggcccccggccagggcctggagtggatgggcagaatcgaccccaacggcgccggcaccacctacgcccagaagttccagggcagagtgaccctgaccatggacaccagcatcaccaccgcctacatggagctgagcagactgagattcgacgacaccgccatctactactgcgccagatgggactggaacttcgacctgtacctgggctggttcgacccctggggccagggcacccccgtgaccgtggccagc

SEQ ID NO: 35560 - RNA, 369 nt, synthetic construct
  misc_feature 1..369: note = derived and/or modified sequence opt4 from anti-influenza_Chain
  source 1..369: mol_type = other RNA
caggtgcagctggtgcagagcggcgccgaggtgaagaagcccggcgccagcgtgaaggtgagctgcaaggccagcggctacaccttcaacgcccaccacatgcactgggtgagacaggcccccggccagggcctgggctggatgggctggatcgaccccaacaacgacggcaccatctacgcccagaagttccagggcagagtgaccctgaccatggacaccagcatccacaccgcctacatggagctgagcggcctgagatacgacgacaccgccatctactactgcgtgagatgggcctggaacttcgacttcttcctgggctggttcgacccctggggccagggcaccctggtgaccgtggccagc

SEQ ID NO: 35561 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacagcgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagc

SEQ ID NO: 35562 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacgccgacgccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagc

SEQ ID NO: 35563 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgagagcgagaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagc

SEQ ID NO: 35564 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacgccgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagc

SEQ ID NO: 35565 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcagcagcgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagc

SEQ ID NO: 35566 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacagcgacgccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagc

SEQ ID NO: 35567 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacaccgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagc

SEQ ID NO: 35568 - RNA, 369 nt, synthetic construct
  misc_feature 1..369: note = derived and/or modified sequence opt4 from anti-influenza_Chain
  source 1..369: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgagagcgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagc

SEQ ID NO: 35569 - RNA, 372 nt, synthetic construct
  misc_feature 1..372: note = derived and/or modified sequence opt4 from anti-influenza_Chain
  source 1..372: mol_type = other RNA
caggtgcagctggtgcagagcggcgccgaggtgaagaagcccggcagcagcgtgaaggtgagctgcaaggccagcggcggcatcttcatcagccaggccatcagctgggtgagacaggcccccggccagggcctggagtggatgggcggcatcatccccatgttcggcgccaccaactacgcccagaagttccagggcagagtgaccatcaccgccgacaagagcaccaacaccgtgtacatggagctgagcagcctgaccagcgaggacaccgccgtgtactactgcgccagactgggcagcggcagctaccacaacggccccaactggttcgacccctggggccagggcaccctggtgaccgtgagcagc

SEQ ID NO: 35570 - RNA, 372 nt, synthetic construct
  misc_feature 1..372: note = derived and/or modified sequence opt4 from anti-influenza_Chain
  source 1..372: mol_type = other RNA
caggtgcagctgcaggagagcggccccggcctggtgaagcccagcgagaccctgagcctgaactgcgccgtgagcggcggcagcatcagcaactactactggagctggatcagacagccccccggcaagggcctggagtggatcggctacatcagctacaacggcagacccaagtacaaccccagcctgaccagcagagtgaccatcagcgtggacaccagcaaggaccagttcagcctggagctgagaagcgtgaccgccgccgacaccgccctgtactactgcgccagagagaccagattcggcgagctgctgagcccctacgacgccttcgagatctggggccagggcaccatggtgaccgtgagcagc

SEQ ID NO: 35571 - RNA, 372 nt, synthetic construct
  misc_feature 1..372: note = derived and/or modified sequence opt4 from anti-influenza_Chain
  source 1..372: mol_type = other RNA
caggtgcagctgcaggagagcggccccggcctggtgaagcccagcgagaccctgagcctgacctgcaccgtgagcggcggcagcgtgagcagcgagacctactactggagctggatcagacagccccccggcaagggcctggagtggatcggctacatctactacatcggcaacaccgactacagacccagcctgaagagcagagtgaccatcagcctggacaccagcaagaaccagttcagcctgaagctgagcagcgtgaccgccgccgacaccgccgtgtactactgcgccagaggcgcctactacgacagcagcggctaccccgccttctacatctggggccagggcaccatggtgaccgtgagcagc

SEQ ID NO: 35572 - RNA, 372 nt, synthetic construct
  misc_feature 1..372: note = derived and/or modified sequence opt4 from anti-influenza_Chain
  source 1..372: mol_type = other RNA
caggtgcagctgcaggagagcggccccggcctggtgaagcccagcgagaccctgagcctgacctgcgccgtgagcggcgtgagcatcagcaacatcgacttctactggggctggatcagacagccccccggcaagggcctggagtggatcggcaacatctactacaccggcatcaccttctacaaccccagcctgagcagcagagtggccatcagcatcgacaccagcaagaaccagttcagcctgaccctgaccagcgtgaccgccgccgacaccgccatgtactactgcgccagacactacggcgacagcgaggccatcaacgacgccttcgacatctggggccagggcaccatgctgaccgtgagcagc

SEQ ID NO: 35573 - RNA, 372 nt, synthetic construct
  misc_feature 1..372: note = derived and/or modified sequence opt4 from anti-influenza_Chain
  source 1..372: mol_type = other RNA
caggtgcagctggtggagagcggcgccgaggtgaagaagttcggcgccagcgtgaaggtgagctgcaaggccagcggctacaccctgatcgactactacatgcactgggtgagagtggcccccggccagggcctggagtggatgggctggatcaaccccatcaacggcggcaccaactacgcccagaagttccagggcagagtgaccatgaccagagacaccagcatcaacaccgcctacatggacctgagcagcctgagaagcgacgacaccgccatgtactactgcaccagaggcagacccatcggcagaaactgggagcccagagacaaggactactggggccagggcacccccgtgaccgtgagcagc

SEQ ID NO: 35574 - RNA, 372 nt, synthetic construct
  misc_feature 1..372: note = derived and/or modified sequence opt4 from anti-influenza_Chain
  source 1..372: mol_type = other RNA
caggtgcagctggtgcagagcggcgccgaggtgaagaagcccggcagcagcgtgaccgtgagctgcaagaccagcggccacaccttcatcagctacgccatcagctggctgagacaggcccccggccagggcctggagtggatgggcggcatcgtgcccatcttcggcaccgtgaactacacccagaagttccagggcagactgaccatcaccgccgacgagagcaccagcaccgcctacatggacctgagcagactgaccttcgaggacaccgccatctacttctgcgccagagaggccggctaccacagcagcttcagcggcgtgtacttcgactactggggccagggcaccctgctgaccgtgagcagc

SEQ ID NO: 35575 - RNA, 372 nt, synthetic construct
  misc_feature 1..372: note = derived and/or modified sequence opt4 from anti-influenza_Chain
  source 1..372: mol_type = other RNA
gaggtgcagctgcagcagagcggccccgagctggtgaagcccggcgccagcgtgaagatcagctgcaaggccagcggctacaccttcaccgactacaacatgcactgggtgaagcagagcctgggcaagagcctggagtggatcggctacatctaccccaacaacggcggcaccggctacaaccagaagttcgagagcaaggccaccctgaccgtggacaacagcagcagcaccgcctacatggagctgagaaccctgaccagcgaggacagcgccgtgtactactgcgtgagaagcggcgcctactacttcaactacctggtgccctacttcgactactggggccagggcaccaccctgaccgtgagcagc

SEQ ID NO: 35576 - RNA, 372 nt, synthetic construct
  misc_feature 1..372: note = derived and/or modified sequence opt4 from anti-influenza_Chain
  source 1..372: mol_type = other RNA
gaggtgcagctgcagcagagcggccccgagctggtgaagcccggcgccagcgtgaagatcagctgcaaggccagcggctacaccttcaccggctacaacatgcactgggtgaagcagagccacggcaagagcctggagtggatcggcaagatctaccccaacaacggcgtgaccggctacaaccaggagttcagaagcaaggccaccctgaccgtggacaacagcagcagcaccgcctacatggagctgagaagcctgaccagcgaggacagcgccatctacttctgcgtgagaagcggcgcctactacgtgaactacctggtgccctacttcgactactggggccagggcaccaccctgaccgtgagcagc

SEQ ID NO: 35577 - RNA, 375 nt, synthetic construct
  misc_feature 1..375: note = derived and/or modified sequence opt4 from anti-influenza_Chain
  source 1..375: mol_type = other RNA
caggtgcagctggtgcagagcggcgccgaggtgaagaagcccggcagcagcgtgaaggtgagctgcaaggccagcggcgtgaccagcagcaactaccccatcacctgggtgagacaggcccccggccagggcctggagtggatgggcggcgtgctgcccctgttcggcgtgaccaactacgcccagaagttccagggcagagtgaccatcagcgccgacaagagcaccaacaccgcctacatggagctgagcagcctgagaagcgaggacaccgccgtgtactactgcgccagaggcaagagacccggctactgcagcggcggcgtgtgcagcagcgactactggggccagggcaccctggtgaccgtgagcagc

SEQ ID NO: 35578 - RNA, 375 nt, synthetic construct
  misc_feature 1..375: note = derived and/or modified sequence opt4 from anti-influenza_Chain
  source 1..375: mol_type = other RNA
caggtgcagctgcaggagagcggccccggcctggtgaagcccagccagaccctgagcctgacctgcaccgtgagcggcggcagcatcagcagcggcacctactactggagctggatcagacaccaccccggcaagggcctggagtggatcggctacatctaccacagcggcagcgcctactacaaccccagcctggagagcagagtgaccatgagcgtggacaccagcaagaaccagttcagcctgaagctgagcagcgtgaccgccgccgacaccgccatctactactgcgccagagccgagaacctgctgagcccctacctggccgagggcttcgacccctggggccagggcaccctggtgaccgtgagcagc

SEQ ID NO: 35579 - RNA, 375 nt, synthetic construct
  misc_feature 1..375: note = derived and/or modified sequence opt4 from anti-influenza_Chain
  source 1..375: mol_type = other RNA
gaggtgcagctggtgcagagcggcgccgaggtgaagaagcccggcgagagcctgaagatcagctgccaggccagcggctacagcttcaccagcagatggatcggctgggtgagacagatgcccggcaagggcctggagtgggtgggcttcatctaccccagcgacagcgacgtgagatacagccccagcttcagaggccaggtgaccatcagcgccgacaagagcatcagcaccgcctacctgcagtggagcagcctgaaggccagcgacaccgccatgtacttctgcgccagactgggcggcaacaaggactacggcgactacctgtggtacttcgacctgtggggcagaggcgccctggtgaccgtgagcagc

SEQ ID NO: 35580 - RNA, 375 nt, synthetic construct
  misc_feature 1..375: note = derived and/or modified sequence opt4 from anti-influenza_Chain
  source 1..375: mol_type = other RNA
caggtgcagctggtggagagcggcggcggcgtggtgcagcccggcagaagcctgagactgagctgcgccgccagcggcttcaccttcagcagctacggcatgcactgggtgagacaggcccccggcaagggcctggagtgggtggccgtgatctggtacgacggcgacaacaagtactacggcgacagcgtgaagggcagattcaccatcagcagagacaacagcaagaacaccctgttcctgcagatgaacagcctgagagccgaggacaccgccgtgtactactgcgccaaggacaccgccgaccacggcgactacgtggacctgggcttcttcgacgcctggggccagggcaccctggtgaccgtgagcagc

SEQ ID NO: 35581 - RNA, 375 nt, synthetic construct
  misc_feature 1..375: note = derived and/or modified sequence opt4 from anti-influenza_Chain
  source 1..375: mol_type = other RNA
gaggtgcagctggtgcagagcggcgccgagctgaagatgcccggcgagagcctgaagatcagctgcaaggccagcggctacaccttcaccaactactggatcggctgggtgagacagacccccggcaagggcctggagtggatgggcatcatcttcccccccgacagccagaccagctacagccccagcttccagggccaggtgaccttcagcgtggacaacagcatcagcgtggcctacatccagtggagcagcctgaaggccagcgacaccgccatctactactgcgccagaagcggcatcttcgactggagcgcccccctggtggaggccttcgacatctggggccagggcaccgtggtgaccgtgagcagc

SEQ ID NO: 35582 - RNA, 375 nt, synthetic construct
  misc_feature 1..375: note = derived and/or modified sequence opt4 from anti-influenza_Chain
  source 1..375: mol_type = other RNA
gaggtgcagctggtgcagagcggcgccgaggtgaagaagcccggcgagagcctgaagatcagctgcaagggcagcggctacagcttcagcgactactggatcggctgggtgagacagatgcccggcgagggcctggagtggatgggcatcatctaccccgccagcagcgagatcagatacagccccagcttccagggcctggtgaccatcagcgccgacaagagcatcaacaccgccagcctgcagtggagcagcctgaaggccagcgacaccgccatctactactgcgccagacacgccagctgcagcgccagaagctgctactggggccccgtggactactggggccagggcaccctggtgaccgtgagcagc

SEQ ID NO: 35583 - RNA, 375 nt, synthetic construct
  misc_feature 1..375: note = derived and/or modified sequence opt4 from anti-influenza_Chain
  source 1..375: mol_type = other RNA
caggtgcagctggtggagagcggcggcggcgtggtgcagcccggcagaagcctgagactgagctgcgccgccagcgagatcaccttcatcacctacgccatgcactgggtgagacaggcccccggcaagggcctggagtgggtggccctgatcagcgacgacggcagcaacaagttctacgccgacagcgtgaagggcagattcaccatcagcagagacaacagcaagaacaccctgtacctgcagatgaacagcctgagagccgaggacaccgccgcctactactgcgccagagagggcgtgtacttcgacagcggcacctacagaggctacttcgactactggggccaggagaccctggtgaccgtgagcagc

SEQ ID NO: 35584 - RNA, 375 nt, synthetic construct
  misc_feature 1..375: note = derived and/or modified sequence opt4 from anti-influenza_Chain
  source 1..375: mol_type = other RNA
caggtgcagctgcaggagagcggccccggcctggtgaagcccagccagaccctgagcctgacctgcaccgtgagcggcggcagcatcagcagcggcaactactactggaactgggtgagacagcaccccggcaagggcctggagtggatcggctacatctactacagaggcagcaccttctacaaccccagcctgaagagcagagtgaccatcagcatcgacaccagcaagaaccagttcagcctgagactgagcagcgtgaccgccgccgacaccgccgtgtactactgcgccaaggacaccagaagcagcctggacaactaccagtacggcatggacgtgtggggccagggcaccaccgtgaccgtgagcagc

SEQ ID NO: 35585 - RNA, 375 nt, synthetic construct
  misc_feature 1..375: note = derived and/or modified sequence opt4 from anti-influenza_Chain
  source 1..375: mol_type = other RNA
gaggtgcagctgctggagagcggcggcggcctggtgcagcccggcggcagcctgagactgagctgcgccgccagcggcttcagcttcagcacctacgccatgagctgggtgagacaggcccccggcaagggcctggagtgggtgagcggcatcagcggcagcggcgagagcacctactacgccgacagcgtgaagggcagattcaccgtgagcagagacaacagcaagaacaccctgtacctgcagatgaacagcctgagagccgaggacaccgccgtgtactactgcgccaagcagggcgaccacatcgcctggctgctgagaggcatcaacttcgactactggggccagggcgtgctggtgaccgtgagcagc

SEQ ID NO: 35586 - RNA, 375 nt, synthetic construct
  misc_feature 1..375: note = derived and/or modified sequence opt4 from anti-influenza_Chain
  source 1..375: mol_type = other RNA
caggtgcagctggtggagagcggcggcggcgtggtgcagcccggcagaagcctgagactgagctgcgccgccagcggcttcgccttccacaacagagccatgcactgggtgagacaggcccccggcaagggcctggagtgggtggccctgatctacttcgacggcagcaagcagtactacgccgacagcgtgaagggcagattcaccatcagcagagacaacagcaagaacaccgtgttcctgcagatgaacagcctgagacccgaggacaccgccgtgtactactgcgccgtgcccggccccatcttcggcatcttccccccctggagctacttcgaccactggggccagggcatcctggtgaccgtgagcagc

SEQ ID NO: 35587 - RNA, 375 nt, synthetic construct
  misc_feature 1..375: note = derived and/or modified sequence opt4 from anti-influenza_Chain
  source 1..375: mol_type = other RNA
gaggtgcagctggtggagagcggcggcggcgtggtgcagcccggcagaagcctgagactgagctgcgccgccagcggcttcgccttccacaacagagccatgcactgggtgagacaggcccccggcaagggcctggagtgggtggccctgatctacttcgacggcagcaagcagtactacgccgacagcgtgaagggcagattcaccatcagcagagacaacagcaagaacaccgtgttcctgcagatgaacagcctgagacccgaggacaccgccgtgtactactgcgccgtgcccggccccatcttcggcatcttccccccctggagctacttcgaccactggggccagggcatcctggtgaccgtgagcagc

SEQ ID NO: 35588 - RNA, 375 nt, synthetic construct
  misc_feature 1..375: note = derived and/or modified sequence opt4 from anti-influenza_Chain
  source 1..375: mol_type = other RNA
gaggtgcagctggtgcagagcggcggcggcgtggtgcagcccggcaagagcctgagactgagctgcgccgccagcggcctgaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagc

SEQ ID NO: 35589 - RNA, 375 nt, synthetic construct
  misc_feature 1..375: note = derived and/or modified sequence opt4 from anti-influenza_Chain
  source 1..375: mol_type = other RNA
caggtgcagctggtggagagcggcggcggcgtggtgcagcccggcaagagcctgagactgagctgcgccgccagcggcctgaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagc

SEQ ID NO: 35590 - RNA, 375 nt, synthetic construct
  misc_feature 1..375: note = derived and/or modified sequence opt4 from anti-influenza_Chain
  source 1..375: mol_type = other RNA
caggtgcagctggtggagagcggcggcggcgtggtgcagcccggcaagagccccagactgagctgcgccgccagcggccccaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagc

SEQ ID NO: 35591 - RNA, 375 nt, synthetic construct
  misc_feature 1..375: note = derived and/or modified sequence opt4 from anti-influenza_Chain
  source 1..375: mol_type = other RNA
gaggtgcagctggtggagagcggcggcggcgtggtgcagcccggcaagagcctgagactgagctgcgccgccagcggcctgaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagc

SEQ ID NO: 35592 - RNA, 375 nt, synthetic construct
  misc_feature 1..375: note = derived and/or modified sequence opt4 from anti-influenza_Chain
  source 1..375: mol_type = other RNA
caggtgcagctggtgcagagcggcgccgagctgaagagacccggcgccagcgtgaaggtgagctgcaagaccagcggctacagcttcaacaactacggcatcaactgggtgagacaggcccccggccagggcctggagtggatgggctggatcagcgcctacaccggcaacacccactacgccaagaacttcgagggcagagtgaccctgaccaccgacaccagcaccagcaccgcctacatggaggtgagaagcctgagaagcgacgacagcgccgtgtacttctgcgccagagccatgatccagggcgtggtgaccctgtacctgagacccggcgactactggggccagggcaccctggtgaccgtgagcagc

SEQ ID NO: 35593 - RNA, 375 nt, synthetic construct
  misc_feature 1..375: note = derived and/or modified sequence opt4 from anti-influenza_Chain
  source 1..375: mol_type = other RNA
caggtgcagctggtgcagagcggcgccgaggtgaagcagcccggcgccagcgtgaaggtgagctgcaaggccagcggctacaccttcaacgcctactacatccactgggtgagacaggcccccggccagggcctggagtggatgggctggatcaaccccaacttcggcggcacccactacgccagaaagttccagggcagagtgaccatgaccagagacgccagcatcaacaccgcctacatggagctggacagactgatcagcgacgacaccgccgtgtactactgcgtgagatggagagccgccgccgtgatcatggaccagttctacaagatggacgtgtggggccagggcaccctggtgaccgtgagcagc

SEQ ID NO: 35594 - RNA, 375 nt, synthetic construct
  misc_feature 1..375: note = derived and/or modified sequence opt4 from anti-influenza_Chain
  source 1..375: mol_type = other RNA
caggtgcagctggtgcagagcggccccgagctgaagaagcccggcagcagcgtgaagctgagctgcatggccaccggcggcaccttcatcaactacgccttcagctgggtgagacaggcccccggccagggcctggagtggctgggcggcatcatccccgtgtacggcaccagcaaccacgtggagaagctgcagggcagagtgaccatcaccgccgacgccagcaccaacaccgcctacatggagctgagcggcctgagattcgacgacaccgccgtgtacttctgcgccgccagcaccgccaccagcggcacctactacgccatgagacccttcgacttctggggccagggcaccctggtgagcgtgagcagc

SEQ ID NO: 35595 - RNA, 378 nt, synthetic construct
  misc_feature 1..378: note = derived and/or modified sequence opt4 from anti-influenza_Chain
  source 1..378: mol_type = other RNA
gaggtgcagctggtggagagcggcggcggcgtggtgcagcccggcggcagcctgagactgagctgcatcgccagcgccttcaacctgggcatcttcggcatgcactgggtgagacaggcccccggcaagggcctggagtgggtggccttcatcagatacgacggcggcaagaccttctacgccgacagcgtgaagggcagattcaccatcagcagagacaacagcaagaacaccctgtacctgcagatgaacagcctgagaaccgaggacaccgccctgtactactgcgccagagacgccaccgccgactactacggccccggcagctaccccaactggctggacccctggggccagggcaccctggtgaccgtgagc

SEQ ID NO: 35596 - RNA, 378 nt, synthetic construct
  misc_feature 1..378: note = derived and/or modified sequence opt4 from anti-influenza_Chain
  source 1..378: mol_type = other RNA
gaggtgcagctggtggagagcggccccgccctggtgaagcccacccagaccctgaccctgacctgcagcttcagcggcttcagcctgagcaccagcggcatgagcgtgagctggatcagacagccccccggcaaggccctggagtggctggccctgatcgactgggacgacgacacctactacatcacctacagcagcagcctgaagaccagactgaccatcagcaaggacaccagcaagagccaggtggtgctgaccatgaccaacatggaccccgtggacaccgccacctactactgcgccagaaccctgagagtgagcggcgactacgtgagagacttcgacctgtggggcagaggcaccctggtgaccgtgagc

SEQ ID NO: 35597 - RNA, 378 nt, synthetic construct
  misc_feature 1..378: note = derived and/or modified sequence opt4 from anti-influenza_Chain
  source 1..378: mol_type = other RNA
caggtgcagctgcaggagagcggccccggcctggtgaagcccagcgagaccctgagcctgacctgcaccgtgagcggcggcagcatcaacagctactactggaactggatcagacagccccccggcaagggcctggagtggatcggctacatctaccacagcggcagcaccaactacaaccccagcctgaagagcagagtgaccatcagcgtggacaccagcaagaaccagttcagcctgcagctgagcagcgtgaccgccgccgacaccgccgtgtactactgcgccagactgagaaccgactacggcgaccccgacagcgtgtactactacggcatggacgtgtggggccagggcaccaccgtgaccgtgagcagc

SEQ ID NO: 35598 - RNA, 378 nt, synthetic construct
  misc_feature 1..378: note = derived and/or modified sequence opt4 from anti-influenza_Chain
  source 1..378: mol_type = other RNA
caggtgcacctggtgcagagcggcgccgaggtgagaaagcccggcgacagcgtgaaggtgagctgcaagaccagcggctacaccttcagcacctaccccgtggcctgggtgagacaggtgcccggccagggcctggagtggatgggctggatcagcacctacaacggcaacaccaacttcgcccagaacttccagggcagagtgaccctgaccaccgacaccaccaccaacaccgcctacatggaggtgagaagcctgaagttcgacgacaccgccgtgtactactgcgccagagtggagggcagctacagagacttctggaacaaccagaacagattcgacccctggggccagggcaccctggtgaccgtgagcagc

SEQ ID NO: 35599 - RNA, 378 nt, synthetic construct
  misc_feature 1..378: note = derived and/or modified sequence opt4 from anti-influenza_Chain
  source 1..378: mol_type = other RNA
gaggtgcagctggtggagagcggcgccgaggtgaagaagcccggcgccagcgtgaaggtgagctgcaaggccagcggctacaccttcaccagcttcgacatcaactgggtgagacaggcccccggccagggcctggagtggatgggctggatgacccccaccagcggcaagaccggctacgcccagaagttccagggcagaatcaccatgaccagaaacaccagcatcaacaccgcctacatggagctgagcagcctgagaagcgaggacaccgccgtgtacttctgcgccagaggccccgagagaagaaccaccatcttcgacgtgatcctggactggttcgacccctggggccagggcaccctggtgaccgtgagc

SEQ ID NO: 35600 - RNA, 378 nt, synthetic construct
  misc_feature 1..378: note = derived and/or modified sequence opt4 from anti-influenza_Chain
  source 1..378: mol_type = other RNA
caggtgcagctggtgcagagcggcgccgaggtgaagaagcccggcagcagcgtgaaggtgagctgcaaggccagcggcggcttcttcagcagctacgccatcagctgggtgagacaggcccccggccagggcctggagtggatgggcggcgtgatccccatcttcagaaccgccaactacgcccagaacttccagggcagagtgaccatcaccgccgacgagttcaccagctacatggagctgagcagcctgagaagcgacgacaccgccgtgtactactgcgccagactgaactaccacgacagcggcacctactacaacgcccccagaggctggttcgacccctggggccagggcaccctggtgaccgtgagcagc

SEQ ID NO: 35601 - RNA, 378 nt, synthetic construct
  misc_feature 1..378: note = derived and/or modified sequence opt4 from anti-influenza_Chain
  source 1..378: mol_type = other RNA
caggtgcagctggtgcagagcggcgccgaggtgaagaagcccggcagcagcgtgaaggtgagctgcaaggccagcggcggcgccttcagcaactacgccatcagctgggtgagacaggcccccggccagggcctggagtggatgggcggcatcatccccatcttcggcaccaccaactacgcccagaagttccagggcagagtgaccatcaccgccgacaagttcaccaccatcgcctacatggagctgagaagcctgagaagcgaggacaccgccgtgtactactgcgccagacacggcggcgtgtactactacggcagcgccagcagcggctggttcgacccctggggccagggcaccctggtgaccgtgagcagc

SEQ ID NO: 35602 - RNA, 378 nt, synthetic construct
  misc_feature 1..378: note = derived and/or modified sequence opt4 from anti-influenza_Chain
  source 1..378: mol_type = other RNA
caggtgcagctgctggagagcggcggcggcgtggtgagacccggcagaagcctgagactggcctgcgccggcagcggcttcaccttcagcgcctacgccatgcactgggtgagacaggcccccggcaagggcctggagtgggtggcccacaccagctacgacggcagagacagctactacgtggacagcgtgaagggcagattcaccatcagcagagacgacagcaagaacaccctgtacctgcagatgaacagcctgagacccgaggacaccgccgtgtactactgcgccaaggtgggcccctacaccggctacgacgactacaactactacggcatggacgtgtggggccacggcaccaccgtgaccgtgagcagc

SEQ ID NO: 35603 - RNA, 378 nt, synthetic construct
  misc_feature 1..378: note = derived and/or modified sequence opt4 from anti-influenza_Chain
  source 1..378: mol_type = other RNA
caggtgcagctggtggagagcggcggcggcgtggtgcagcccggcggcagcctgagactgagctgcgccgccagcggcttcaacttcgacgagtacgtgatgtactgggtgagacagagccccggcaagggcctggagtgggtgagcctgatcggcgccgacggcagaggcacctacaacagcgacagcgtgaagggcagattcaccatcagcagagacaacagaaagaacagcctgtacctgcagatgaacagcctgagaagcgacgacaccgccctgtactactgcgccaaggtggagagaagcttctacgacggcagcggctacggcgacgccctggagatctggggccagggcaccatggtgaccgtgagcagc

SEQ ID NO: 35604 - RNA, 381 nt, synthetic construct
  misc_feature 1..381: note = derived and/or modified sequence opt4 from anti-influenza_Chain
  source 1..381: mol_type = other RNA
gaggtgcagctgctggagagcggcggcggcctggtgcaccccggcggcagcctgagactgagctgcgccgccagcggcttcaccttcagcaactacgccatgagctgggtgagacaggcccccggcaagggcctggagtgggtgagcagcatcaacagcggcggcggcgccacctactacgccgacagcgtgaagggcagattcaccatcagcagagacaacagcaagaacaccctgagcctgcagatgaacagcctgagagccgaggacaccgccgtgtactactgcgccaaggagggcggcaacaccatcttcggcctggtgaccatggcctactacttcgacagctggggccagggcaccctggtgaccgtgagcagc

SEQ ID NO: 35605 - RNA, 381 nt, synthetic construct
  misc_feature 1..381: note = derived and/or modified sequence opt4 from anti-influenza_Chain
  source 1..381: mol_type = other RNA
cagccccagctgcaggagagcggccccggcctggtgagacccagcgagaccctgagcctgacctgcaccgtgagcggcgacagcgtgaccagaggcggcttctactggggctggatcagacagccccccggcaagggcctggagtggatcggcagcatctactacaactacaacatctaccacagccccagcctgaagagcagagtgagcctgagcgtggacaccagcaagaaccaggtgagcctgaagctggccagcgtgaccgccgccgacaccgccgtgtactactgcgccagacactacccctactacgacctgcccaccggcttctacagccagttcgacttctggggccagggcacccccgtgaccgtgagcagc

SEQ ID NO: 35606 - RNA, 381 nt, synthetic construct
  misc_feature 1..381: note = derived and/or modified sequence opt4 from anti-influenza_Chain
  source 1..381: mol_type = other RNA
tggtggcagctggtgcagagcggcgccgaggtgaagaagcccggcagcagcgtgaaggtgagctgcaaggccagcggcggcaccttcagcagctacgacatcagctgggtgagacaggcccccggccagggcctggagtggatgggcggcatcatccccatctacggcaccgccaactacgcccagaagttccagggcagagtgaccatcaccgccgacgagagcaccagcaccgcctacatggagctgagcagcctgagaagcgaggacaccgccgtgtactactgcgccagagccggcggcgacagcagcggctactacggcgccctgggcagattcttccagcactggggccagggcaccctggtgaccgtgagcagc

SEQ ID NO: 35607 - RNA, 381 nt, synthetic construct
  misc_feature 1..381: note = derived and/or modified sequence opt4 from anti-influenza_Chain
  source 1..381: mol_type = other RNA
gaggtgcagctggtgcagagcggcggcgccgtggtgcagcccggcagaagcctgagactgagctgcgccgccagcggcttcaccttcagcatctacgccatgcactgggtgagacagacccccggcaagggcctggagtgggtggccctgatcagctacgacggcaacaacaagtactacgccgacagcgtgaagggcagattcaccatcagcagagacaactacaagaacaccctgtacctgcagatgaagggcctgagagccgaggacaccgccctgtactactgcgccagaagaatcaccgagaagggctactacaacgacagcggcagacccaactggttcgacccctggggccagggcaccctggtgaccgtgagc

SEQ ID NO: 35608 - RNA, 381 nt, synthetic construct
  misc_feature 1..381: note = derived and/or modified sequence opt4 from anti-influenza_Chain
  source 1..381: mol_type = other RNA
caggtgcagctgcagcagagcggccccagactggtgaagcccagccagaccctgagcctgacctgcgccatcagcggcgacagcgtgagcggcgacagcggcacctggaactggatcagacagagccccagcagaggcctggagtggctgggcagaacctactacagaagcaagtggtacaacgactacgccgagagcgtgaagagcagaatcgtgatcaaggccgacaccagcaagaacgagttcagcctgcagctgaacagcgtgacccccgaggacaccgccatctactactgcgccagagccggcgtgaagatcttcggcctgatcgtgggcgccctggacaactggggcagaggcaccctggtgaccgtgagcagc

SEQ ID NO: 35609 - RNA, 381 nt, synthetic construct
  misc_feature 1..381: note = derived and/or modified sequence opt4 from anti-influenza_Chain
  source 1..381: mol_type = other RNA
caggtgcagctgcagcagtggggcgccggcctgctgaagcccagcgagaccctgagcctgacctgcaccgtgagcggcggcagcctgaccgactacagctggaactggatcagacagccccccggcaagggcctggagtggatcggcgacaccctgcacaacggctacaccaactacaaccccagcctgagaggcagagtgagcatcagcatcgacaccagcaagaaccaggtgagcctgagactgaccagcgtgaccgccgccgacaccgccctgtactactgcgccagaggcagcggcggctacggcggcttcgactacttcggcaagctgagaacctgggacttctggggccagggcaccctggtgaccgtgagcagc

SEQ ID NO: 35610 - RNA, 381 nt, synthetic construct
  misc_feature 1..381: note = derived and/or modified sequence opt4 from anti-influenza_Chain
  source 1..381: mol_type = other RNA
caggtgcagctggtgcagagcggcgccgaggtgagaaagcccggcgagagcctgagaatcagctgcagaggcagcggctacaacttccccaagtactggatcggctgggtgagacagatgcccggcaagggcctggagtggatgggcatgatctaccccggcgacagcgacgtgagatacaaccccagcttccagggccaggtgaccatcagcgccgacgagagcatcaacaccgcctacctgcagtggagcagcctgagaaccagcgacaccgccagatactactgcgccagacacctgggccagcagctggtgagcaacacctactactactacggcatggacgtgtggggccagggcaccaccgtgaccgtgagcagc

SEQ ID NO: 35611 - RNA, 384 nt, synthetic construct
  misc_feature 1..384: note = derived and/or modified sequence opt4 from anti-influenza_Chain
  source 1..384: mol_type = other RNA
cagatccagctgcaggagagcggccccggcctggtgaagcccagccagaccctgagcctgacctgcgccatcagcggcgacagcgtgagcagcaacaacgccgtgtggaactggatcagacagagccccagcagaggcctggagtggctgggcagaacctactacagaagcaagtggtacaacgactacgccgagagcgtgaagagcagaatcaccgtgaaccccgacaccagcaagaaccagttcagcctgcacctgaagagcgtgacccccgaggacaccgccgtgttctactgcgtgagaagcggccacatcaccgtgttcggcgtgaacgtggacgccttcgacatgtggggccagggcaccatggtgaccgtgagcagc

SEQ ID NO: 35612 - RNA, 384 nt, synthetic construct
  misc_feature 1..384: note = derived and/or modified sequence opt4 from anti-influenza_Chain
  source 1..384: mol_type = other RNA
caggtgcagctgcaggagagcggccccggcctggtgaagcccagccagaccctgagcctgacctgcgccatcagcggcgacagcgtgagcagcaacaacgccgtgtggaactggatcagacagagccccagcagaggcctggagtggctgggcagaacctactacagaagcaagtggtacaacgactacgccgagagcgtgaagagcagaatcaccgtgaaccccgacaccagcaagaaccagttcagcctgcacctgaagagcgtgacccccgaggacaccgccgtgttctactgcgtgagaagcggccacatcaccgtgttcggcgtgaacgtggacgccttcgacatgtggggccagggcaccatggtgaccgtgagcagc

SEQ ID NO: 35613 - RNA, 384 nt, synthetic construct
  misc_feature 1..384: note = derived and/or modified sequence opt4 from anti-influenza_Chain
  source 1..384: mol_type = other RNA
caggtgcagctgcagcagagcggccccggcctggtgaagcccagccagaccctgagcctgacctgcgccatcagcggcgacagagtgagcagcaacagcgccgtgtggaactggatcagacagagccccagcagaggcctggagtggctgggcagaacctactacagaagcaagtggtactacgactacgccgagagcgtgaagagcagaatcgtgatcgaccccgacaccagcaagaaccaggtgagcctgcagctgaacagcgtgacccccgaggacagcgccatctactactgcgccagaggcggccacatcaccgtgttcggcctgaacatcgacgcctacgacatctggggccagggcgccaaggtgaccgtgagcagc

SEQ ID NO: 35614 - RNA, 384 nt, synthetic construct
  misc_feature 1..384: note = derived and/or modified sequence opt4 from anti-influenza_Chain
  source 1..384: mol_type = other RNA
caggtgcagctgcagcagagcggccccggcctggtgaagcccagccagaccctgagcctgacctgcgccatcagcggcgacagagtgagcagcaacagcgccgtgtggaactggatcagacagagccccagcagaggcctggagtggctgggcagaacctactacagaagcaagtggtactacgactacgccgagagcgtgaagagcagaatcgtgatcgaccccgacaccagcaagaaccaggtgagcctgcagctgaacagcgtgacccccgaggacagcgccatctactactgcgccagaggcggccacatcaccgtgttcggcctgaacatcgacgcctacgacatctggggccagggcgccatggtgaccgtgagcagc

SEQ ID NO: 35615 - RNA, 384 nt, synthetic construct
  misc_feature 1..384: note = derived and/or modified sequence opt4 from anti-influenza_Chain
  source 1..384: mol_type = other RNA
caggtgcagctgcagcagagcggccccggcctggtgaagcccagccagaccctgagcctgacctgcgccatcagcggcgacagagtgagcagcaacagcgccgtgtggaactggatcagacagagccccagcagaggcctggagtggctgggcagaacctactacagaagcaagtggtactacgactacgccgagagcgtgaagagcagaatcgtgatcgaccccgacaccagcaagaaccaggtgagcctgcagctgaacagcgtgacccccgaggacagcgccatctactactgcgccagaggcggccacatcaccgagttcggcctgaacatcgacgcctacgacatctggggccagggcgccatggtgaccgtgagcagc

SEQ ID NO: 35616 - RNA, 384 nt, synthetic construct
  misc_feature 1..384: note = derived and/or modified sequence opt4 from anti-influenza_Chain
  source 1..384: mol_type = other RNA
caggtgcagctgcagcagagcggccccggcctggtgaagcccagccagaccctgagcctgacctgcgtgatcagcggcgacaccgtgagcagcaacagagccacctggaactggatgagacagagccccctgagaggcctggagtggctgggcagaacctactacagaagcaagtggtacaacgactacgccgtgagcgtgaagagcagagtggtgatcaaccccgacaccagcaagaaccaggtgagcctgcagctgaacaccgtgacccccgacgacagcggcgtgtacttctgcgccagaggcggccacatcaccgtgttcggcgtgaacatcgacgccttcgacatctggggcctgggcaccaaggtgaccgtgagcagc

SEQ ID NO: 35617 - RNA, 384 nt, synthetic construct
  misc_feature 1..384: note = derived and/or modified sequence opt4 from anti-influenza_Chain
  source 1..384: mol_type = other RNA
caggtggagctgcagcagagcggccccggcctggtgaagcccagccagaccctgagcctgacctgcgccatcagcggcgacagcgtgagcagcaacagcgccacctggaactggatcagacagagccccagcagaggcctggagtggctgggcagaacctactacagaagcaagtggtacaacgactacgccgacttcctgaagagaagaatcaccatcaaccccgacaccagcaacaacgaggtgagcctgagactgaccagcgtgacccccgacgacaccgccctgtactactgcgccagaggcggccacatcaccgtgttcggcgtgaacatcgacgccttcgacgtgtggggccagggcaccatggccaccgtgagcagc

SEQ ID NO: 35618 - RNA, 384 nt, synthetic construct
  misc_feature 1..384: note = derived and/or modified sequence opt4 from anti-influenza_Chain
  source 1..384: mol_type = other RNA
caggtgcagctgcagcagagcggccccggcctggtgaagcccagccagaccctgagcctgacctgcgccatcagcggcgacagcgtgagcagcaacagcgccacctggaactggatcagacagagccccagcagaggcctggagtggctgggcagaacctactacagaagcaagtggtacaacgactacgccgacttcctgaagagaagaatcaccatcaaccccgacaccagcaacaacgaggtgagcctgagactgaccagcgtgacccccgacgacaccgccctgtactactgcgccagaggcggccacatcaccgtgttcggcgtgaacatcgacgccttcgacgtgtggggccagggcaccatggtgaccgtgagcagc

SEQ ID NO: 35619 - RNA, 384 nt, synthetic construct
  misc_feature 1..384: note = derived and/or modified sequence opt4 from anti-influenza_Chain
  source 1..384: mol_type = other RNA
caggtgcagctgcagcagagcggccccggcctggtgaagcccagccagaccctgagcctgacctgcgccatcagcggcgacagcgtgagcagctacaacgccgtgtggaactggatcagacagagccccagcagaggcctggagtggctgggcagaacctactacagaagcggctggtacaacgactacgccgagagcgtgaagagcagaatcaccatcaaccccgacaccagcaagaaccagttcagcctgcagctgaacagcgtgacccccgaggacaccgccgtgtactactgcgccagaagcggccacatcaccgtgttcggcgtgaacgtggacgccttcgacatgtggggccagggcaccatggtgaccgtgagcagc

SEQ ID NO: 35620 - RNA, 384 nt, synthetic construct
  misc_feature 1..384: note = derived and/or modified sequence opt4 from anti-influenza_Chain
  source 1..384: mol_type = other RNA
caggtgcagctgcagcagagcggccccggcctggtgaagcccagccagaccctgagcctgacctgcgccatcagcggcgacagcgtgagcagcaacaacgccgtgtggaactggatcagacagagccccagcagaggcctggagtggctgggcagaacctactacagaagcaagtggtacaacgactacgccgagagcgtgaagagcagaatcaccatcaaccccgacaccagcaagaaccagttcagcctgcagctgaacagcgtgacccccgaggacaccgccgtgtactactgcgccagaagcggccacatcaccgtgttcggcgtgaacgtggacgccttcgacatgtggggccagggcaccaccgtgaccgtgagcagc

SEQ ID NO: 35621 - RNA, 384 nt, synthetic construct
  misc_feature 1..384: note = derived and/or modified sequence opt4 from anti-influenza_Chain
  source 1..384: mol_type = other RNA
agaggccagctggtgcagagcggcggcggcgtggtgcagcccggcagaagcctgagactgagctgcgccgccagcggcttcgtgttcaacgtgttcggcatccactgggtgagacaggcccccggcaagggcctggagtggctggccaccatcagctacgacggcctgaacaagtactacgccgacagcgtgaagggcagaatcaccatcagcagagacaacagcaagaacaccctgtacctgcagatgaacagcctgagagccgaggacaccgccgtgtactactgcgtgagagacagcgaggagagcacctactacggcgactacatgtgggtgtacaactggttcgacctgtggggccagggcaccctggtgaccgtgagc

SEQ ID NO: 35622 - RNA, 384 nt, synthetic construct
  misc_feature 1..384: note = derived and/or modified sequence opt4 from anti-influenza_Chain
  source 1..384: mol_type = other RNA
caggtgcagctgcagcagtggggcagcggcctgctgaagcccagcgagaccctgagcctgacctgcgccgtgtacggcggcagcttcagagacgactactggacctggatcagacagccccccggcaagggcctggagtggatcggcgagatcaaccacagcggcagaaccaactacaaccccagcctgaagagcagagtgaccatcagcgtggacaccagcctgaagcagttcagcctgaaggtgatcagcgtgaccgccgccgacaccgccgtgtactactgcgccagaggcaccagccacgtgagcagatacttcgactggctgccccccaccaactggttcgacccctggggccagggcacccaggtgaccgtgagcagc

SEQ ID NO: 35623 - RNA, 384 nt, synthetic construct
  misc_feature 1..384: note = derived and/or modified sequence opt4 from anti-influenza_Chain
  source 1..384: mol_type = other RNA
caggtgcagctgcagcagtggggcgccggcctgctgaagcccagcgagaccctgagcctgagctgcgccgtgttcggcggcagcttcagcgactactactggacctggatcagacagccccccggcaagggcctggagtggatcggcgagatcaagcacagcggcagaaccaactacaaccccagcctggagagcagagtgaccatcagcgtggacaccagcaagaaccagttcagcctgaagctgagcagcgtgaccgccgccgacaccgccatctactactgcgccagaggcaccgaccccgacaccgagggctactgcagaagcggcagctgcagcgccttcgacttctggggccagggcaccctggtgaccgtgagcagc

SEQ ID NO: 35624 - RNA, 384 nt, synthetic construct
  misc_feature 1..384: note = derived and/or modified sequence opt4 from anti-influenza_Chain
  source 1..384: mol_type = other RNA
caggtgcagctgcagcagtggggcgccggcctgctgaagcccagcgagaccctgagcctgacctgcggcgtgtacggcggcagcctgagcgactactactggagctggatcagacagccccccggcaagggcctggagtggatcggcgagatcaaccacagcggcggcaccaactacaaccccagcctgaagagaagagtgaccatcagcgtggacaccagcaagaagcagttcagcctgaagatgaacagcgtgaccgccgccgacaccgccgtgtactactgcgccagaggcaccgaccccgacaccgaggtgtactgcagagccggcaactgcgccgccttcgacttctggggccagggcaccctggtgaccgtgagcagc

SEQ ID NO: 35625 - RNA, 384 nt, synthetic construct
  misc_feature 1..384: note = derived and/or modified sequence opt4 from anti-influenza_Chain
  source 1..384: mol_type = other RNA
caggtgcagctgcaggagagcggccccggcctggtgaagcccagccagaccctgagcctgacctgcaccgtgagcggcgacagcatcagcagcgtggaccactactggagctggatcagacagcaccccgtgaagggcctggagtggatcggcttcatgtactacagcgccagcacctactacaaccccagcctgaagagcagagtgaccatcagcaccgacaccagcaagaaccagttcagcctgagactgagcagcgtgaccgccgccgacaccgccgtgtactactgcgccagaggcacctgcgccggcgactgcagcctgcactactactactacggcctggacgtgtggggccagggcagaaccgtgaccgtgagcagc

SEQ ID NO: 35626 - RNA, 384 nt, synthetic construct
  misc_feature 1..384: note = derived and/or modified sequence opt4 from anti-influenza_Chain
  source 1..384: mol_type = other RNA
gaggtggccctggtggagagcggcgccgaggtgaagaagcccggcagcagcgtgaaggtgagctgcaaggccagcggccacatcttcagcggctacgccatcagctgggtgagacaggcccccggccagggcctggagtggatgggcggcatcatccccatcttcggcaccaccaactacgcccagaagttccagggcagagtgaccatcaccgccgaccagagcaccagcaccgcctacatggacctgagcaacctgagaagcgaggacaccgccgtgtactactgcgccagagtgaaggacggctactgcaccctgaccagctgccccgtgggctggtacttcgacctgtggggcagaggcaccctggtgaccgtgagcagc

SEQ ID NO: 35627 - RNA, 384 nt, synthetic construct
  misc_feature 1..384: note = derived and/or modified sequence opt4 from anti-influenza_Chain
  source 1..384: mol_type = other RNA
gaggtgcagctggtggagagcggcgccgaggtgaagaagcccggcagcagcgtgaaggtgagctgcaaggccagcggccacatcttcagcggctacgccatcagctgggtgagacaggcccccggccagggcctggagtggatgggcggcatcatccccatcttcggcaccaccaactacgcccagaagttccagggcagagtgaccatcaccgccgaccagagcaccagcaccgcctacatggacctgagcaacctgagaagcgaggacaccgccgtgtactactgcgccagagtgaaggacggctactgcaccctgaccagctgccccgtgggctggtacttcgacctgtggggcagaggcaccctggtgaccgtgagcagc

SEQ ID NO: 35628 - RNA, 384 nt, synthetic construct
  misc_feature 1..384: note = derived and/or modified sequence opt4 from anti-influenza_Chain
  source 1..384: mol_type = other RNA
caggtgcagctggtgcagagcggcgccgaggtgagaaagcccggcgccagcgtgaaggtgagctgcaaggccagcggctacaccttcaccagacacggcatcagctgggtgagacaggcccccggccagggcctggagtggatgggctggatcagcgcctacaccggcgacaccgactacgcccagaagttccagggcagagtgaccatgaccaccgacaccagcaccaacaccgcctacatggagctgagaagcctgagaagcgacgacgccgccgtgtactactgcgccagactgagactgcagggcgaggtggtggtgccccccagccagagcaactggttcgacccctggggccagggcaccctggtgaccgtgagcagc

SEQ ID NO: 35629 - RNA, 384 nt, synthetic construct
  misc_feature 1..384: note = derived and/or modified sequence opt4 from anti-influenza_Chain
  source 1..384: mol_type = other RNA
caggtgcagctggtggagagcggccccggcctgatgaagcccagcgagaccctgagcctgacctgcaccgtgagcggcggcagcgtgagcaactactactggagctggatcagacagccccccggcaagggcctggagtggatcggctacgtgttctacagcggcagcagcaactacaaccccagcctgaacaaccccagcctgaagagcagagtgaccatcagcatcgacaccagcaacaaccagttcagcctgaagctgagcagcgtgaccgccgccgacaccgccgtgtactactgcgccagaggcagagtgaacagcggctacgactggggccccaacttcgacagctggggccagggcgccctggtgaccgtgagcagc

SEQ ID NO: 35630 - RNA, 384 nt, synthetic construct
  misc_feature 1..384: note = derived and/or modified sequence opt4 from anti-influenza_Chain
  source 1..384: mol_type = other RNA
caggtgcagctggtgcagagcggcgccgaggtgaagaagcccggcagcagcgtgaaggtgagctgcaaggccagcggcggcaccttcagctactacgccatcagctgggtgagacaggcccccggccagggcctggagtggatgggcggcatcatccccatcgtgggcaccgcccactacacccagaagttccagggcagagtgaccatcaccgccgacgagagcaccagcaccgcctacatggagctgagcagcctgagaagcgaggacaccgccgtgtacttctgcgccagagccgccgacgagagcgtggagagcctgaccatcaaggccttcagaaccaactaccactggggccagggcaccctggtgaccgtgagcagc

SEQ ID NO: 35631 - RNA, 387 nt, synthetic construct
  misc_feature 1..387: note = derived and/or modified sequence opt4 from anti-influenza_Chain
  source 1..387: mol_type = other RNA
gaggtgcagctggtggagagcggcggcggcgccgtgcagcccggcgagagcctgaagctgccctgcgccgccagcggcttcaccttcagcaactacggcatgcactgggtgagacaggcccccggcaagggcctggagtgggtggccgtgatcagctacgacggcagcaacaagtactacgccgacagcgtgaagggcagattcaccatcagcagagacaacagcaaggacaccctgtacctgcagatgaacagcctgagagccgaggacaccgccctgttctactgcgccaaggagagacccctgagactgctgagatacttcgactggctgagcggcggcgccaacgactactggggccagggcaccctggtgaccgtgagcagc

SEQ ID NO: 35632 - RNA, 387 nt, synthetic construct
  misc_feature 1..387: note = derived and/or modified sequence opt4 from anti-influenza_Chain
  source 1..387: mol_type = other RNA
gaggtgcagctggtggagagcggcggcggcgccgtgcagcccggcgagagcctgaagctgagctgcgccgccagcggcttcaccttcagcaactacggcatgcactgggtgagacaggcccccggcaagggcctggagtgggtggccgtgatcagctacgacggcagcaacaagtactacgccgacagcgtgaagggcagattcaccatcagcagagacaacagcaaggacaccctgtacctgcagatgaacagcctgagagccgaggacaccgccctgttctactgcgccaaggagagacccctgagactgctgagatacttcgactggctgagcggcggcgccaacgactactggggccagggcaccctggtgaccgtgagcagc

SEQ ID NO: 35633 - RNA, 387 nt, synthetic construct
  misc_feature 1..387: note = derived and/or modified sequence opt4 from anti-influenza_Chain
  source 1..387: mol_type = other RNA
caggtgcagctggtggagagcggcggcggcgtggtgcagcccggcagaagcctgagactgagctgcgccgtgagcggcttcaccttcagcagctacgccatgcactgggtgagacaggcccccggcaagggcctggagtgggtggccgtgatcagctacgacggcagcaaccagtactacgccgacagcgtgaagggcagattcaccatcagcagagacaacagcaagaacaccctgtacctgcagatgaacagcctgagagccgaggacaccgccctgtactactgcgccaaggaccccagactgagacacctgctgtacttccccttcaccagcatgatctacttcgactactggggccagggcaccctggtgaccgtgagcagc

SEQ ID NO: 35634 - RNA, 387 nt, synthetic construct
  misc_feature 1..387: note = derived and/or modified sequence opt4 from anti-influenza_Chain
  source 1..387: mol_type = other RNA
caggtgcagctggtgcagagcggcggcggcgtggtgcagcccggcagaagcctgagactgagctgcgtggccagcggcttcaccttcagcacctacgccatgcactgggtgagacaggcccccggcagaggcctggagtgggtggccgtgatcagctacgacgccaactacaagtactacgccgacagcgtgaagggcagattcagcatcagcagagacaacagccagaacaccctgcacctggagatgaacaccctgagaaccgaggacaccgccctgtactactgcgccaaggacagccagctgagaagcctgctgtacttcgagtggctgagccagggctacttcgagccctggggccagggcaccctggtgaccgtgaccagc

SEQ ID NO: 35635 - RNA, 387 nt, synthetic construct
  misc_feature 1..387: note = derived and/or modified sequence opt4 from anti-influenza_Chain
  source 1..387: mol_type = other RNA
caggtgcagctggtgcagagcggcggcggcgtggtgcagcccggcagaagcctgagactgagctgcgtggccagcggcttcaccttcagcacctacgccatgcactgggtgagacaggcccccggcagaggcctggagtgggtggccgtgatcagctacgacggcaactacaagtactacgccgacagcgtgaagggcagattcagcatcagcagagacaacagcaacagcaccctgcacctggagatgaacaccctgagaaccgaggacaccgccctgtactactgcgccaaggacagccagctgagaagcctgctgtacttcgagtggctgagccagggctacttcgacccctggggccagggcaccctggtgaccgtgaccagc

SEQ ID NO: 35636 - RNA, 387 nt, synthetic construct
  misc_feature 1..387: note = derived and/or modified sequence opt4 from anti-influenza_Chain
  source 1..387: mol_type = other RNA
caggtgcagctggtgcagagcggcgccgaggtgaagaagcccggcagcagcgtgaccgtgagctgcaaggccagcggcggcaccttcagcaactacggcatcagctgggtgagacaggcccccggccagggcctggactggatgggcggcatcatccccctgttcggcaccgccaactacgcccagaagttccagggcagagtgaccatcaccgccgacgagagcaccagcagcagcaacatggagctgagcagcctgagaagcgaggacaccgccgtgtactactgcgccagagacgtgcacaactacgacttcctgaccggctaccccctgcacctgtacggcatggacgtgtggggccagggcaccaccgtgaccgtgagcagc

SEQ ID NO: 35637 - RNA, 387 nt, synthetic construct
  misc_feature 1..387: note = derived and/or modified sequence opt4 from anti-influenza_Chain
  source 1..387: mol_type = other RNA
caggtgcagctgcaggagagcggccccggcctggtgaagcccagcgagaccctgagcctgatctgcgccgtgagcggcgccagcatcagcagcagctactggagctggatcagacagccccccggcaagggcctggagtggatcggctacatctactacagcggcgtgaccaagtacaaccccagcctgaagagcagagtgaccctgagcgtggacaccagcaagaaccacttcagcctgaagctgagctacgtgaccgccgccgacaccgccgtgtactactgcgccagaaacctgcccgacatcgccgtggtgaccgccgtgcaggacgccacccccgtgtggttcgacccctggggccccggcaccctggtgagcgtgagcagc

SEQ ID NO: 35638 - RNA, 387 nt, synthetic construct
  misc_feature 1..387: note = derived and/or modified sequence opt4 from anti-influenza_Chain
  source 1..387: mol_type = other RNA
gaggtgcagctggtggagagcggcggcggcctggtgcagcccggcagaagcctgagactgagctgcgccgccagcggcttcaccttcagcgacttctggatgagctgggtgagacaggcccccggcaagggcctggagtgggtggccaacatcgaccaggacggcaacgagagattctacgccgacagcgtgaagggcagattcaccatcagcagagacaacgccaagaacagcctgtacctgcagatgaccagcctgagagccgacgacaccgccgtgtactactgcgccagagacggcagagagggctacttctacggcagcggcagcttctacaacctgaagggcctgaactggggccagggcaccctgctgaccgtgagcagc

SEQ ID NO: 35639 - RNA, 387 nt, synthetic construct
  misc_feature 1..387: note = derived and/or modified sequence opt4 from anti-influenza_Chain
  source 1..387: mol_type = other RNA
gaggtgctgatggtggagagcggcggcggcctggtgcagcccggcggcagcgtgagactgagctgcgtggccagcggcttcagcttcagcagccactggatgacctgggtgagacaggcccccggcaagggcctggagtgggtggccaacatcgaggacgacggcggcgacaagtactacgtggacagcgtgaagggcagattcatcatcagcagagacaacgccaagaacagcgtgtacctgcagatgaacagcctgagagccgaggacaccgccgtgtacttctgcgccagaggcagcggcagcagcgacagaagcgactacgacccccactactactactacctggacgtgtggggcaagggcgccaccgtgaccgtgagcagc

SEQ ID NO: 35640 - RNA, 387 nt, synthetic construct
  misc_feature 1..387: note = derived and/or modified sequence opt4 from anti-influenza_Chain
  source 1..387: mol_type = other RNA
gaggtgcagctggtggagagcggcggcgacctggtgcagcccggcagaagcctgaagctgagctgcaccggcagcggcttcaccttcggcgactacggcgtgacctgggtgagacaggcccccggcaagggcctggagtgggtgggcttcatcagaaccagaccctggggcggcaccgccgacaccgccgccagcgtgaagggcagattcaccatcagcagagacgacagcaagagcctggcctacctgcagatgaacagcctgaagaccgaggacaccgccgtgtactactgctgcagagacgccccccccaacgtggaggtggccagcatgaccaactggtacttcgacctgtggggcagaggcaccctggtgaccgtgagcagc

SEQ ID NO: 35641 - RNA, 387 nt, synthetic construct
  misc_feature 1..387: note = derived and/or modified sequence opt4 from anti-influenza_Chain
  source 1..387: mol_type = other RNA
gaggtgcagctggtgcagagcggcagcgaggtgaagaagcccggcgagagcctgaagatcagctgcaagggcagcggctacagcttcagcaactactggatcggctgggtgagacacatgcccggcaagggcctggagtggatgggcatcatctaccccggcgacagcgacaccagatacagccccagcttccagggccaggtgaccatgagcgccgacaagagcagcagcaccgtgtacctgcagtggagcagcctgaaggccagcgacaccgccatctactactgcgccagaagaggcggccacagcttcggctacggcagcggcggcgacacccacagcgagttcgacagctggggccagggcaccctggtgaccgtgagcagc

SEQ ID NO: 35642 - RNA, 387 nt, synthetic construct
  misc_feature 1..387: note = derived and/or modified sequence opt4 from anti-influenza_Chain
  source 1..387: mol_type = other RNA
caggtgcagctgctggagaccggcggcggcctggtgaagcccggccagagcctgaagctgagctgcgccgccagcggcttcaccttcaccagctacgccatgcactgggtgagacagccccccggcaagggcctggagtgggtggccgtggtgagctacgacggcaactacaagtactacgccgacagcgtgcagggcagattcaccatcagcagagacaacagcaagaacaccctgtacctgcagatgaacagcctgagagccgaggacaccgccgtgtactactgcgccaaggacagcagactgagaagcctgctgtacttcgagtggctgagccagggctacttcaacccctggggccagggcaccaccctgaccgtgagcagc

SEQ ID NO: 35643 - RNA, 387 nt, synthetic construct
  misc_feature 1..387: note = derived and/or modified sequence opt4 from anti-influenza_Chain
  source 1..387: mol_type = other RNA
caggtgcagctggtggagagcggcgccgaggtgaagaagcccggcgccagcgtgaagctgagctgcaccgccagcggctacaacttcgccgcctactacatccactgggtgagacaggcccccggccagggcctggagtggatgggctggagcaaccccaacaccggcggcgccaactacgcccaggacttccagggcagagtgaccatgaccgccgtgaccagcaccagcaccgcctacatggagctgagcagactgaccagcgacgacaccgccctgtacttctgcgccagagtgcccagagacagactgctgaccctgtactacgagagcagcacctacggcttcgactactggggccagggcaccctggtgaccgtgagcagc

SEQ ID NO: 35644 - RNA, 387 nt, synthetic construct
  misc_feature 1..387: note = derived and/or modified sequence opt4 from anti-influenza_Chain
  source 1..387: mol_type = other RNA
caggtgcagctggtggagagcggcggcggcctggtgcagcccggcggcagcctgagactgagctgcaccgtgagcggcttcaccttcaacagctacgccatgaactgggtgagacaggcccccggcaagggcctggagtgggtgagcggcatcagaggcagcggcgagaacacctactacgccgagaccgtgaagggcagattcaccatcagcagagacaacagcaagaacaccctgtacctggagatgaacagcctgagagccgaggacaccgccgtgtactactgcgccagaaagtggggcagaatgaccgtgttcggcgtggccaccgaccagctgtactacttcgactactggggccagggcaccctggtgaccgtgagcagc

SEQ ID NO: 35645 - RNA, 387 nt, synthetic construct
  misc_feature 1..387: note = derived and/or modified sequence opt4 from anti-influenza_Chain
  source 1..387: mol_type = other RNA
caggtgcagctggtggagagcggccccggcctggtgaagcccagccagaccctgagcctgacctgcaccgtgagcggcggcagcatcagcaacggcggctaccactggagctggatcagacagcaccccggcaagggcctggagtggatcggcaacatctactacagaggcagcaccttctacgaccccagcctgaagagcagagtgaccatcagcgtggacaccagcaagagccagttcagcctgaagctgaccagcgtgaccgccgccgacaccgccgtgtactactgcgccagaatgcccctggccaactacgacctgctgaccggcctgtacatcggcgccttcgacctgtggggccagggcaccatggtgaccgtgagcagc

SEQ ID NO: 35646 - RNA, 387 nt, synthetic construct
  misc_feature 1..387: note = derived and/or modified sequence opt4 from anti-influenza_Chain
  source 1..387: mol_type = other RNA
caggtgcagctggtggagagcggcgccgaggtgaagaagcccggcgccagcgtgagagtgagctgcaagggcagcggctacaccttcaccgcctaccacatgcactgggtgagacaggcccccggccagggcttcgagtgggtgggctggatcaaccccaacagcggcgccacctactacaccagcaccttcgagggcagagtgaccatgaccagagacaccagcatcaccaccgcctacatggagctgagcagcctgagaagcgacgacaccgccgtgtactactgcgccaccgacatcgtggtggagagagacgccagcctgggcggcttcaacagctacggcatggacgtgtggggccagggcaccaccgtgaccgtgagcagc

SEQ ID NO: 35647 - RNA, 390 nt, synthetic construct
  misc_feature 1..390: note = derived and/or modified sequence opt4 from anti-influenza_Chain
  source 1..390: mol_type = other RNA
caggtgcagctgcagcagtggggcgccggcctgctgaagcccagcgagaccctgagcctgacctgcgccgtgtacggcggcagcttcagcgtgagcggctactactggagctggatcagacagccccccggcagaggcctggagtggatcggcgagatcagccacggcggcagcaccaactacaaccccagcctgaagagcagagtgaccatcagcgtggacaccaccaagaaccagttcagcctgagactgagcagcgtgaccgccgccgacaccgccgtgtactactgcgccagaggcaccgaccccgacaccgaggtgtactgcagagtgggcaactgcgccgccttcgactactggggccagggcagcctggtgaccgtgagcagc

SEQ ID NO: 35648 - RNA, 390 nt, synthetic construct
  misc_feature 1..390: note = derived and/or modified sequence opt4 from anti-influenza_Chain
  source 1..390: mol_type = other RNA
caggtgcagctgctggagagcggccccggcctggtgaagcccagccagaccctgctgctgacctgcaccgtgagcggcgccagcatcagcaccggcggcaactactggagctggatcagacagcaccccggcaaggacctggagtggatcggctacatcttctacagcggcaccaccaagtacaaccccagcgtggacaaccccagcctgaagagcagagtgaccatgagcgtggacaccagcgagaaccagttcagcctgaagctgagcagcgtgaccgccgccgacaccgccgtgtacttctgcgccagaggcagccccaacagcggctacgactggggcccccacttcgactactggggccagggcaccctggtgaccgtgagcagc

SEQ ID NO: 35649 - RNA, 390 nt, synthetic construct
  misc_feature 1..390: note = derived and/or modified sequence opt4 from anti-influenza_Chain
  source 1..390: mol_type = other RNA
gaggtgcagctggtggagagcggcggccacctggtgcagcccggcagaagcctgagactgagctgcgccgccagcggcttcaccttcgaggactacgccatgaactgggtgagacaggcccccggcaagggcctggagtgggtgagcgtgatcagctgggacagcggcagaatcggctacgccgacagcgtgaagggcagattcaccatcagcagagacaacgccaagaacagcagctacctgcagatgaacagcctgagacccgaggacaccgccctgtactactgcgtgagagacatgctggcctactacagcgacaacagcggcaagaagtacaacgtgtacggcatggacgtgtggggccagggcaccaccgtgaccgtgagcagc

SEQ ID NO: 35650 - RNA, 390 nt, synthetic construct
  misc_feature 1..390: note = derived and/or modified sequence opt4 from anti-influenza_Chain
  source 1..390: mol_type = other RNA
gaggtgcagctggtggagagcggcggcggcctggtgcagcccggcagaagcctgagactgagctgcgccgtgagcggcttcatcttcgaggactacgccatcaactgggtgagacaggcccccggcaagggcctggagtgggtgagcatcatcagctgggacagcggcagaatcggctacgccgacagcgtgagaggcagattcaccatcagcagagacaacgccaagaacagcagcttcctgcagatgaacagcctgagacccgaggacaccgccgtgtactactgcgtgaaggacatgctggcctactactacgacggcagcggcatcagatacaacctgtacggcatggacgtgtggggccagggcaccaccgtgaccgtgagcagc

SEQ ID NO: 35651 - RNA, 390 nt, synthetic construct
  misc_feature 1..390: note = derived and/or modified sequence opt4 from anti-influenza_Chain
  source 1..390: mol_type = other RNA
gaggtgcagctggtggagagcggcggcggcctggtgcagcccggcagaagcctgagactgagctgcgccgtgagcggcttcatcttcgaggactacgccatcaactgggtgagacaggcccccggcaagtgcctggagtgggtgagcatcatcagctgggacagcggcagaatcggctacgccgacagcgtgagaggcagattcaccatcagcagagacaacgccaagaacagcagcttcctgcagatgaacagcctgagacccgaggacaccgccgtgtactactgcgtgaaggacatgctggcctactactacgacggcagcggcatcagatacaacctgtacggcatggacgtgtggggccagggcaccaccgtgaccgtgagcagc

SEQ ID NO: 35652 - RNA, 396 nt, synthetic construct
  misc_feature 1..396: note = derived and/or modified sequence opt4 from anti-influenza_Chain
  source 1..396: mol_type = other RNA
cagatcaccctgaaggagagcggccccaccctggtgaagcccacccagaccctgaccctgacctgcgtgttcagcggcttcagcctgagcatcaccggcgtgagagtgggctggatcagacagccccccggcaaggccctggagtggctggccctgatcagctgggacgacgagaagcactacagccccagcctgcagagcagactgaccatcaccaaggacaccagcaagaaccaggtggtgctgaccatgaccaacctggaccccgtggacaccgccacctactactgcgccagaagcaccgacagaggccacgtgctgagatacttcggctggatgctgcccggcgacgccttcgacgtgtggggccagggcaccatggtgaccgtgagcagc

SEQ ID NO: 35653 - RNA, 396 nt, synthetic construct
  misc_feature 1..396: note = derived and/or modified sequence opt4 from anti-influenza_Chain
  source 1..396: mol_type = other RNA
caggtgcagctgcaggagagcggccccggcctggtgaagcccagcgagaccctgagcctgacctgcaccgtgagcagcggccccatgagcgactactactggagctggatcagacagccccccggcaagggcctggagtggatcggccacgtgagcgtgagccacggcggcagaaccaagagcaaccccagcgtgatgagcagagtgaccatcagcgtggagaccagcaagaaccagttcagcctgaagctgaccagcgtgaccgccgccgacaccgccgtgtactactgcgccagactgaactactacgacagaagcggctaccacagccccgacggccccagcaacaactggttcgacccctggggccagggcaccctggtgaccgtgagcagc

SEQ ID NO: 35654 - RNA, 396 nt, synthetic construct
  misc_feature 1..396: note = derived and/or modified sequence opt4 from anti-influenza_Chain
  source 1..396: mol_type = other RNA
caggtgcagctggtgcagagcggcgccgaggtgaagaagcccggcgccagcgtgaaggtgagctgcaagaccagcggctacaccttcaccgcctacaccatccactgggtgagacaggcccccggccagagactggagtggatgggctggatcaacgccggcaacggccacaccaagtacagccagagattcaagggcagagtgaccatcaccagagacaccagcgccagaaccacctacatggagctgagaagcctgaccagcgaggacaccgccctgtacttctgcgccagaggccccgagacctactactacgacaagaccaactggctgaacagccaccccgacgagtacttccagcactggggccacggcacccaggtgaccgtgagcagc

SEQ ID NO: 35655 - RNA, 399 nt, synthetic construct
  misc_feature 1..399: note = derived and/or modified sequence opt4 from anti-influenza_Chain
  source 1..399: mol_type = other RNA
caggtgcagctggtgcagagcggcagcgaggtgaagaagcccggcgccagcgtgaaggtgagctgcaaggccagcggctacaccttcaccaactacgacatcaactggatcagacaggcccccggccagggcctggagtggatgggctggatcaaccccaacagcggcaccaccggcagcgcccagagattccagggcagagtgaccatcaccgtggacaccagcatcaccaccgtgtacatggagctgagcagcctgagaagcgacgacaccgccatctactactgcgccagaggcagagagctgctgagactgcagcacttcctgaccgacagccagagcgagagaagagactgcttcgacccctggggccagggcaccctggtgaccgtgagcagc

SEQ ID NO: 35656 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcctgagcttcctgaacgcctggatgagctgggtgagacaggcccccggcaagggcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggccagggcaccaccgtgaccgtgagcagc

SEQ ID NO: 35657 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcttcagcttcctgaacgcctggatgagctgggtgagacaggcccccggcaagggcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggccagggcaccaccgtgaccgtgagcagc

SEQ ID NO: 35658 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcctgaccttcctgaacgcctggatgagctgggtgagacaggcccccggcaagggcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggccagggcaccaccgtgaccgtgagcagc

SEQ ID NO: 35659 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcttcagcttcagcaacgcctggatgagctgggtgagacaggcccccggcaagggcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggccagggcaccaccgtgaccgtgagcagc

SEQ ID NO: 35660 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcctgaccttcagcaacgcctggatgagctgggtgagacaggcccccggcaagggcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggccagggcaccaccgtgaccgtgagcagc

SEQ ID NO: 35661 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcttcaccttcagcaacgcctggatgagctgggtgagacaggcccccggcaagggcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggccagggcaccaccgtgaccgtgagcagc

SEQ ID NO: 35662 - RNA, 402 nt, synthetic construct
  misc_feature 1..402: note = derived and/or modified sequence opt4 from anti-influenza_Chain
  source 1..402: mol_type = other RNA
gaggtgcagctggtggtgagcggcggcggcctggtgaagcccggcggcagcctgagactgagctgcgccgccagcggcctgagcttcctgaacgcctggatgagctgggtgagacaggcccccggcaagggcctggagtgggtgggcagaatcaagagcaacaccgacggcggcaccaccgactacgccgcccccgtgaagggcagattcagcatcagcagagacgacagcaagaacatgctgttcctgcacatgagcagcctgagaaccgaggacaccgccgtgtactactgcgccaccgacggcccctacagcgacgacttcagaagcggctacgccgccagatacagatacttcggcatggacgtgtggggccagggcaccaccgtgaccgtgagcagc

SEQ ID NO: 35663 - RNA, 402 nt, synthetic construct
  misc_feature 1..402: note = derived and/or modified sequence opt4 from anti-influenza_Chain
  source 1..402: mol_type = other RNA
gaggtgcagctggtggtgagcggcggcggcctggtgaagcccggcggcagcctgagactgagctgcgccgccagcggcctgagcttcctgaacgcctggatgagctgggtgagacaggcccccggcaagtgcctggagtgggtgggcagaatcaagagcaacaccgacggcggcaccaccgactacgccgcccccgtgaagggcagattcagcatcagcagagacgacagcaagaacatgctgttcctgcacatgagcagcctgagaaccgaggacaccgccgtgtactactgcgccaccgacggcccctacagcgacgacttcagaagcggctacgccgccagatacagatacttcggcatggacgtgtggggccagggcaccaccgtgaccgtgagcagc

SEQ ID NO: 35664 - RNA, 402 nt, synthetic construct
  misc_feature 1..402: note = derived and/or modified sequence opt4 from anti-influenza_Chain
  source 1..402: mol_type = other RNA
gaggtgcagctggtggtgagcggcggcggcctggtgaagcccggcggcagcctgagactgagctgcgccgccagcggcctgagcttcctgaacgcctggatgagctgggtgagacaggcccccggcaagggcctggagtgggtgggcagaatcaagagcaacaccgacggcggcaccaccgactacgccgcccccgtgaagggcagattcagcatcagcagagacgacagcaagaacatgctgttcctgcacatgagcagcctgagaaccgaggacaccgccgtgtactactgcgccaccgacggcccctacagcgacgacttcagaagcggctacgccgccagatacagatacttcggcatggacgtgtggggctgcggcaccaccgtgaccgtgagcagc

SEQ ID NO: 35665 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcttcaccttcctgaacgcctggatgagctgggtgagacaggcccccggcaagggcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggccagggcaccaccgtgaccgtgagcagc

SEQ ID NO: 35666 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcttcaccttcctgaacgcctggatgagctgggtgagacaggcccccggcaagtgcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggccagggcaccaccgtgaccgtgagcagc

SEQ ID NO: 35667 - RNA, 402 nt, synthetic construct
  misc_feature 1..402: note = derived and/or modified sequence opt4 from anti-influenza_Chain
  source 1..402: mol_type = other RNA
gaggtgcagctggtggagagcggcggcggcctggtgaagcccggcggcagcctgagactgagctgcgccgccagcggcttcaccttcctgaacgcctggatgagctgggtgagacaggcccccggcaagggcctggagtgggtgggcagaatcaagagcaacaccgacggcggcaccaccgactacgccgcccccgtgaagggcagattcaccatcagcagagacgacagcaagaacaccctgtacctgcagatgagcagcctgaagaccgaggacaccgccgtgtactactgcaccaccgacggcccctacagcgacgacttcagaagcggctacgccgccagatacagatacttcggcatggacgtgtggggctgcggcaccaccgtgaccgtgagcagc

SEQ ID NO: 35668 - RNA, 414 nt, synthetic construct
  misc_feature 1..414: note = derived and/or modified sequence opt4 from anti-influenza_Chain
  source 1..414: mol_type = other RNA
caggtgcagctgcaggagagcggcggcggcctggtgcagcccggcgagagcctgagactgagctgcgtgggcagcggcagcagcttcggcgagagcaccctgagctactacgccgtgagctgggtgagacaggcccccggcaagggcctggagtggctgagcatcatcaacgccggcggcggcgacatcgactacgccgacagcgtggagggcagattcaccatcagcagagacaacagcaaggagaccctgtacctgcagatgaccaacctgagagtggaggacaccggcgtgtactactgcgccaagcacatgagcatgcagcaggtggtgagcgccggctgggagagagccgacctggtgggcgacgccttcgacgtgtggggccagggcaccatggtgaccgtgagcagc

SEQ ID NO: 35669 - RNA, 465 nt, synthetic construct
  misc_feature 1..465: note = derived and/or modified sequence opt4 from anti-influenza_Chain
  source 1..465: mol_type = other RNA
ctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaag

SEQ ID NO: 35670 - RNA, 564 nt, synthetic construct
  misc_feature 1..564: note = derived and/or modified sequence opt4 from anti-influenza_Chain
  source 1..564: mol_type = other RNA
aacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaag

SEQ ID NO: 35671 - RNA, 609 nt, synthetic construct
  misc_feature 1..609: note = derived and/or modified sequence opt4 from anti-influenza_Chain
  source 1..609: mol_type = other RNA
atgctgagaagcctggtgctgaacgagaagctgagagccagagtgctggagagagccgaggagttcctgctgaacaacaaggccgacgaggaggtgtggttcagagagctggtgctgtgcatcctgaccagcaacagcagcttcatcagcgcctacaagagcatgaactacatcctggacaagatcctgtacatggacgagaaggagatcagcatcctgctgcaggagagcggctacagattctacaacctgaaggccaagtacctgtacagagccaagaacctgtacggcaaggtgaagaagaccatcaaggagatcgccgacaaggaccagatgcaggccagagagttcatcgccacccacatctacggcatcggctacaaggaggccagccacttcctgagaaacgtgggctacctggacctggccatcatcgacagacacatcctgagattcatcaacaacctgggcatccccatcaagctgaagagcaagagagagtacctgctggccgagagcctgctgagaagcatcgccaacaacctgaacgtgcaggtgggcctgctggacctgttcatcttcttcaagcagaccaacaccatcgtgaag

SEQ ID NO: 35672 - RNA, 615 nt, synthetic construct
  misc_feature 1..615: note = derived and/or modified sequence opt4 from anti-influenza_Chain
  source 1..615: mol_type = other RNA
ggcctgttcggcgccatcgccggcttcatcgagggcggctggaccggcatggtggacggctggtacggctaccaccaccagaacgagcagggcagcggctacgccgccgacctgaagagcacccagaacgccatcgacgagatcaccaacaaggtgaacagcgtgatcgagaagatgaacacccagttcaccgccgtgggcaaggagttcaaccacctggagaagagaatcgagaacctgaacaagaagatcgacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgcc

SEQ ID NO: 35673 - RNA, 639 nt, synthetic construct
  misc_feature 1..639: note = derived and/or modified sequence opt4 from anti-influenza_Chain
  source 1..639: mol_type = other RNA
gagatcgtgctgacccagagccccggcaccctgagcctgagccccggcgagagagccaccctgagctgcagagccagccagagagtgagcagctacctggcctggtaccagcagaagcccggccaggcccccagactgctgatctacggcgccagcaccagagccgccggcatccccgacagattcagcggcagcggcagcggcaccgacttcaccctgaccatcagcagactggagcccgaggacagcgccgtgtactactgccagcagtacggcagaacccccctgaccttcggcggcggcaccaaggtggagatcaagagagccgccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35674 - RNA, 639 nt, synthetic construct
  misc_feature 1..639: note = derived and/or modified sequence opt4 from anti-influenza_Chain
  source 1..639: mol_type = other RNA
gacatccagatgacccagagccccagcagcctgagcgccagcctgggcggcaacgtgaccatcacctgcaaggccagccaggacatcaacaagtacatcgcctggtaccagcacaagcccggcaagggccccagactggtgatccactacaccagcaccctgcagcccggcatccccagcagattcagcggcagcggcagcggcaccgactacagcttcagcatcagcaacctggagcccgaggacatcgccacctactactgcctgcagtacgacatcctgtacaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 35675 - RNA, 642 nt, synthetic construct
  misc_feature 1..642: note = derived and/or modified sequence opt4 from anti-influenza_Chain
  source 1..642: mol_type = other RNA
gacatccagatgacccagagccccagcagcctgagcgccagcgtgggcgacagagtgaccatcacctgcagagccagccagggcatcagcagctacctggcctggtaccagcagaagcccggcaaggtgcccaccctgctgatctacgacgccagcaccctgagaagcggcgtgcccagcagattcagcggcagcggcagcgccaccgacttcaccctgaccatcagcagcctgcagcccgaggacgtggccacctactactgccagagatacaacagcgccccccccatcaccttcggccagggcaccagactggagatcaagagagccgccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35676 - RNA, 642 nt, synthetic construct
  misc_feature 1..642: note = derived and/or modified sequence opt4 from anti-influenza_Chain
  source 1..642: mol_type = other RNA
gagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagccccagaaccttcggcggcggcaccaaggtggagatcaagagagccgccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35677 - RNA, 642 nt, synthetic construct
  misc_feature 1..642: note = derived and/or modified sequence opt4 from anti-influenza_Chain
  source 1..642: mol_type = other RNA
agctacgtgctgacccagccccccagcgtgagcgtggcccccggcgagaccgccaccgtgacctgcggcggcaacaacatcggcagcaagagcgtgcactggtaccagcagaagcccggccaggcccccgtggtggtgatctactacgacggcgacagacccagcggcatccccgagagattcagcggcagcaacagcggcgacaccgccaccctgaccatcagcagagtggaggccggcgacgaggccgactactactgcctggtgtgggactacaccagcgtgcactacgtgttcggcaccggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacggcagccccgtgaaggccggcgtggagaccaccaagcccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35678 - RNA, 642 nt, synthetic construct
  misc_feature 1..642: note = derived and/or modified sequence opt4 from anti-influenza_Chain
  source 1..642: mol_type = other RNA
gacatccagatgacccagaccagcagcagcctgagcgccagcctgggcgacagagtgaccatcagctgcagagccagccaggacatcagaaactacctgaactggtaccagcagaagcccgacggcaccgtgaagctgctgatctactacaccagcagactgcacagcggcgtgcccagcagattcagcgacagcggcagcggcaccgactacagcctgaccatcagcaacctggagcaggaggacctggccacctacttctgccagcagacctacaccctgccctggaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 35679 - RNA, 645 nt, synthetic construct
  misc_feature 1..645: note = derived and/or modified sequence opt4 from anti-influenza_Chain
  source 1..645: mol_type = other RNA
gacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaag

SEQ ID NO: 35680 - RNA, 645 nt, synthetic construct
  misc_feature 1..645: note = derived and/or modified sequence opt4 from anti-influenza_Chain
  source 1..645: mol_type = other RNA
gacatccagatgacccagagccccagcaccctgagcgccagcgtgggcgacagagtgaccatcacctgcagagccagccagaccatcaacaactacctggcctggtaccagcagaagcccggcaaggcccccaagctgctgatctacaaggccagcagcctggagagcggcgtgcccagcagattcagcggcagcggcagcggcaccgagttcaccctgaccatcagcagcctgcagcccgacgacttcgccacctactactgccaggagtacaacaacgacagccccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35681 - RNA, 645 nt, synthetic construct
  misc_feature 1..645: note = derived and/or modified sequence opt4 from anti-influenza_Chain
  source 1..645: mol_type = other RNA
agcgtgctgacccagccccccagcgccagcggcagcagaggccagagcatcaccatcagctgcaccggcagcaccagcgacatcggcagctacaactacgtgagctggtaccagcagcaccccggcaccgcccccaaggtgatcctgtacgaggtgagccagagacccagcggcgtgcccgacagattcagcggcagcaagagcggcaacaccgccttcctgaccgtgagcggcctgcaggccgaggacgaggccgactactactgcgccagctacgccggcaacaacatctacgtgttcggcagcggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 35682 - RNA, 645 nt, synthetic construct
  misc_feature 1..645: note = derived and/or modified sequence opt4 from anti-influenza_Chain
  source 1..645: mol_type = other RNA
agcgccctgacccagccccccagcgccagcggcagcagaggccagagcatcaccatcagctgcaccggcagcaccagcgacatcggcagctacaactacgtgagctggtaccagcagcaccccggcaccgcccccaaggtgatcctgtacgaggtgagccagagacccagcggcgtgcccgacagattcagcggcagcaagagcggcaacaccgccttcctgaccgtgagcggcctgcaggccgaggacgaggccgactactactgcgccagctacgccggcaacaacatctacgtgttcggcagcggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 35683 - RNA, 648 nt, synthetic construct
  misc_feature 1..648: note = derived and/or modified sequence opt4 from anti-influenza_Chain
  source 1..648: mol_type = other RNA
cagagcgtgctgacccagccccccagcgagagcgtgagccccggccagaccgccagcgtgacctgcagcggccacaagctgggcgacaagtacgtgagctggtaccagcagaagcccggccagagccccgtgctgctgatctaccaggacaacagaagacccagcggcatccccgagagattcatcggcagcaacagcggcaacaccgccaccctgaccatcagcggcacccaggccctggacgaggccgactactactgccaggcctgggacagcagcaccgccgtgttcggcggcggcaccaagctgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35684 - RNA, 648 nt, synthetic construct
  misc_feature 1..648: note = derived and/or modified sequence opt4 from anti-influenza_Chain
  source 1..648: mol_type = other RNA
cagagcgccctgacccagcccgccagcgtgagcggcagccccggccagagcatcaccatcagctgcaccggcaccagcagcgacgtgggcagctacaacctggtgagctggtaccagcagcaccccggcaaggcccccaagctgatgatctacgaggtgagcaagagacccagcggcgtgagcaacagattcagcggcagcaagagcggcaacaccgccagcctgaccatcagcggcctgcaggccgaggacgaggccgactactactgccacctgtacgtgggcagcagcaactgggtgttcggcggcggcaccaagctggccgtgctgggccagcccaaggccgcccccagcgtgaccctgttcccccccagcagcaaggagctgcaggccaacaaggccaccctggtgtgccccatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 35685 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccagagcgtggacagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35686 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccagagcgtgagccacaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactacccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35687 - RNA, 648 nt, synthetic construct
  misc_feature 1..648: note = derived and/or modified sequence opt4 from anti-influenza_Chain
  source 1..648: mol_type = other RNA
gagatcgtgatgacccagagccccgccaccctgagcgtgagccccggcgagagagccaccctgagctgcagagccagccagagcgtggacagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35688 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccagagcgtgagcagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35689 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccagagcgtggaccacaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35690 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccagagcgtgagccacaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactggccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35691 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccagagcgtgagccacaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaacttcccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35692 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccagagcgtggacagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaacttcccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35693 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccagagcgtggacagcaacctggcctggtaccagcagaagcccggccaggcccccagactgctggtgtacagcgccagcaccagagccaccggcatccccgccagattcagcggcagcggcagcggcaccgagttcaccctggccatcagcagcctgcagagcgaggacttcgccgtgtactactgccagcactacaccaactacccccccagactgaccttcggcggcggcagcaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35694 - RNA, 648 nt, synthetic construct
  misc_feature 1..648: note = derived and/or modified sequence opt4 from anti-influenza_Chain
  source 1..648: mol_type = other RNA
gagaccaccctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaactggccccccagactgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35695 - RNA, 648 nt, synthetic construct; identical to SEQ ID NO: 31576
  misc_feature 1..648: note = derived and/or modified sequence opt4 from anti-influenza_Chain
  source 1..648: mol_type = other RNA

SEQ ID NO: 35696 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagcccgaggacttcgccgtgtactactgccagcactacagcaactggccccccagactgaccttcggcggcggcaccaaggtggagatcaagagaaccgtggccgcccccagcgtgagcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35697 - RNA, 648 nt, synthetic construct
  misc_feature 1..648: note = derived and/or modified sequence opt4 from anti-influenza_Chain
  source 1..648: mol_type = other RNA
gagatcgtgatgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaactggccccccagactgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35698 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaacttcccccccagactgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35699 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagccaccctgagctgcagagccagccaggtgatcagccacaacctggcctggtaccagcagaagcccggccaggcccccagactgctgatctacggcgccagcaccagagccagcggcatccccgccagattcagcggcagcggcagcggcaccgactacaccctgaccatcaccagcctgcagagcgaggacttcgccgtgtactactgccagcactacagcaactacccccccagactgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35700 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccgccaccctgagcgtgagccccggcgagagagtgaccctgagctgcagagccagccagagcgtggccaacaacctggcctggtaccagcagaagcccggccagagccccagactgctgatctacggcgccagcaccagagacaccggcatccccgccagattcagcggcagcggcagcggcaccgagttcaccctgaccatcagcagcctgcagagcgaggacttcgccgtgtactactgccagcagtacaacaactggccccccatgtacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35701 - RNA, 648 nt, synthetic construct
  misc_feature 1..648: note = derived and/or modified sequence opt4 from anti-influenza_Chain
  source 1..648: mol_type = other RNA
gacatcgtgatgacccagagccccagcaccctgagcgccagcgtgggcgacagagtgaccatcacctgcagagccagccagagcatcggcaactggctggcctggtaccagcagaagcccggcaaggcccccaagctgctgatctacaaggtgagcaccctggagagcggcgtgcccagcagattcagcggcagcggcagcggcaccgagttcaccctgaccatcaacagcctgcagcccgacgacttcgccacctactactgccagagatacaccagcaacagccagggcttcaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35702 - RNA, 648 nt, synthetic construct
  misc_feature 1..648: note = derived and/or modified sequence opt4 from anti-influenza_Chain
  source 1..648: mol_type = other RNA
gacatccagctgacccagagccccctgagcccccccgtgaccctgggccagcccgccagcatcagctgcagaagcagccagagcctgctgtacaccgacggcttcacctacctgagctggtaccaccagagacccggccagagccccagaagactgatctacaagatcagcaacagagacagcggcgtgcccgacagattcagcggcagcggcagcggcaccgacttcaccctgaagatcagcagagtggaggccgaggacgtgggcgtgtactactgcatgcaggccacccactggcccctgaccttcggcgagggcaccaaggtggagatcaagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 35703 - RNA, 648 nt, synthetic construct
  misc_feature 1..648: note = derived and/or modified sequence opt4 from anti-influenza_Chain
  source 1..648: mol_type = other RNA
gagatcgtgctgacccagagccccggcaccctgagcctgagccccggcgagagagccaccctgagctgcagagccagccagagcgtgagaagcaacaacctggcctggtaccagcacaagcccggccaggcccccagactgctgatcttcggcgccagcagcagagccaccggcatccccgacagattcagcggcagcggcagcggcaccgacttcaccctgaccatcagcagactggagcccgaggacttcgccgtgtactactgccagcagtacggcagcagccccgccctgaccttcggcggcggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35704 - RNA, 648 nt, synthetic construct
  misc_feature 1..648: note = derived and/or modified sequence opt4 from anti-influenza_Chain
  source 1..648: mol_type = other RNA
cagagcgtgctgacccagccccccagcgccagcggcagcagaggccagagcatcaccatcagctgcaccggcagcaccagcgacatcggcagctacaactacgtgagctggtaccagcagcaccccggcaccgcccccaaggtgatcctgtacgaggtgagccagagacccagcggcgtgcccgacagattcagcggcagcaagagcggcaacaccgccttcctgaccgtgagcggcctgcagaccgacgacgaggccgactactactgcgccagctacgccggcaacaacatctacgtgttcggcagcggcaccaaggtgaccgtgctgggccagcccaaggccaaccccaccgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 35705 - RNA, 651 nt, synthetic construct
  misc_feature 1..651: note = derived and/or modified sequence opt4 from anti-influenza_Chain
  source 1..651: mol_type = other RNA
cagcccgtgctgacccagccccccagcgccagcggcagccccggccagagagtgaccatcagctgcagcggcagcagcagcaacatcggcagctacaccgtgaactggtaccagcagctgcccggcaccgcccccaagctgctgatctacagcctgaaccagagacccagcggcgtgcccgacagattcagcggcagcaagagcggcaccagcgccagcctggccatcagcggcctgcagagcgaggacgaggccgtgtactactgcgccgcctgggacgacagcctgagcgcccacgtggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35706 - RNA, 651 nt, synthetic construct
  misc_feature 1..651: note = derived and/or modified sequence opt4 from anti-influenza_Chain
  source 1..651: mol_type = other RNA
cagcccgtgctgacccagccccccagcgccagcggcacccccggccagagagtgaccatcagctgcagcggcagcagcagcaacatcggcagcaacaccgtgagctggtaccagcaggtgcccggcaccgcccccaagctgctgatctacggcaacaacgagagacccagcggcgtgcccgacagattcagcggcagcaagagcgccaccagcgccagcctggccatcagcggcctgcagagcgaggacgaggccgactactactgcgccgcctgggacgacagcctgaacggcttctgggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 35707 - RNA, 651 nt, synthetic construct
  misc_feature 1..651: note = derived and/or modified sequence opt4 from anti-influenza_Chain
  source 1..651: mol_type = other RNA
agctacgtgctgacccagccccccagcgtgagcggcacccccggccagagagtgatcatcagctgcagcggctacagcagcaacatcggcagcaacaccgtgaactggtaccagcagttccccggcaccgcccccagactgctgatctacgccaacaaccagagaccccccggcgtgcccgacagattcagcggcagcaagagcggcaccagcgccagcctggccatcagcggcctgcagagcgacgacgagagcgactactactgcgccgcctgggacgacagcctgaacggccactgggtgttcggcggcggcaccaagctgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35708 - RNA, 654 nt, synthetic construct
  misc_feature 1..654: note = derived and/or modified sequence opt4 from anti-influenza_Chain
  source 1..654: mol_type = other RNA
agctacgtgctgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccacgccgtgttcggcggcggcacccagctgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35709 - RNA, 654 nt, synthetic construct
  misc_feature 1..654: note = derived and/or modified sequence opt4 from anti-influenza_Chain
  source 1..654: mol_type = other RNA
cagagcgtggtgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccactacgtgttcggcaccggcaccaaggtgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35710 - RNA, 654 nt, synthetic construct
  misc_feature 1..654: note = derived and/or modified sequence opt4 from anti-influenza_Chain
  source 1..654: mol_type = other RNA
ctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctg

SEQ ID NO: 35711 - RNA, 657 nt, synthetic construct
  misc_feature 1..657: note = derived and/or modified sequence opt4 from anti-influenza_Chain
  source 1..657: mol_type = other RNA
agcagcgagctgacccagccccccagcgccagcggcacccccggccagagagtgaccatcagctgcagcggcagcaccagcaacatcggctacaaccccgtgagctggtaccagcaggtgcccggcaccgcccccaagctgctgatctacagcaacaccgagagacccagcggcgtgcccgacagattcagcggcagcaagagcggcaccagcgccagcctggccatcagcggcctgcagagcgaggacgaggccgactactactgcgccgcctgggacgacaccctgaacggccccgtgttcggcggcggcaccaaggtgaccgtgctgggccagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35712 - RNA, 657 nt, synthetic construct; identical to SEQ ID NO: 31592
  misc_feature 1..657: note = derived and/or modified sequence opt4 from anti-influenza_Chain
  source 1..657: mol_type = other RNA

SEQ ID NO: 35713 - RNA, 660 nt, synthetic construct
  misc_feature 1..660: note = derived and/or modified sequence opt4 from anti-influenza_Chain
  source 1..660: mol_type = other RNA
agctacgtgctgacccagccccccagcgccagcggcacccccggccagagagtgaccatcagctgcagcggcagcaccttcaacatcggcagcaacgccgtggactggtacagacagctgcccggcaccgcccccaagctgctgatctacagcaacaaccagagacccagcggcgtgcccgacagattcagcggcagcagaagcggcaccagcgccagcctggccatcagcggcctgcagagcgaggacgaggccgactactactgcgccgcctgggacgacatcctgaacgtgcccgtgttcggcggcggcaccaagctgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35714 - RNA, 660 nt, synthetic construct
  misc_feature 1..660: note = derived and/or modified sequence opt4 from anti-influenza_Chain
  source 1..660: mol_type = other RNA
cagagcgccctgacccagcccgccgccgtgagcggcagccccggccagagcatcaccatcagctgcaccggcaccagcagcgacgtgggcggctacaactacgtgagctggtaccagcagcaccccggcaaggcccccaagctgatgatctacgaggtgagcaacagacccagcggcgtgagcaacagattcagcggcagcaagagcggcaacaccgccagcctgaccatcagcggcctgcaggccgaggacgaggccgactactactgcagcagctacaccagcagcagcacctacgtgttcggcaccggcaccaaggtgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35715 - RNA, 660 nt, synthetic construct
  misc_feature 1..660: note = derived and/or modified sequence opt4 from anti-influenza_Chain
  source 1..660: mol_type = other RNA
agctacgtgctgacccagccccccagcgtgagcggcacccccggccagagagtgaccatcagctgcagcggcagcagaagcaacgtgggcgacaacagcgtgtactggtaccagcacgtgcccgagatggcccccaagctgctggtgtacaagaacacccagagacccagcggcgtgcccgccagattcagcggcagcaagagcggcaccagcgccagcctggccatcatcggcctgcagagcggcgacgaggccgactactactgcgtggcctgggacgacagcgtggacggctacgtgttcggcagcggcaccaaggtgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35716 - RNA, 660 nt, synthetic construct
  misc_feature 1..660: note = derived and/or modified sequence opt4 from anti-influenza_Chain
  source 1..660: mol_type = other RNA
agctacgtgctgacccagccccccagcgccagcggcacccccggccagagagtgaccatcagctgcagcggcagcagcagcaacatcggcagcaactacgtgtactggtaccagcagctgcccggcaccgcccccaagctgctgatctacagagacggccagagacccagcggcgtgcccgacagattcagcggcagcaagagcggcaccagcgccagcctggccatcagcggcctgagaagcgacgacgaggccgactactactgcgccacctgggacgacaacctgagcggccccgtgttcggcggcggcaccaagctgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35717 - RNA, 660 nt, synthetic construct
  misc_feature 1..660: note = derived and/or modified sequence opt4 from anti-influenza_Chain
  source 1..660: mol_type = other RNA
cagagcgccctgacccagcccgccagcgtgagcggcagccccggccagagcatcaccatcagctgcaccggcaccagcagcgacgtgggcggctacaactacgtgagctggtaccagcagcaccccggcaaggcccccaagctgatgatctacgaggtgagcaacagacccagcggcgtgagcaacagattcagcggcagcaagagcggcaacaccgccagcctgaccatcagcggcctgcaggccgaggacgaggccgactactactgcagcagctacaccagcagcagcaccctggtgttcggcaccggcaccaaggtgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35718 - RNA, 660 nt, synthetic construct
  misc_feature 1..660: note = derived and/or modified sequence opt4 from anti-influenza_Chain
  source 1..660: mol_type = other RNA
accgtgctgacccagccccccagcgtgagcggcgcccccggccagagagtgaccatcagctgcaccggcagcagcagcaacatcggcgccggctacgacgtgcactggtaccagcagctgcccggcaccgcccccaagctgctgatctacggcaacagcaacagacccagcggcgtgcccgacagattcagcggcagcaagagcggcaccagcgccaccctgggcatcaccggcctgcagaccggcgacgaggccgactactactgcggcacctgggacagcagcctgagcgcctacgtgttcggcaccggcaccaaggtgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35719 - RNA, 663 nt, synthetic construct
  misc_feature 1..663: note = derived and/or modified sequence opt4 from anti-influenza_Chain
  source 1..663: mol_type = other RNA
cagagcgtgctgacccagccccccagcgtgagcgccgcccccggccagaaggtgaccatcagctgcagcggcagcagcagcaacatcggcaacgactacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccaactactactgcgccacctgggacagaagacccaccgcctacgtggtgttcggcggcggcaccaagctgaccgtgctgggcgccgccgccggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35720 - RNA, 675 nt, synthetic construct
  misc_feature 1..675: note = derived and/or modified sequence opt4 from anti-influenza_Chain
  source 1..675: mol_type = other RNA
atggtgggcttcacccccgtggccctggccgccctggccgccaccggcgccctggccttccccgccggcaacgccaccgagctggagaagagacagaccacccccaacagcgagggctggcacgacggctactactacagctggtggagcgacggcggcgcccaggccacctacaccaacctggagggcggcacctacgagatcagctggggcgacggcggcaacctggtgggcggcaagggctggaaccccggcctgaacgccagagccatccacttcgagggcgtgtaccagcccaacggcaacagctacctggccgtgtacggctggaccagaaaccccctggtggagtactacatcgtggagaacttcggcacctacgaccccagcagcggcgccaccgacctgggcaccgtggagtgcgacggcagcatctacagactgggcaagaccaccagagtgaacgcccccagcatcgacggcacccagaccttcgaccagtactggagcgtgagacaggacaagagaaccagcggcaccgtgcagaccggctgccacttcgacgcctgggccagagccggcctgaacgtgaacggcgaccactactaccagatcgtggccaccgagggctacttcagcagcggctacgccagaatcaccgtggccgacgtgggc

SEQ ID NO: 35721 - RNA, 687 nt, synthetic construct
  misc_feature 1..687: note = derived and/or modified sequence opt4 from anti-influenza_Chain
  source 1..687: mol_type = other RNA
agaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35722 - RNA, 696 nt, synthetic construct
  misc_feature 1..696: note = derived and/or modified sequence opt4 from anti-influenza_Chain
  source 1..696: mol_type = other RNA
cacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaag

SEQ ID NO: 35723 - RNA, 699 nt, synthetic construct
  misc_feature 1..699: note = derived and/or modified sequence opt4 from anti-influenza_Chain
  source 1..699: mol_type = other RNA
atgagacccagcatccagttcctgggcctgctgctgttctggctgcacggcggccagtgcgacatccagatgacccagagccccagcagcctgagcgccagcctgggcggcaacgtgaccatcacctgcaaggccagccaggacatcaacaagtacatcgcctggtaccagcacaagcccggcaagggccccagactggtgatccactacaccagcaccctgcagcccggcatccccagcagattcagcggcagcggcagcggcaccgactacagcttcagcatcagcaacctggagcccgaggacatcgccacctactactgcctgcagtacgacatcctgtacaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 35724 - RNA, 702 nt, synthetic construct
  misc_feature 1..702: note = derived and/or modified sequence opt4 from anti-influenza_Chain
  source 1..702: mol_type = other RNA
atgatgagcagcgcccagttcctgggcctgctgctgctgtgcttccagggcaccagatgcgacatccagatgacccagaccagcagcagcctgagcgccagcctgggcgacagagtgaccatcagctgcagagccagccaggacatcagaaactacctgaactggtaccagcagaagcccgacggcaccgtgaagctgctgatctactacaccagcagactgcacagcggcgtgcccagcagattcagcgacagcggcagcggcaccgactacagcctgaccatcagcaacctggagcaggaggacctggccacctacttctgccagcagacctacaccctgccctggaccttcggcggcggcaccaagctggagatcaagagagccgacgccgcccccaccgtgagcatcttcccccccagcagcgagcagctgaccagcggcggcgccagcgtggtgtgcttcctgaacaacttctaccccaaggacatcaacgtgaagtggaagatcgacggcagcgagagacagaacggcgtgctgaacagctggaccgaccaggacagcaaggacagcacctacagcatgagcagcaccctgaccctgaccaaggacgagtacgagagacacaacagctacacctgcgaggccacccacaagaccagcaccagccccatcgtgaagagcttcaacagaaacgagtgc

SEQ ID NO: 35725 - RNA, 702 nt, synthetic construct
  misc_feature 1..702: note = derived and/or modified sequence opt4 from anti-influenza_Chain
  source 1..702: mol_type = other RNA
atggaggcccccgcccagctgctgttcctgctgctgctgtggctgcccgacaccaccggcgagatcgtgctgacccagagccccgccaccctgagcctgagccccggcgagagagccaccctgagctgcagagccagcgagaacatctggaacaacctggcctggtaccagcagaagcccggccaggcccccagactgctgatcagcggcgccagcaccggcgccaccggcgtgcccagcagattcagaggcagcggcagcagaaccgagttcaccctgaccatcagcagcctgcagagcgaggacttcgccatctacttctgccagcagtacaacagctggcccagaaccttcggccccggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35726 - RNA, 705 nt, synthetic construct
  misc_feature 1..705: note = derived and/or modified sequence opt4 from anti-influenza_Chain
  source 1..705: mol_type = other RNA
atggagacccccgcccagctgctgttcctgctgctgctgtggctgcccgacaccaccggcgagatcgtgctgacccagagccccggcaccctgagcctgagccccggcgagagagccaccctgagctgcagagccagccagagcctgagcagcagcagcctggtgtggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcaacagcccctacaccttcggccagggcacccaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35727 - RNA, 705 nt, synthetic construct
  misc_feature 1..705: note = derived and/or modified sequence opt4 from anti-influenza_Chain
  source 1..705: mol_type = other RNA
atggagacccccgcccagctgctgttcctgctgctgctgtggctgcccgacaccaccggcgagaccgtgctgacccagagccccggcaccctgagcctgagccccggcgagagagccaccctgagctgcagagccagccagagcgtgagcatcagctacctggcctggtaccagagaaagcccggccaggcccccagactgctgatctacggcgccagcagaagagccaccggcatccccgacagattcagcggcagcggcagcggcaccgacttcaccctgaccatcagcagactggagcccgaggacttcgccgtgtactactgccagcagtacggcagcagcccctacaccttcggccagggcaccaagctggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 35728 - RNA, 705 nt, synthetic construct
  misc_feature 1..705: note = derived and/or modified sequence opt4 from anti-influenza_Chain
  source 1..705: mol_type = other RNA
atggcctggatgatgctgctgctgaccctgctgatccactgcaccggcagctgggcccagagcgtgctgacccagccccccagcgtgagcgccgcccccggccagaaggtgaccatcagctgcagcggcagcagcagcaacatcggcaagaactacgtgagctggtaccagcagctgcccggcaccgcccccaagctgctgatctacgacaacgacaagagacccagcggcatccccgacagattcagcggcagcaagagcggcaccagcgccaccctgggcatcaccggcctgcagaccggcgacgaggccgactaccactgcggcgcctgggacagcagcctgaacggcggcgtgttcggcggcggcaccaaggtgaccgtgctgggccagcccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 35729 - RNA, 714 nt, synthetic construct
  misc_feature 1..714: note = derived and/or modified sequence opt4 from anti-influenza_Chain
  source 1..714: mol_type = other RNA
atgatgaagaagaagagctggttcaccctgatgatcaccggcgtgatcagcctgttcttcagcgtgagcgccttcgccggcaacgtgttctgggagcccctgagctacttcaacagcagcacctggcagaaggccgacggctacagcaacggccagatgttcaactgcacctggagagccaacaacgtgaacttcaccaacgacggcaagctgaagctgagcctgaccagccccgccaacaacaagttcgactgcggcgagtacagaagcaccaacaactacggctacggcctgtacgaggtgagcatgaagcccgccaagaacaccggcatcgtgagcagcttcttcacctacaccggccccagccacggcacccagtgggacgagatcgacatcgagttcctgggcaaggacaccaccaaggtgcagttcaactactacaccaacggcgtgggcggccacgagaagatcatcaacctgggcttcgacgccagcaccagcttccacacctacgccttcgactggcagcccggctacatcaagtggtacgtggacggcgtgctgaagcacaccgccaccaccaacatccccagcacccccggcaagatcatgatgaacctgtggaacggcaccggcgtggacagctggctgggcagctacaacggcgccaaccccctgtacgccgagtacgactgggtgaagtacaccagcaac

SEQ ID NO: 35730 - RNA, 729 nt, synthetic construct
  misc_feature 1..729: note = derived and/or modified sequence opt4 from anti-influenza_Chain
  source 1..729: mol_type = other RNA
caggtgcagctggtgcagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcatgggcatgttcggcaccaccaactacgcccagaagttccagggcagagtgaccatcaccgccgacgagttcaccagcgccgcctacatggagctgagaagcctgagaagcgaggacaccgccgtgtactactgcgccagaagcagcggctactaccccgagtacttccaggactggggccagggcaccctggtgaccgtgagcagcggcaccggcggcagcggcggcaccggcagcggcaccggcggcagcacccagagcgtgctgacccagccccccagcgagagcgtgagccccggccagaccgccagcgtgacctgcagcggccacaagctgggcgacaagtacgtgagctggtaccagcagaagcccggccagagccccgtgctgctgatctaccaggacaacagaagacccagcggcatccccgagagattcatcggcagcaacagcggcaacaccgccaccctgaccatcagcggcacccaggccctggacgaggccgactactactgccaggcctgggacagcagcaccgccgtgttcggcggcggcaccaagctgaccgtgctgggc

SEQ ID NO: 35731 - RNA, 729 nt, synthetic construct
  misc_feature 1..729: note = derived and/or modified sequence opt4 from anti-influenza_Chain
  source 1..729: mol_type = other RNA
caggtgcagctggtgcagagcggcgccgaggtgaagaagcccggcagcagcgtgaaggtgagctgcaaggccagcggcggccccttcagaaacttcgccatcaactgggtgagacaggcccccggccagggcctggagtggatgggcggcatcatcgccgtgttcggcaccaccaagtacgcccacaagttccagggcagagtgaccatcaccgccgacgacagcaccaacaccgcctacatggagctgggcagcctgaagagcgaggacaccgccgtgtactactgcgccagaggcccccactactacagcagctacatggacgtgtggggcgagggcaccaccgtgaccgtgagcagcggcaccggcggcagcggcggcaccggcagcggcaccggcggcagcaccgacatccagctgacccagagccccagcagcctgagcgccagcgtgggcgacagagtgaccatcacctgcagagccagccagggcatcagcacctacctggcctggtaccagcagaagcccggcaaggtgcccaagctgctgatctacgccgccagcaccctgcagagcggcgtgcccagcagattcagcggcagcggcagcggcaccgacttcaccctgaccatcagcagcctgcagcccgaggacgtggccacctactactgccagaagtacaacagcgcccccagcttcggccccggcaccaaggtggacatcaagaga

SEQ ID NO: 35732 - RNA, 729 nt, synthetic construct
  misc_feature 1..729: note = derived and/or modified sequence opt4 from anti-influenza_Chain
  source 1..729: mol_type = other RNA
atgagctacagagtgaagagaatgctgatgctgctggtgaccggcctgttcctgagcctgagcaccttcgccgccagcgccagcgcccagaccggcggcagcttctacgagcccttcaacaactacaacaccggcctgtggcagaaggccgacggctacagcaacggcaacatgttcaactgcacctggagagccaacaacgtgagcatgaccagcctgggcgagatgagactgagcctgaccagccccagctacaacaagttcgactgcggcgagaacagaagcgtgcagacctacggctacggcctgtacgaggtgaacatgaagcccgccaagaacgtgggcatcgtgagcagcttcttcacctacaccggccccaccgacggcaccccctgggacgagatcgacatcgagttcctgggcaaggacaccaccaaggtgcagttcaactactacaccaacggcgtgggcaaccacgagaagatcgtgaacctgggcttcgacgccgccaacagctaccacacctacgccttcgactggcagcccaacagcatcaagtggtacgtggacggccagctgaagcacaccgccaccacccagatcccccagacccccggcaagatcatgatgaacctgtggaacggcgccggcgtggacgagtggctgggcagctacaacggcgtgacccccctgagcagaagcctgcactgggtgagatacaccaagaga

SEQ ID NO: 35733 - RNA, 735 nt, synthetic construct
  misc_feature 1..735: note = derived and/or modified sequence opt4 from anti-influenza_Chain
  source 1..735: mol_type = other RNA
caggtgcagctgcagcagagcggcgccgaggtgaagaagcccggcagcagcgtgaaggtgagctgcaaggtgagcggcgtgatcttcagcggcagcgccatcagctgggtgagacaggcccccggccagggcctggagtggatgggcggcatcagccccctgttcggcaccaccaactacgcccagaagttccagggcagagtgaccatcaccgccgaccagagcaccaacaccacctacatggaggtgaacagcctgagatacgaggacaccgccgtgtacttctgcgccagaggccccaagtactacagcgagtacatggacgtgtggggcaagggcaccaccgtgaccgtgagcagcggcaccggcggcagcggcggcaccggcagcggcaccggcggcagcaccgacatccagatgacccagagccccagcagcctgagcgccagcgtgggcgacagagtgaccatcacctgcagagccagccagggcatcagcagctacctggcctggtaccagcagaagcccggcaaggtgcccaccctgctgatctacgacgccagcaccctgagaagcggcgtgcccagcagattcagcggcagcggcagcgccaccgacttcaccctgaccatcagcagcctgcagcccgaggacgtggccacctactactgccagagatacaacagcgccccccccatcaccttcggccagggcaccagactggagatcaagaga

SEQ ID NO: 35734 - RNA, 735 nt, synthetic construct
  misc_feature 1..735: note = derived and/or modified sequence opt4 from anti-influenza_Chain
  source 1..735: mol_type = other RNA
gaggtgcagctggtggagagcggcgccgaggtgaagaagcccggcagcagcgtgaaggtgagctgcaaggccagcggcggcaccttcagcagctacggcatcagctgggtgagacaggcccccggccagggcctggagtggatgggcgacatcatcggcatgttcggcagcaccaactacgcccagaacttccagggcagactgaccatcaccgccgacgagagcaccagcaccgcctacatggagctgagcagcctgagaagcgaggacaccgccgtgtactactgcgccagaagcagcggctactaccccgcctacctgccccactggggccagggcaccctggtgaccgtgagcagcggcaccggcggcagcggcggcaccggcagcggcaccggcggcagcaccgagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacggcagcagccccagaaccttcggcggcggcaccaaggtggagatcaagaga

SEQ ID NO: 35735 - RNA, 735 nt, synthetic construct
  misc_feature 1..735: note = derived and/or modified sequence opt4 from anti-influenza_Chain
  source 1..735: mol_type = other RNA
gaggtgcagctggtggagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcatcggcatgttcggcaccgccaactacgcccagaagttccagggcagagtgaccatcaccgccgacgagttcaccagcaccgcctacatggagctgagcagcctgagaagcgaggacaccgccgtgtactactgcgccagaggcaactactactacgagagcagcctggactactggggccagggcaccctggtgaccgtgagcagcggcaccggcggcagcggcggcaccggcagcggcaccggcggcagcacccagagcgtggtgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccactacgtgttcggcaccggcaccaaggtgaccgtgctgggc

SEQ ID NO: 35736 - RNA, 735 nt, synthetic construct
  misc_feature 1..735: note = derived and/or modified sequence opt4 from anti-influenza_Chain
  source 1..735: mol_type = other RNA
gaggtgcagctggtgcagagcggcgccgaggtgaagaagcccggcgccagcgtgaaggtgagctgcaaggccagcggctacaccttcaccggctactacgtgtactgggtgagacaggcccccggccagggcctggagtggatgggctggatcagcgcctacaacggcaacaccaactacgcccagaagttccagggcagagtgaccatcaccgccgacaagagcaccagcaccgcctacatggagctgagcagcctgagaagcgaggacaccgccgtgtactactgcgccagaagcagaagcctggacgtgtggggccagggcaccaccgtgaccgtgagcagcggcaccggcggcagcggcggcaccggcagcggcaccggcggcagcaccgacgtggtgatgacccagagccccgacagcctggccgtgagcctgggcgagagagccaccatcaactgcaagagcagccagagcgtgctgtacagcagcaacaacaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagtactacagcacccccctgaccttcggcggcggcaccaaggtggacatcaagaga

SEQ ID NO: 35737 - RNA, 735 nt, synthetic construct
  misc_feature 1..735: note = derived and/or modified sequence opt4 from anti-influenza_Chain
  source 1..735: mol_type = other RNA
gaggtgcagctggtggagaccggcgccgaggtgaagaagcccggcagcagcgtgaaggtgccctgcaagagcagcggcagccccttcagaagcaacgccgtgagctgggtgagacaggcccccggccagggcctggagtgggtgggcggcatcctgggcgtgttcggcagccccagctacgcccagaagttccagggcagagtgaccatcaccgccgacgagagcaccaacaccgtgcacatggagctgagaggcctgagaagcgaggacaccgccgtgtactactgcgccagaggccccacctactactacagctacatggacgtgtggggcaagggcaccaccgtgaccgtgagcagcggcaccggcggcagcggcggcaccggcagcggcaccggcggcagcaccagctacgtgctgacccagccccccagcgagagcgtggcccccggccagaccgccagaatcacctgcggcggcaacaacatcggcagaaacagcgtgcactggtaccagcagaagcccggccaggcccccgtgctggtggtgtacgacgacagcgacagacccagcggcatccccgagagattcagcggcagcaagagcggcaacaccgccaccctgatcatcagcagagtggaggtgggcgacgaggccgactactactgccaggtgtggcacagcagcagcgaccactacgtgttcggcaccggcaccaaggtgaccgtgctgggc

SEQ ID NO: 35738 - RNA, 735 nt, synthetic construct
  misc_feature 1..735: note = derived and/or modified sequence opt4 from anti-influenza_Chain
  source 1..735: mol_type = other RNA
cagatgcagctggtgcagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcttcggcatgttcggcaccgccaactacgcccagaagttccagggcagagtgaccatcaccgccgacgagttcaccagcgccgcctacatggagctgagcagcctgggcagcgaggacaccgccatgtactactgcgccagaagcagcggctactacccccagtacttccaggactggggccagggcaccctggtgaccgtgagcagcggcaccggcggcagcggcggcaccggcagcggcaccggcggcagcaccgagatcgtgatgacccagagccccggcaccctgagcctgagccccggccagagagccaccctgagctgcagagccagccagagcgtgagcagcagctacctggcctggtaccagcagaagcccggccaggcccccagactgctgatgtacggcgccagcagcagagccaccggcatccccgacagattcagcggcagcggcagcggcaccgacttcaccctgaccatcagcagactggagcccgaggacttcgccgtgtactactgccagcagtacggcagcagcagcctgaccttcggcggcggcaccaagctggagatcaagaga

SEQ ID NO: 35739 - RNA, 735 nt, synthetic construct
  misc_feature 1..735: note = derived and/or modified sequence opt4 from anti-influenza_Chain
  source 1..735: mol_type = other RNA
caggtgcagctggtgcagagcggcgccgaggtgaagaagcccggcagcagcgtgaaggtgagctgcaaggccagcggcgtgaccttcagctactacgccatgagctgggtgagacaggcccccggccagggcctggagtggatgggcggcatcagccccatgttcggcaccaccacctacgcccagaagttccagggcagagtgaccatcaccgccgacgacagcaccagcaccgcctacatggaggtgagaagcctgagaagcgaggacaccgccgtgtactactgcgccagaagcagcaactactacgacagcgtgtacgactactggggccagggcaccctggtgaccgtgagcagcggcaccggcggcagcggcggcaccggcagcggcaccggcggcagcacccagagcgtggtgacccagccccccagcgagagcgtggcccccggccagaccgccagaatcacctgcggcggccacaacatcggcagcaacagcgtgcactggtaccagcagaagcccggccaggcccccgtgctggtggtgtacgacaacagcgacagacccagcggcatccccgagagattcagcggcagcaacagcggcaacaccgccaccctgaccatcagcagagtggaggccggcgacgaggccgactactactgccaggtgtggggcagcagcagcgaccactacgtgttcggcaccggcaccaaggtgaccgtgctgggc

SEQ ID NO: 35740 - RNA, 738 nt, synthetic construct
  misc_feature 1..738: note = derived and/or modified sequence opt4 from anti-influenza_Chain
  source 1..738: mol_type = other RNA
caggtgcagctggtgcagagcggcggcggcctggtgaagcccggcggcagcctgagactgagctgcgccgccagcggcttcaccttcagcagctacagcatgaactgggtgagacaggcccccggcaagggcctggagtgggtgagcagcatcagcagcagcagcagctacatctactacgtggacagcgtgaagggcagattcaccatcagcagagacaacgccaagaacagcctgtacctgcagatgaacagcctgagagccgaggacaccgccgtgtactactgcgccagaggcggcggcagctacggcgcctacgagggcttcgactactggggccagggcaccctggtgaccgtgagcagcggcaccggcggcagcggcggcaccggcagcggcaccggcggcagcaccgagatcgtgctgacccagagccccggcaccctgagcctgagccccggcgagagagccaccctgagctgcagagccagccagagagtgagcagctacctggcctggtaccagcagaagcccggccaggcccccagactgctgatctacggcgccagcaccagagccgccggcatccccgacagattcagcggcagcggcagcggcaccgacttcaccctgaccatcagcagactggagcccgaggacagcgccgtgtactactgccagcagtacggcagaacccccctgaccttcggcggcggcaccaaggtggagatcaagaga

SEQ ID NO: 35741 - RNA, 738 nt, synthetic construct
  misc_feature 1..738: note = derived and/or modified sequence opt4 from anti-influenza_Chain
  source 1..738: mol_type = other RNA
gaggtgcagctggtggagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcggcaccggcggcagcggcggcaccggcagcggcaccggcggcagcaccagctacgtgctgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccacgccgtgttcggcggcggcacccagctgaccgtgctgggc

SEQ ID NO: 35742 - RNA, 738 nt, synthetic construct
  misc_feature 1..738: note = derived and/or modified sequence opt4 from anti-influenza_Chain
  source 1..738: mol_type = other RNA
gaggtgcagctggtggagaccggcgccgaggtgaagaagcccggcgccagcgtgaaggtgagctgcaaggccagcggctacaccttcaccagctactacatgcactgggtgagacaggcccccggccagggcctggagtggatgggctggatcaaccccaacagcggcggcaccaactacgcccagaagttccagggcagagtgaccatgaccagagacaccagcatcagcaccgcctacatggagctgagcagactgagaagcgacgacaccgccgtgtactactgcgccagagagggcaagtggggcccccaggccgccttcgacatctggggccagggcaccatggtgaccgtgagcagcggcaccggcggcagcggcggcaccggcagcggcaccggcggcagcaccgagatcgtgatgacccagagccccggcaccctgagcctgagccccggcgagagagccaccctgagctgcagagccagccagagcgtgagcagcagctacctggcctggtaccagcagaagcccggccaggcccccagactgctgatctacgacgccagcagcagagccaccgacatccccgacagattcagcggcagcggcagcggcaccgacttcaccctgaccatcagcagactggagcccgaggacttcgccgtgtactactgccagcagtacggcagcagcctgtggaccttcggccagggcaccaaggtggagatcaagaga

SEQ ID NO: 35743 - RNA, 738 nt, synthetic construct
  misc_feature 1..738: note = derived and/or modified sequence opt4 from anti-influenza_Chain
  source 1..738: mol_type = other RNA
gaggtgcagctggtggagagcggcggcggcctggtgcagcccggcggcagcctgagactgagctgcgccgccagcggcttcaccttcagcatctacgccatgagctgggtgagacaggcccccggcaagggcctggagtgggtgagcgccatcagcagcagcggcgacagcacctactacgccgacagcgtgaagggcagattcaccatcagcagagacaacgccagaaacaccctgtacctgcagatgaacagcctgagagccgaggacaccgccgtgtactactgcgccagagcctacggctacaccttcgacccctggggccagggcaccctggtgaccgtgagcagcggcaccggcggcagcggcggcaccggcagcggcaccggcggcagcaccgagatcgtgctgacccagagccccctgagcctgcccgtgacccccggcgagcccgccagcatcagctgcagaagcagccagagcctgctgcacagcaacggctacaactacctggactggtacctgcagaagcccggccagagcccccagctgctgatctacctgggcagcaacagagccagcggcgtgcccgacagattcagcggcagcggcagcggcaccgacttcaccctgaagatcagcagagtggaggccgaggacgtgggcgtgtactactgcatgcaggccctgcagacccccctgaccttcggcggcggcaccaaggtggagatcaagaga

SEQ ID NO: 35744 - RNA, 738 nt, synthetic construct
  misc_feature 1..738: note = derived and/or modified sequence opt4 from anti-influenza_Chain
  source 1..738: mol_type = other RNA
gaggtgcagctggtggagaccggcgccgaggtgaagaagcccggcagcagcgtgaaggtgagctgcaaggccagcggcggcaccttcagaacccacgccatcagctgggtgagacaggcccccggccagggcctggagtggatgggcggcatcatcgccatcttcggcaccgccaactacgcccagaagttccagggcagaatcaccatcaccgccgacgagagcaccagcaccgcctacatggagctgagcagcctgagaagcgaggacaccgccgtgtacttctgcgccagaggcagcggctaccacatcagcacccccttcgacaactggggccagggcaccctggtgaccgtgagcagcggcaccggcggcagcggcggcaccggcagcggcaccggcggcagcaccagctacgtgctgacccagccccccagcgtgagcgtggcccccggccagaccgccagaatcacctgcggcggcaacaacatcggcagcaagggcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccacgtggtgttcggcggcggcaccaagctgaccgtgctgggc

SEQ ID NO: 35745 - RNA, 738 nt, synthetic construct
  misc_feature 1..738: note = derived and/or modified sequence opt4 from anti-influenza_Chain
  source 1..738: mol_type = other RNA
gaggtgcagctggtgcagagcggcgccgaggtgaagaagcccggcagcagcgtgaaggtgagctgcaaggccagcggcggcatcttcagaagcaacagcatcagctgggtgagacaggcccccggccagggcctggagtggatgggcggcatcttcgccctgttcggcaccaccgactacgcccagaagttccagggcagagtgaccatcaccgccgacgagagcagcaccaccgtgtacctggagctgagcagcctgaccagcgaggacaccgccgtgtactactgcgccagaggcagcggctacaccaccagaaactacttcgactactggggccagggcaccctggtgaccgtgagcagcggcaccggcggcagcggcggcaccggcagcggcaccggcggcagcaccgagatcgtgctgacccagagccccggcaccctgagcctgagccccggcgagagagccaccctgagctgcagagccagccagagcgtgagcagcaactacctgggctggtaccagcagaagcccggccaggcccccagactgctgatctacggcgccagcagcagagccagcggcatccccgacagattcagcggcggcggcagcggcaccgacttcaccctgaccatcagcagactggagcccgaggacttcgccgtgtactactgccagcagtacggcagcagccccctgaccttcggcggcggcaccaaggtggagatcaagaga

SEQ ID NO: 35746 - RNA, 738 nt, synthetic construct
  misc_feature 1..738: note = derived and/or modified sequence opt4 from anti-influenza_Chain
  source 1..738: mol_type = other RNA
gaggtgcagctggtggagagcggcgccgaggtgaagaagcccggcagcagcgtgaaggtgagctgcaaggccagcggcggcatcttcaacagctacgccatcagctgggtgagacaggcccccggccagggcctggagtggatgggcggcatcatcgccatcttccacacccccaagtacgcccagaagttccagggcagagtgaccatcaccgccgacgagagcaccaacaccgcctacatggagctgagaagcctgaagagcgaggacaccgccctgtactactgcgccagaggcagcacctacgacttcagcagcggcctggactactggggccagggcaccctggtgaccgtgagcagcggcaccggcggcagcggcggcaccggcagcggcaccggcggcagcacccaggccggcctgacccagccccccagcgtgagcgtggcccccggccagaccgccagaatcacctgcggcggcaacaacatcggcagcaagagcgtgcactggtaccagcagaagcccggccaggcccccgtgctggtggtgtacgacgacagcgacagacccagcggcatccccgagagattcagcggcagcaacagcggcaacaccgccaccctgaccatcagcagagtggaggccggcgacgaggccgactactactgccaggtgtgggacagcagcagcgaccacgtggtgttcggcggcggcaccaagctgaccgtgctgggc

SEQ ID NO: 35747 - RNA, 741 nt, synthetic construct
  misc_feature 1..741: note = derived and/or modified sequence opt4 from anti-influenza_Chain
  source 1..741: mol_type = other RNA
cagatgcagctggtgcagagcggcgccgaggtgaagaagcccggcagcagcgtgaaggtgagctgcaaggccagcggcggcaccttcagcagctacgccatcacctgggtgagacaggcccccggccagggcctggagtggatgggcggcatcatcggcatgttcggcagcaccaactacgcccagaacttccagggcagagtgaccatcaccgccgacgagagcaccagcaccgcctacatggagctgagcagcctgagaagcgaggacaccgccgtgtactactgcgccagaagcaccggctactaccccgcctacctgcaccactggggccagggcaccctggtgaccgtgagcagcggcaccggcggcagcggcggcaccggcagcggcaccggcggcagcacccagagcgccctgacccagcccagaagcgtgagcggcagccccggccagagcgtgaccatcagctgcaccggcaccagcagcgacgtgggcggctacaactacgtgagctggtaccagcagcaccccggcaaggcccccaagctgatgatctacgacgtgagcaagagacccagcggcgtgcccgacagattcagcggcagcaagagcggcaacaccgccagcctgaccatcagcggcctgcaggccgaggacgaggccgactactactgcagcagctacaccagcagcagcacccacgtgttcggcaccggcaccaaggtgaccgtgctgggc

SEQ ID NO: 35748 - RNA, 744 nt, synthetic construct
  misc_feature 1..744: note = derived and/or modified sequence opt4 from anti-influenza_Chain
  source 1..744: mol_type = other RNA
gaggtgcagctggtggagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcggcaccggcggcagcggcggcaccggcagcggcaccggcggcagcaccagctacgtgctgacccagccccccagcgccagcggcacccccggccagagagtgaccatcagctgcagcggcagcaccttcaacatcggcagcaacgccgtggactggtacagacagctgcccggcaccgcccccaagctgctgatctacagcaacaaccagagacccagcggcgtgcccgacagattcagcggcagcagaagcggcaccagcgccagcctggccatcagcggcctgcagagcgaggacgaggccgactactactgcgccgcctgggacgacatcctgaacgtgcccgtgttcggcggcggcaccaagctgaccgtgctgggc

SEQ ID NO: 35749 - RNA, 744 nt, synthetic construct
  misc_feature 1..744: note = derived and/or modified sequence opt4 from anti-influenza_Chain
  source 1..744: mol_type = other RNA
caggtgcagctggtgcagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcggcaccggcggcagcggcggcaccggcagcggcaccggcggcagcacccagagcgccctgacccagcccgccgccgtgagcggcagccccggccagagcatcaccatcagctgcaccggcaccagcagcgacgtgggcggctacaactacgtgagctggtaccagcagcaccccggcaaggcccccaagctgatgatctacgaggtgagcaacagacccagcggcgtgagcaacagattcagcggcagcaagagcggcaacaccgccagcctgaccatcagcggcctgcaggccgaggacgaggccgactactactgcagcagctacaccagcagcagcacctacgtgttcggcaccggcaccaaggtgaccgtgctgggc

SEQ ID NO: 35750 - RNA, 744 nt, synthetic construct
  misc_feature 1..744: note = derived and/or modified sequence opt4 from anti-influenza_Chain
  source 1..744: mol_type = other RNA
gaggtgcagctggtggagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcggcaccggcggcagcggcggcaccggcagcggcaccggcggcagcaccagctacgtgctgacccagccccccagcgtgagcggcacccccggccagagagtgaccatcagctgcagcggcagcagaagcaacgtgggcgacaacagcgtgtactggtaccagcacgtgcccgagatggcccccaagctgctggtgtacaagaacacccagagacccagcggcgtgcccgccagattcagcggcagcaagagcggcaccagcgccagcctggccatcatcggcctgcagagcggcgacgaggccgactactactgcgtggcctgggacgacagcgtggacggctacgtgttcggcagcggcaccaaggtgaccgtgctgggc

SEQ ID NO: 35751 - RNA, 744 nt, synthetic construct
  misc_feature 1..744: note = derived and/or modified sequence opt4 from anti-influenza_Chain
  source 1..744: mol_type = other RNA
gaggtgcagctggtggagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcggcaccggcggcagcggcggcaccggcagcggcaccggcggcagcaccagctacgtgctgacccagccccccagcgccagcggcacccccggccagagagtgaccatcagctgcagcggcagcagcagcaacatcggcagcaactacgtgtactggtaccagcagctgcccggcaccgcccccaagctgctgatctacagagacggccagagacccagcggcgtgcccgacagattcagcggcagcaagagcggcaccagcgccagcctggccatcagcggcctgagaagcgacgacgaggccgactactactgcgccacctgggacgacaacctgagcggccccgtgttcggcggcggcaccaagctgaccgtgctgggc

SEQ ID NO: 35752 - RNA, 744 nt, synthetic construct
  misc_feature 1..744: note = derived and/or modified sequence opt4 from anti-influenza_Chain
  source 1..744: mol_type = other RNA
gaggtgcagctggtggagagcggcgccgaggtgaagaagcccggcagcagcgtgaaggtgagctgcaaggccagcggcggcaccttcagcttctacagcatgagctgggtgagacaggcccccggccagggcctggagtggatgggcggcatcatccccatgttcggcaccaccaactacgcccagaagttccagggcagagtgaccatcaccgccgtggagagcaccagcaccgcctacatggaggtgagcagcctgagaagcgaggacaccgccgtgtactactgcgccagaggcgacaagggcatctactactactacatggacgtgtggggcaagggcaccaccgtgaccgtgagcagcggcaccggcggcagcggcggcaccggcagcggcaccggcggcagcacccagagcgccctgacccagcccgccagcgtgagcggcagccccggccagagcatcaccatcagctgcaccggcaccagcagcgacgtgggcggctacaactacgtgagctggtaccagcagcaccccggcaaggcccccaagctgatgatctacgaggtgagcaacagacccagcggcgtgagcaacagattcagcggcagcaagagcggcaacaccgccagcctgaccatcagcggcctgcaggccgaggacgaggccgactactactgcagcagctacaccagcagcagcaccctggtgttcggcaccggcaccaaggtgaccgtgctgggc

SEQ ID NO: 35753 - RNA, 744 nt, synthetic construct
  misc_feature 1..744: note = derived and/or modified sequence opt4 from anti-influenza_Chain
  source 1..744: mol_type = other RNA
atgagcctgttcggcgacaccatcgcctacctgctgagcctgatcgaggacggcgagggcaaggccgagctggccgagaagctgcactgctggttcggcggcaaggagttcgacctggacagcgccctggagtggatcaagaacaagagatgcctgaccgacatccagaaggccctgatcggcgccagcatctgcttcctgaagcccaaggaccaggagagaaagagaagattcatcaccgagcccctgagcggcatgggcaccaccgccaccaagaagaagggcctgatcctggccgagagaaagatgagaagatgcgtgagcttccacgaggccttcgagatcgccgagggccacgagagcagcgccctgctgtactgcctgatggtgatgtacctgaaccccgagaactacagcatgcaggtgaagctgggcaccctgtgcgccctgtgcgagaagcaggccagccacagccacagagcccacagcagagccgccagaagcagcgtgcccggcgtgagaagagagatgcagatggtgagcgccatgaacaccgccaagaccatgaacggcatgggcaagggcgaggacgtgcagaagctggccgaggagctgcagaacaacatcggcgtgctgagaagcctgggcgccagccagaagaacggcgagggcatcgccaaggacgtgatggaggtgctgaagcagagcagcatgggcaacagcgccctggtgagaaagtacctg

SEQ ID NO: 35754 - RNA, 747 nt, synthetic construct
  misc_feature 1..747: note = derived and/or modified sequence opt4 from anti-influenza_Chain
  source 1..747: mol_type = other RNA
gaggtgcagctggtggagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcggcaccggcggcagcggcggcaccggcagcggcaccggcggcagcacccagagcgtgctgacccagccccccagcgtgagcgccgcccccggccagaaggtgaccatcagctgcagcggcagcagcagcaacatcggcaacgactacgtgagctggtaccagcagctgcccggcaccgcccccaagctgctgatctacgacaacaacaagagacccagcggcatccccgacagattcagcggcagcaagagcggcaccagcgccaccctgggcatcaccggcctgcagaccggcgacgaggccaactactactgcgccacctgggacagaagacccaccgcctacgtggtgttcggcggcggcaccaagctgaccgtgctgggc

SEQ ID NO: 35755 - RNA, 750 nt, synthetic construct
  misc_feature 1..750: note = derived and/or modified sequence opt4 from anti-influenza_Chain
  source 1..750: mol_type = other RNA
caggtgcagctggtgcagagcggcgccgaggtgaagaagcccggcagcagcgtgagagtgagctgcaaggccagcggcagcatcttcagaaactacgccatgagctgggtgagacaggcccccggccagggcctggagtggatgggcggcatcatcgccatcttcggcacccccaagtacgcccagaagttccagggcagagtgaccatcaccgccgacgagagcaccagcaccgtgtacatggagctgagcggcctgagaagcgaggacaccgccatgtactactgcgccagaatcccccactacaacttcggcagcggcagctacttcgactactggggccagggcaccctggtgaccgtgagcagcggcaccggcggcagcggcggcaccggcagcggcaccggcggcagcaccaccgtgctgacccagccccccagcgtgagcggcgcccccggccagagagtgaccatcagctgcaccggcagcagcagcaacatcggcgccggctacgacgtgcactggtaccagcagctgcccggcaccgcccccaagctgctgatctacggcaacagcaacagacccagcggcgtgcccgacagattcagcggcagcaagagcggcaccagcgccaccctgggcatcaccggcctgcagaccggcgacgaggccgactactactgcggcacctgggacagcagcctgagcgcctacgtgttcggcaccggcaccaaggtgaccgtgctgggc

SEQ ID NO: 35756 - RNA, 756 nt, synthetic construct
  misc_feature 1..756: note = derived and/or modified sequence opt4 from anti-influenza_Chain
  source 1..756: mol_type = other RNA
gaggtgcagctggtggagagcggcgccgaggtgaagaagcccggcagcagcgtgaaggtgagctgcaaggccagcggccacatcttcagcggctacgccatcagctgggtgagacaggcccccggccagggcctggagtggatgggcggcatcatccccatcttcggcaccaccaactacgcccagaagttccagggcagagtgaccatcaccgccgaccagagcaccagcaccgcctacatggacctgagcaacctgagaagcgaggacaccgccgtgtactactgcgccagagtgaaggacggctactgcaccctgaccagctgccccgtgggctggtacttcgacctgtggggcagaggcaccctggtgaccgtgagcagcggcaccggcggcagcggcggcaccggcagcggcaccggcggcagcaccgagatcgtgatgacccagagccccggcaccctgagcctgagccccggcgagagagccaccctgagctgcagagccagccagagcgtgagcagcagctacctggcctggtaccagcagaagcccggccaggcccccagactgctgatcttcggcgccagcagcagagccaccggcatccccgacagattcagcggcagcggcagcggcaccgacttcaccctgaccatcagcagactggagcccgaggacttcgccgtgtactactgccagcagtacggcagcagcctgaccttcggcggcggcaccaagctggagatcaagaga

SEQ ID NO: 35757 - RNA, 768 nt, synthetic construct
  misc_feature 1..768: note = derived and/or modified sequence opt4 from anti-influenza_Chain
  source 1..768: mol_type = other RNA
caggtgcagctggtgcagagcggcgccgaggtgaagaagcccggcagcagcgtgaaggtgagctgcaaggccagcggcggcttcttcagcagctacgccatcagctgggtgagacaggcccccggccagggcctggagtggatgggcggcgtgatccccatcttcagaaccgccaactacgcccagaacttccagggcagagtgaccatcaccgccgacgagttcaccagctacatggagctgagcagcctgagaagcgacgacaccgccgtgtactactgcgccagactgaactaccacgacagcggcacctactacaacgcccccagaggctggttcgacccctggggccagggcaccctggtgaccgtgagcagcggcaccggcggcagcggcggcaccggcagcggcaccggcggcagcaccgacatccagatgacccagagccccgacagcctggccgtgagcctgggcgagaaggccaccatcaactgcaagagcagccagagcatcctgaacagcagcaacaacaagaactacctggcctggtaccagcagaagcccggccagccccccaagctgctgatctactgggccagcaccagagagagcggcgtgcccgacagattcagcggcagcggcagcggcaccgacttcaccctgaccatcagcagcctgcaggccgaggacgtggccgtgtactactgccagcagtactacagcagcccccccaccttcggccagggcaccaaggtggagatcaagaga

SEQ ID NO: 35758 - RNA, 768 nt, synthetic construct; identical to SEQ ID NO: 35757
  misc_feature 1..768: note = derived and/or modified sequence opt4 from anti-influenza_Chain
  source 1..768: mol_type = other RNA

SEQ ID NO: 35759 - RNA, 771 nt, synthetic construct
  misc_feature 1..771: note = derived and/or modified sequence opt4 from anti-influenza_Chain
  source 1..771: mol_type = other RNA
atctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaag

SEQ ID NO: 35760 - RNA, 771 nt, synthetic construct; identical to SEQ ID NO: 35759
  misc_feature 1..771: note = derived and/or modified sequence opt4 from anti-influenza_Chain
  source 1..771: mol_type = other RNA

SEQ ID NO: 35761 - RNA, 777 nt, synthetic construct
  misc_feature 1..777: note = derived and/or modified sequence opt4 from anti-influenza_Chain
  source 1..777: mol_type = other RNA
atggtgaagagcaagtacctggtgttcatcagcgtgttcagcctgctgttcggcgtgttcgtggtgggcttcagccaccagggcgtgaaggccgaggaggagagacccatgggcaccgccttctacgagagcttcgacgccttcgacgacgagagatggagcaaggccggcgtgtggaccaacggccagatgttcaacgccacctggtaccccgagcaggtgaccgccgacggcctgatgagactgaccatcgccaagaagaccaccagcgccagaaactacaaggccggcgagctgagaaccaacgacttctaccactacggcctgttcgaggtgagcatgaagcccgccaaggtggagggcaccgtgagcagcttcttcacctacaccggcgagtgggactgggacggcgacccctgggacgagatcgacatcgagttcctgggcaaggacaccaccagaatccagttcaactacttcaccaacggcgtgggcggcaacgagttctactacgacctgggcttcgacgccagcgagagcttcaacacctacgccttcgagtggagagaggacagcatcacctggtacgtgaacggcgaggccgtgcacaccgccaccgagaacatcccccagaccccccagaagatcatgatgaacctgtggcccggcgtgggcgtggacggctggaccggcgtgttcgacggcgacaacacccccgtgtacagctactacgactgggtgagatacacccccctgcagaactaccagatccaccag

SEQ ID NO: 35762 - RNA, 777 nt, synthetic construct; identical to SEQ ID NO: 35761
  misc_feature 1..777: note = derived and/or modified sequence opt4 from anti-influenza_Chain
  source 1..777: mol_type = other RNA

SEQ ID NO: 35763 - RNA, 783 nt, synthetic construct
  misc_feature 1..783: note = derived and/or modified sequence opt4 from anti-influenza_Chain
  source 1..783: mol_type = other RNA
gacatccagatgacccagagccccagcagcgtgagcgccagcgtgggcgacagagtgaccatcacctgcagagccagccaggacatcagcacctggctggcctggtaccagcagaagcccggcaaggcccccaagctgctgatctacgccgccagcagcctgcagagcggcgtgcccagcagattcagcggcagcggcagcggcaccgacttcaccctgaccatcagcagcctgcagcccgaggacttcgccacctacttctgccagcaggccaacagcttcccccccaccttcggctgcggcaccaagctggagatcaagggcggcggcggcagcggcggcggcggcagcggcggcggcggcagcggcggcggcggcagcgaggtgcagctggtggtgagcggcggcggcctggtgaagcccggcggcagcctgagactgagctgcgccgccagcggcctgagcttcctgaacgcctggatgagctgggtgagacaggcccccggcaagtgcctggagtgggtgggcagaatcaagagcaacaccgacggcggcaccaccgactacgccgcccccgtgaagggcagattcagcatcagcagagacgacagcaagaacatgctgttcctgcacatgagcagcctgagaaccgaggacaccgccgtgtactactgcgccaccgacggcccctacagcgacgacttcagaagcggctacgccgccagatacagatacttcggcatggacgtgtggggccagggcaccaccgtgaccgtgagcagc

SEQ ID NO: 35764 - RNA, 783 nt, synthetic construct; identical to SEQ ID NO: 35763
  misc_feature 1..783: note = derived and/or modified sequence opt4 from anti-influenza_Chain
  source 1..783: mol_type = other RNA

SEQ ID NO: 35765 - RNA, 789 nt, synthetic construct
  misc_feature 1..789: note = derived and/or modified sequence opt4 from anti-influenza_Chain
  source 1..789: mol_type = other RNA
atgggcttcgtgctgttcagccagctgcccagcttcctgctggtgagcaccctgctgctgttcctggtgatcagccacagctgcagagcccagaacggcggcagctacccctacaagagcggcgagtacagaaccaagagcttcttcggctacggctactacgaggtgagaatgaaggccgccaagaacgtgggcatcgtgagcagcttcttcacctacaccggccccagcgacaacaacccctgggacgagatcgacatcgagttcctgggcaaggacaccaccaaggtgcagttcaactggtacaagaacggcgtgggcggcaacgagtacctgcacaacctgggcttcgacgccagccaggacttccacacctacggcttcgagtggagacccgactacatcgacttctacgtggacggcaagaaggtgtacagaggcaccagaaacatccccgtgacccccggcaagatcatgatgaacctgtggcccggcatcggcgtggacgagtggctgggcagatacgacggcagaacccccctgcaggccgagtacgagtacgtgaagtactaccccaacggcagaagcaagctggtggtgaacacccccttcgtggccgtgttcagcaacttcgacagcagccagtgggagaaggccgactgggccaacggcagcgtgttcaactgcgtgtggaagcccagccaggtgaccttcagcaacggcaagatgatcctgaccctggacagagagtacgtggaccaccaccaccaccaccacaaggacgagctg

SEQ ID NO: 35766 - RNA, 789 nt, synthetic construct; identical to SEQ ID NO: 35765
  misc_feature 1..789: note = derived and/or modified sequence opt4 from anti-influenza_Chain
  source 1..789: mol_type = other RNA

SEQ ID NO: 35767 - RNA, 840 nt, synthetic construct
  misc_feature 1..840: note = derived and/or modified sequence opt4 from anti-influenza_Chain
  source 1..840: mol_type = other RNA
atggcccaggtgggcagaggcgccagccccctgagcagagccagagtgccccccctgccccaccccctggacggcgagcacctgccccacgaccccgccggcggcggccacggcaaggccagcagccaggacgcccccgtgggccagctgcccggccacctggccagacccgccttcttccactacctgaagaacagcttcctggtgtgcagcctgaccaccgtgttcgccctggccgtggccaccttcgccggctacgccctggccagattcagattccccggcgccgagctgttcggcggcagcgtgctggtgacccaggtgatccccggcatcctgttcctgatccccatctacatcatgtacatctacgtgcagaactgggtgagaagcgccctgggcctggaggtgagactggtgggcagctacggcggcctggtgttcacctacaccgccttcttcgtgcccctgagcatctggatcctgagaggcttcttcgccagcatccccaaggagctggaggaggccgccatggtggacggcgccacccccttccaggccttccacagagtgatcctgcccctggccctgcccggcctggccgccaccgccgtgtacatcttcctgaccgcctgggacgagctgctgttcgcccaggtgctgaccaccgaggccaccgccaccgtgcccgtgggcatcagaaacttcgtgggcaactaccagaacagatacgacctggtgatggccgccgccaccgtggccaccctgcccgtgctggtgctgttcttcttcgtgcagagacagctgatccagggcctgaccgccggcgccgtgaagggc

SEQ ID NO: 35768 - RNA, 840 nt, synthetic construct; identical to SEQ ID NO: 35767
  misc_feature 1..840: note = derived and/or modified sequence opt4 from anti-influenza_Chain
  source 1..840: mol_type = other RNA

SEQ ID NO: 35769 - RNA, 843 nt, synthetic construct
  misc_feature 1..843: note = derived and/or modified sequence opt4 from anti-influenza_Chain
  source 1..843: mol_type = other RNA
atggccgacaacatgaccaccacccagatcgaggtgggccccggcgccaccaacgccaccatcaacttcgaggccggcatcctggagtgctacgagagattcagctggcagagagccctggactaccccggccaggacagactgcacagactgaagagaaagctggagagcagaatcaagacccacaacaagagcgagcccgagaacaagagaatgagcctggaggagagaaaggccatcggcgtgaagatgatgaaggtgctgctgttcatggaccccagcgccggcatcgagggcttcgagccctactgcgtgaagaaccccagcaccagcaagtgccccaactacgactggaccgactacccccccacccccggcaagtacctggacgacatcgaggaggagcccgagaacgtggaccaccccatcgaggtggtgctgagagacatgaacaacaaggacgccagacagaagatcaaggacgaggtgaacacccagaaggagggcaagttcagactgaccatcaagagagacatcagaaacgtgctgagcctgagagtgctggtgaacggcaccttcctgaagcaccccaacggcgacaagagcctgagcaccctgcacagactgaacgcctacgaccagaacggcggcctggtggccaagctggtggccaccgacgacagaaccgtggaggacgagaaggacggccacagaatcctgaacagcctgttcgagagattcgacgagggccacagcaagcccatcagagccgccgagaccgccgtgggcgtgctgagccagttcggccaggagcacagactgagccccgaggagggcgacaac

SEQ ID NO: 35770 - RNA, 843 nt, synthetic construct; identical to SEQ ID NO: 35769
  misc_feature 1..843: note = derived and/or modified sequence opt4 from anti-influenza_Chain
  source 1..843: mol_type = other RNA

SEQ ID NO: 35771 - RNA, 858 nt, synthetic construct
  misc_feature 1..858: note = derived and/or modified sequence opt4 from anti-influenza_Chain
  source 1..858: mol_type = other RNA
atgtgcaccatgcccctgatgaagctgaagaagatgatgagaagaaccgccttcctgctgagcgtgctgatcggctgcagcatgctgggcagcgacagaagcgacaaggccccccactgggagctggtgtggagcgacgagttcgactacagcggcctgcccgaccccgagaagtgggactacgacgtgggcggccacggctggggcaaccaggagctgcagtactacaccagagccagaatcgagaacgccagagtgggcggcggcgtgctgatcatcgaggccagacacgagccctacgagggcagagagtacaccagcgccagactggtgaccagaggcaaggccagctggacctacggcagattcgagatcagagccagactgcccagcggcagaggcacctggcccgccatctggatgctgcccgacagacagacctacggcagcgcctactggcccgacaacggcgagatcgacatcatggagcacgtgggcttcaaccccgacgtggtgcacggcaccgtgcacaccaaggcctacaaccacctgctgggcacccagagaggcggcagcatcagagtgcccaccgccagaaccgacttccacgtgtacgccatcgagtggacccccgaggagatcagatggttcgtggacgacagcctgtactacagattccccaacgagagactgaccgaccccgaggccgactggagacactggcccttcgaccagcccttccacctgatcatgaacatcgccgtgggcggcgcctggggcggccagcagggcgtggaccccgaggccttccccgcccagctggtggtggactacgtgagagtgtacagatgggtggag

SEQ ID NO: 35772 - RNA, 858 nt, synthetic construct; identical to SEQ ID NO: 35771
  misc_feature 1..858: note = derived and/or modified sequence opt4 from anti-influenza_Chain
  source 1..858: mol_type = other RNA

SEQ ID NO: 35773 - RNA, 900 nt, synthetic construct
  misc_feature 1..900: note = derived and/or modified sequence opt4 from anti-influenza_Chain
  source 1..900: mol_type = other RNA
aacgtgcccgagtggagctacatcgtggagaaggccaaccccgccaacgacctgtgctaccccggcaacttcaacgactacgaggagctgaagcacctgctgagcagaatcaaccacttcgagaagatccagggctacatccccgaggcccccagagacggccaggcctacgtgagaaaggacggcgagtgggtgctgctgagcaccttcctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35774 - RNA, 900 nt, synthetic construct; identical to SEQ ID NO: 35773
  misc_feature 1..900: note = derived and/or modified sequence opt4 from anti-influenza_Chain
  source 1..900: mol_type = other RNA

SEQ ID NO: 35775 - RNA, 927 nt, synthetic construct
  misc_feature 1..927: note = derived and/or modified sequence opt4 from anti-influenza_Chain
  source 1..927: mol_type = other RNA
atggtgaacagaagagacctgatcaagtggagcgccgtggccctgggcgccggcgccggcctggccggccccgcccccgccgcccacgccgccgacctggagtgggagcagtaccccgtgcccgccgcccccggcggcaacagaagctggcagctgctgcccagccacagcgacgacttcaactacaccggcaagccccagaccttcagaggcagatggctggaccagcacaaggacggctggagcggccccgccaacagcctgtacagcgccagacacagctgggtggccgacggcaacctgatcgtggagggcagaagagcccccgacggcagagtgtactgcggctacgtgaccagcagaacccccgtggagtaccccctgtacaccgaggtgctgatgagagtgagcggcctgaagctgagcagcaacttctggctgctgagcagagacgacgtgaacgagatcgacgtgatcgagtgctacggcaacgagagcctgcacggcaagcacatgaacaccgcctaccacatcttccagagaaaccccttcaccgagctggccagaagccagaagggctacttcgccgacggcagctacggctacaacggcgagaccggccaggtgttcggcgacggcgccggccagcccctgctgagaaacggcttccacagatacggcgtgcactggatcagcgccaccgagttcgacttctacttcaacggcagactggtgagaagactgaacagaagcaacgacctgagagaccccagaagcagattcttcgaccagcccatgcacctgatcctgaacaccgagagccaccagtggagagtggacagaggcatcgagcccaccgacgccgagctggccgaccccagcatcaacaacatctactacagatgggtgagaacctaccaggccgtg

SEQ ID NO: 35776 - RNA, 927 nt, synthetic construct; identical to SEQ ID NO: 35775
  misc_feature 1..927: note = derived and/or modified sequence opt4 from anti-influenza_Chain
  source 1..927: mol_type = other RNA

SEQ ID NO: 35777 - RNA, 960 nt, synthetic construct
  misc_feature 1..960: note = derived and/or modified sequence opt4 from anti-influenza_Chain
  source 1..960: mol_type = other RNA
atctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctg

SEQ ID NO: 35778 - RNA, 960 nt, synthetic construct; identical to SEQ ID NO: 35777
  misc_feature 1..960: note = derived and/or modified sequence opt4 from anti-influenza_Chain
  source 1..960: mol_type = other RNA

SEQ ID NO: 35779 - RNA, 960 nt, synthetic construct; identical to SEQ ID NO: 35777
  misc_feature 1..960: note = derived and/or modified sequence opt4 from anti-influenza_Chain
  source 1..960: mol_type = other RNA

SEQ ID NO: 35780 - RNA, 978 nt, synthetic construct
  misc_feature 1..978: note = derived and/or modified sequence opt4 from anti-influenza_Chain
  source 1..978: mol_type = other RNA
accctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagaccagcagcagcgacaacggcacctgctaccccggcgacttcatcgactacgaggagctgagagagcagctgagcagcgtgagcagcttcgagagattcgagatcttccccaagaccagcagctggcccaaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccaccccagcaccagcgccgaccagcagagcctgtaccagaacgccgacgcctacgtgttcgtgggcaccagcagatacagcaagaagttcaagcccgagatcgccatcagacccaaggtgagagaccaggagggcagaatgaactactactggaccctggtggagcccggcgacaagatcaccttcgaggccaccggcaacctggtggtgcccagatacgccttcgccatggagagagacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacgtgcccagcatccagagcaga

SEQ ID NO: 35781 - RNA, 978 nt, synthetic construct; identical to SEQ ID NO: 35780
  misc_feature 1..978: note = derived and/or modified sequence opt4 from anti-influenza_Chain
  source 1..978: mol_type = other RNA

SEQ ID NO: 35782 - RNA, 960 nt, synthetic construct; identical to SEQ ID NO: 35777
  misc_feature 1..960: note = derived and/or modified sequence opt4 from anti-influenza_Chain
  source 1..960: mol_type = other RNA

SEQ ID NO: 35783 - RNA, 990 nt, synthetic construct
  misc_feature 1..990: note = derived and/or modified sequence opt4 from anti-influenza_Chain
  source 1..990: mol_type = other RNA
atgtgcagcagcatccccagcctgagagaggtgttcgccaacgacttcagaatcggcgccgccgtgaaccccgtgaccctggaggcccagcagagcctgctgatcagacacgtgaacagcctgaccgccgagaaccacatgaagttcgagcacctgcagcccgaggagggcagattcaccttcgacatcgccatcaagagcagcaccagccccttcagcagccacggcgtgagaggccacaccctggtgtggcacaaccagacccccagctgggtgttccaggacagccagggccacttcgtgggcagagacgtgctgctggagagaatgaagagccacatcagcaccgtggtgcagagatacaagggcaaggtgtactgctgggacgtgatcaacgaggccgtggccgacgagggcagcgagtggctgagaagcagcacctggagacagatcatcggcgacgacttcatccagcaggccttcctgtacgcccacgaggccgaccccgaggccctgctgttctacaacgactacaacgagtgcttccccgagaagagagagaagatctacaccctggtgaagagcctgagagacaagggcatccccatccacggcatcggcatgcaggcccactggagcctgaacagacccaccctggacgagatcagagccgccatcgagagatacgccagcctgggcgtgatcctgcacatcaccgagctggacatcagcatgttcgagttcgacgaccacagaaaggacctggccgcccccaccaacgagatggtggagagacaggccgagagatacgagcagatcttcagcctgttcaaggagtacagagacgtgatccagaacgtgaccttctggggcatcgccgacgaccacacctggctggaccacttccccgtgcagggcagaaagaactggcccctgctgttcgacgagcagcacaaccccaagcccgccttctggagagtggtgaacatc

SEQ ID NO: 35784 - RNA, 990 nt, synthetic construct; identical to SEQ ID NO: 35783
  misc_feature 1..990: note = derived and/or modified sequence opt4 from anti-influenza_Chain
  source 1..990: mol_type = other RNA

SEQ ID NO: 35785 - RNA, 1002 nt, synthetic construct
  misc_feature 1..1002: note = derived and/or modified sequence opt4 from anti-influenza_Chain
  source 1..1002: mol_type = other RNA
atgaagaacagagtgatcagcctgctgatggccagcctgctgctggtgctgagcgtgatcgtggcccccttctacaaggccgaggccgccaccgtggtgaacacccccttcgtggccgtgttcagcaacttcgacagcagccagtgggagaaggccgactgggccaacggcagcgtgttcaactgcgtgtggaagcccagccaggtgaccttcagcaacggcaagatgatcctgaccctggacagagagtacggcggcagctacccctacaagagcggcgagtacagaaccaagagcttcttcggctacggctactacgaggtgagaatgaaggccgccaagaacgtgggcatcgtgagcagcttcttcacctacaccggccccagcgacaacaacccctgggacgagatcgacatcgagttcctgggcaaggacaccaccaaggtgcagttcaactggtacaagaacggcgtgggcggcaacgagtacctgcacaacctgggcttcgacgccagccaggacttccacacctacggcttcgagtggagacccgactacatcgacttctacgtggacggcaagaaggtgtacagaggcaccagaaacatccccgtgacccccggcaagatcatgatgaacctgtggcccggcatcggcgtggacgagtggctgggcagatacgacggcagaacccccctgcaggccgagtacgagtacgtgaagtactaccccaacggcgtgccccaggacaaccccacccccacccccaccatcgcccccagcacccccaccaaccccaacctgcccctgaagggcgacgtgaacggcgacggccacgtgaacagcagcgactacagcctgttcaagagatacctgctgagagtgatcgacagattccccgtgggcgaccagagcgtggccgacgtgaacagagacggcagaatcgacagcaccgacctgaccatgctgaagagatacctgatcagagccatccccagcctg

SEQ ID NO: 35786 - RNA, 1002 nt, synthetic construct; identical to SEQ ID NO: 35785
  misc_feature 1..1002: note = derived and/or modified sequence opt4 from anti-influenza_Chain
  source 1..1002: mol_type = other RNA

SEQ ID NO: 35787 - RNA, 1041 nt, synthetic construct
  misc_feature 1..1041: note = derived and/or modified sequence opt4 from anti-influenza_Chain
  source 1..1041: mol_type = other RNA
atctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctgggctacatccccgaggcccccagagacggccaggcctacgtgagaaaggacggcgagtgggtgctgctgagcaccttcctg

SEQ ID NO: 35788 - RNA, 1041 nt, synthetic construct; identical to SEQ ID NO: 35787
  misc_feature 1..1041: note = derived and/or modified sequence opt4 from anti-influenza_Chain
  source 1..1041: mol_type = other RNA

SEQ ID NO: 35789 - RNA, 1047 nt, synthetic construct
  misc_feature 1..1047: note = derived and/or modified sequence opt4 from anti-influenza_Chain
  source 1..1047: mol_type = other RNA
atgaacatcaagaagaccgccgtgaagagcgccctggccgtggccgccgccgccgccgccctgaccaccaacgtgagcgccaaggacttcagcggcgccgagctgtacaccctggaggaggtgcagtacggcaagttcgaggccagaatgaagatggccgccgccagcggcaccgtgagcagcatgttcctgtaccagaacggcagcgagatcgccgacggcagaccctgggtggaggtggacatcgaggtgctgggcaagaaccccggcagcttccagagcaacatcatcaccggcaaggccggcgcccagaagaccagcgagaagcaccacgccgtgagccccgccgccgaccaggccttccacacctacggcctggagtggacccccaactacgtgagatggaccgtggacggccaggaggtgagaaagaccgagggcggccaggtgagcaacctgaccggcacccagggcctgagattcaacctgtggagcagcgagagcgccgcctgggtgggccagttcgacgagagcaagctgcccctgttccagttcatcaactgggtgaaggtgtacaagtacacccccggccagggcgagggcggcagcgacttcaccctggactggaccgacaacttcgacaccttcgacggcagcagatggggcaagggcgactggaccttcgacggcaacagagtggacctgaccgacaagaacatctacagcagagacggcatgctgatcctggccctgaccagaaagggccaggagagcttcaacggccaggtgcccagagacgacgagcccgccccccagagcagcagcagcgcccccgccagcagcagcagcgtgcccgccagcagcagcagcgtgcccgccagcagcagcagcgccttcgtgccccccagcagcagcagcgccaccaacgccatccacggcatgagaaccacccccgccgtggccaaggagcacagaaacctggtgaacgccaagggcgccaaggtgaaccccaacggccacaagagatacagagtgaacttcgagcac

SEQ ID NO: 35790 - RNA, 1047 nt, synthetic construct
  misc_feature 1..1047: note = derived and/or modified sequence opt4 from anti-influenza_Chain
  source 1..1047: mol_type = other RNA
gaggtgcagctggtggagagcggcggcggcgtggtgcagcccggcagaagcctgagactgagctgcgccgccagcggcttcgccttccacaacagagccatgcactgggtgagacaggcccccggcaagggcctggagtgggtggccctgatctacttcgacggcagcaagcagtactacgccgacagcgtgaagggcagattcaccatcagcagagacaacagcaagaacaccgtgttcctgcagatgaacagcctgagacccgaggacaccgccgtgtactactgcgccgtgcccggccccatcttcggcatcttccccccctggagctacttcgaccactggggccagggcatcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggc

SEQ ID NO: 35791 - RNA, 1047 nt, synthetic construct; identical to SEQ ID NO: 35790
  misc_feature 1..1047: note = derived and/or modified sequence opt4 from anti-influenza_Chain
  source 1..1047: mol_type = other RNA

SEQ ID NO: 35792 - RNA, 1047 nt, synthetic construct; identical to SEQ ID NO: 35789
  misc_feature 1..1047: note = derived and/or modified sequence opt4 from anti-influenza_Chain
  source 1..1047: mol_type = other RNA

SEQ ID NO: 35793 - RNA, 1161 nt, synthetic construct
  misc_feature 1..1161: note = derived and/or modified sequence opt4 from anti-influenza_Chain
  source 1..1161: mol_type = other RNA
atgaacaagttcctgaacaagaagtggagcctgatcctgaccatgggcggcatcttcctgatggccaccctgagcctgatcttcgccaccggcaagaaggccttcaacgaccagaccagcgccgaggacatccccagcctggccgaggccttcagagactacttccccatcggcgccgccatcgagcccggctacaccaccggccagatcgccgagctgtacaagaagcacgtgaacatgctggtggccgagaacgccatgaagcccgccagcctgcagcccaccgagggcaacttccagtgggccgacgccgacagaatcgtgcagttcgccaaggagaacggcatggagctgagattccacaccctggtgtggcacaaccagacccccaccggcttcagcctggacaaggagggcaagcccatggtggaggagaccgacccccagaagagagaggagaacagaaagctgctgctgcagagactggagaactacatcagagccgtggtgctgagatacaaggacgacatcaagagctgggacgtggtgaacgaggtgatcgagcccaacgaccccggcggcatgagaaacagcccctggtaccagatcaccggcaccgagtacatcgaggtggccttcagagccaccagagaggccggcggcagcgacatcaagctgtacatcaacgactacaacaccgacgaccccgtgaagagagacatcctgtacgagctggtgaagaacctgctggagaagggcgtgcccatcgacggcgtgggccaccagacccacatcgacatctacaacccccccgtggagagaatcatcgagagcatcaagaagttcgccggcctgggcctggacaacatcatcaccgagctggacatgagcatctacagctggaacgacagaagcgactacggcgacagcatccccgactacatcctgaccctgcaggccaagagataccaggagctgttcgacgccctgaaggagaacaaggacatcgtgagcgccgtggtgttctggggcatcagcgacaagtacagctggctgaacggcttccccgtgaagagaaccaacgcccccctgctgttcgacagaaacttcatgcccaagcccgccttctgggccatcgtggaccccagcagactgagagag

SEQ ID NO: 35794 - RNA, 1161 nt, synthetic construct; identical to SEQ ID NO: 35793
  misc_feature 1..1161: note = derived and/or modified sequence opt4 from anti-influenza_Chain
  source 1..1161: mol_type = other RNA

SEQ ID NO: 35795 - RNA, 1221 nt, synthetic construct
  misc_feature 1..1221: note = derived and/or modified sequence opt4 from anti-influenza_Chain
  source 1..1221: mol_type = other RNA
atgagaaacgtggtgagaaagcccctgaccatcggcctggccctgaccctgctgctgcccatgggcatgaccgccaccagcgccaagaacgccgacagctacgccaagaagccccacatcagcgccctgaacgccccccagctggaccagagatacaagaacgagttcaccatcggcgccgccgtggagccctaccagctgcagaacgagaaggacgtgcagatgctgaagagacacttcaacagcatcgtggccgagaacgtgatgaagcccatcagcatccagcccgaggagggcaagttcaacttcgagcaggccgacagaatcgtgaagttcgccaaggccaacggcatggacatcagattccacaccctggtgtggcacagccaggtgccccagtggttcttcctggacaaggagggcaagcccatggtgaacgagaccgaccccgtgaagagagagcagaacaagcagctgctgctgaagagactggagacccacatcaagaccatcgtggagagatacaaggacgacatcaagtactgggacgtggtgaacgaggtggtgggcgacgacggcaagctgagaaacagcccctggtaccagatcgccggcatcgactacatcaaggtggccttccaggccgccagaaagtacggcggcgacaacatcaagctgtacatgaacgactacaacaccgaggtggagcccaagagaaccgccctgtacaacctggtgaagcagctgaaggaggagggcgtgcccatcgacggcatcggccaccagagccacatccagatcggctggcccagcgaggccgagatcgagaagaccatcaacatgttcgccgccctgggcctggacaaccagatcaccgagctggacgtgagcatgtacggctggccccccagagcctaccccacctacgacgccatccccaagcagaagttcctggaccaggccgccagatacgacagactgttcaagctgtacgagaagctgagcgacaagatcagcaacgtgaccttctggggcatcgccgacaaccacacctggctggacagcagagccgacgtgtactacgacgccaacggcaacgtggtggtggaccccaacgccccctacgccaaggtggagaagggcaagggcaaggacgcccccttcgtgttcggccccgactacaaggtgaagcccgcctactgggccatcatcgaccacaag

SEQ ID NO: 35796 - RNA, 1221 nt, synthetic construct; identical to SEQ ID NO: 35795
  misc_feature 1..1221: note = derived and/or modified sequence opt4 from anti-influenza_Chain
  source 1..1221: mol_type = other RNA

SEQ ID NO: 35797 - RNA, 1233 nt, synthetic construct
  misc_feature 1..1233: note = derived and/or modified sequence opt4 from anti-influenza_Chain
  source 1..1233: mol_type = other RNA
ctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggctacatccccgaggcccccagagacggccaggcctacgtgagaaaggacggcgagtgggtgctgctgagcaccttcctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35798 - RNA, 1233 nt, synthetic construct; identical to SEQ ID NO: 35797
  misc_feature 1..1233: note = derived and/or modified sequence opt4 from anti-influenza_Chain
  source 1..1233: mol_type = other RNA

SEQ ID NO: 35799 - RNA, 1293 nt, synthetic construct
  misc_feature 1..1293: note = derived and/or modified sequence opt4 from anti-influenza_Chain
  source 1..1293: mol_type = other RNA
atggacgaccacgccgagaagttcctgtggggcgtggccaccagcgcctaccagatcgagggcgccacccaggaggacggcagaggccccagcatctgggacgccttcgccagaagacccggcgccatcagagacggcagcaccggcgagcccgcctgcgaccactacagaagatacgaggaggacatcgccctgatgcagagcctgggcgtgagagcctacagattcagcgtggcctggcccagaatcctgcccgagggcagaggcagaatcaaccccaagggcctggccttctacgacagactggtggacagactgctggccagcggcatcacccccttcctgaccctgtaccactgggacctgcccctggccctggaggagagaggcggctggagaagcagagagaccgccttcgccttcgccgagtacgccgaggccgtggccagagccctggccgacagagtgcccttcttcgccaccctgaacgagccctggtgcagcgccttcctgggccactggaccggcgagcacgcccccggcctgagaaacctggaggccgccctgagagccgcccaccacctgctgctgggccacggcctggccgtggaggccctgagagccgccggcgccagaagagtgggcatcgtgctgaacttcgcccccgcctacggcgaggaccccgaggccgtggacgtggccgacagataccacaacagatacttcctggaccccatcctgggcaagggctaccccgagagccccttcagagaccccccccccgtgcccatcctgagcagagacctggagctggtggccagacccctggacttcctgggcgtgaactactacgcccccgtgagagtggcccccggcaccggcaccctgcccgtgagatacctgccccccgagggccccgccaccgccatgggctgggaggtgtaccccgagggcctgcaccacctgctgaagagactgggcagagaggtgccctggcccctgtacgtgaccgagaacggcgccgcctaccccgacctgtggaccggcgaggccgtggtggaggaccccgagagagtggcctacctggaggcccacgtggaggccgccctgagagccagagaggagggcgtggacctgagaggctacttcgtgtggagcctgatggacaacttcgagtgggccttcggctacaccagaagattcggcctgtactacgtggacttccccagccagagaagaatccccaagagaagcgccctgtggtacagagagagaatcgccagagcccagacc

SEQ ID NO: 35800 - RNA, 1293 nt, synthetic construct
  misc_feature 1..1293: note = derived and/or modified sequence opt4 from anti-influenza_Chain
  source 1..1293: mol_type = other RNA
atgaccgagaacgccgagaagttcctgtggggcgtggccaccagcgcctaccagatcgagggcgccacccaggaggacggcagaggccccagcatctgggacgccttcgcccagagacccggcgccatcagagacggcagcaccggcgagcccgcctgcgaccactacagaagatacgaggaggacatcgccctgatgcagagcctgggcgtgagagcctacagattcagcgtggcctggcccagaatcctgcccgagggcagaggcagaatcaaccccaagggcctggccttctacgacagactggtggacagactgctggccagcggcatcacccccttcctgaccctgtaccactgggacctgcccctggccctggaggagagaggcggctggagaagcagagagaccgccttcgccttcgccgagtacgccgaggccgtggccagagccctggccgacagagtgcccttcttcgccaccctgaacgagccctggtgcagcgccttcctgggccactggaccggcgagcacgcccccggcctgagaaacctggaggccgccctgagagccgcccaccacctgctgctgggccacggcctggccgtggaggccctgagagccgccggcgccagaagagtgggcatcgtgctgaacttcgcccccgcctacggcgaggaccccgaggccgtggacgtggccgacagataccacaacagattcttcctggaccccatcctgggcaagggctaccccgagagccccttcagagaccccccccccgtgcccatcctgagcagagacctggagctggtggccagacccctggacttcctgggcgtgaactactacgcccccgtgagagtggcccccggcaccggcaccctgcccgtgagatacctgccccccgagggccccgccaccgccatgggctgggaggtgtaccccgagggcctgtaccacctgctgaagagactgggcagagaggtgccctggcccctgtacgtgaccgagaacggcgccgcctaccccgacctgtggaccggcgaggccgtggtggaggaccccgagagagtggcctacctggaggcccacgtggaggccgccctgagagccagagaggagggcgtggacctgagaggctacttcgtgtggagcctgatggacaacttcgagtgggccttcggctacaccagaagattcggcctgtactacgtggacttccccagccagagaagaatccccaagagaagcgccctgtggtacagagagagaatcgccagagcccagacc

SEQ ID NO: 35801 - RNA, 1293 nt, synthetic construct
  misc_feature 1..1293: note = derived and/or modified sequence opt4 from anti-influenza_Chain
  source 1..1293: mol_type = other RNA
atggccgagaacgccgagaagttcctgtggggcgtggccaccagcgcctaccagatcgagggcgccacccaggaggacggcagaggccccagcatctgggacaccttcgccagaagacccggcgccatcagagacggcagcaccggcgagcccgcctgcgaccactaccacagatacgaggaggacatcgccctgatgcagagcctgggcgtgggcgtgtacagattcagcgtggcctggcccagaatcctgcccgagggcagaggcagaatcaaccccaagggcctggccttctacgacagactggtggacagactgctggccgccggcatcacccccttcctgaccctgtaccactgggacctgccccaggccctggaggacagaggcggctggagaagcagagagaccgccttcgccttcgccgagtacgccgaggccgtggccagagccctggccgacagagtgcccttcttcgccaccctgaacgagccctggtgcagcgccttcctgggccactggaccggcgagcacgcccccggcctgagaaacctggaggccgccctgagagccgcccaccacctgctgctgggccacggcctggccgtggaggccctgagagccgccggcgccaagagagtgggcatcgtgctgaacttcgcccccgtgtacggcgaggaccccgaggccgtggacgtggccgacagataccacaacagatacttcctggaccccatcctgggcagaggctaccccgagagccccttccaggaccccccccccacccccaacctgagcagagacctggagctggtggccagacccctggacttcctgggcgtgaactactacgcccccgtgagagtggcccccggcaccggccccctgcccgtgagatacctgccccccgagggccccgtgaccgccatgggctgggaggtgtaccccgagggcctgtaccacctgctgaagagactgggcagagaggtgccctggcccctgtacatcaccgagaacggcgccgcctaccccgacctgtggaccggcgaggccgtggtggaggaccccgagagagtggcctacctggaggcccacgtggaggccgccctgagagccagagaggagggcgtggacctgagaggctacttcgtgtggagcctgatggacaacttcgagtgggccttcggctacaccagaagattcggcctgtactacgtggacttccccagccagagaagaatccccaagagaagcgccctgtggtacagagagagaatcgccagagcccagctg

SEQ ID NO: 35802 - RNA, 1293 nt, synthetic construct; identical to SEQ ID NO: 35799
  misc_feature 1..1293: note = derived and/or modified sequence opt4 from anti-influenza_Chain
  source 1..1293: mol_type = other RNA

SEQ ID NO: 35803 - RNA, 1293 nt, synthetic construct; identical to SEQ ID NO: 35800
  misc_feature 1..1293: note = derived and/or modified sequence opt4 from anti-influenza_Chain
  source 1..1293: mol_type = other RNA

SEQ ID NO: 35804 - RNA, 1293 nt, synthetic construct; identical to SEQ ID NO: 35801
  misc_feature 1..1293: note = derived and/or modified sequence opt4 from anti-influenza_Chain
  source 1..1293: mol_type = other RNA

SEQ ID NO: 35805 - RNA, 1296 nt, synthetic construct
  misc_feature 1..1296: note = derived and/or modified sequence opt4 from anti-influenza_Chain
  source 1..1296: mol_type = other RNA
atgttcaagcccaactaccacttcttccccatcaccggctggatgaacgaccccaacggcctgatcttctggaagggcaagtaccacatgttctaccagtacaaccccagaaagcccgagtggggcaacatctgctggggccacgccgtgagcgacgacctggtgcactggagacacctgcccgtggccctgtaccccgacgacgagacccacggcgtgttcagcggcagcgccgtggagaaggacggcaagatgttcctggtgtacacctactacagagaccccacccacaacaagggcgagaaggagacccagtgcgtggccatgagcgagaacggcctggacttcgtgaagtacgacggcaaccccgtgatcagcaagccccccgaggagggcacccacgccttcagagaccccaaggtgaacagaagcaacggcgagtggagaatggtgctgggcagcggcaaggacgagaagatcggcagagtgctgctgtacaccagcgacgacctgttccactggaagtacgagggcgtgatcttcgaggacgagaccaccaaggagatcgagtgccccgacctggtgagaatcggcgagaaggacatcctgatctacagcatcaccagcaccaacagcgtgctgttcagcatgggcgagctgaaggagggcaagctgaacgtggagaagagaggcctgctggaccacggcaccgacttctacgccgcccagaccttcttcggcaccgacagagtggtggtgatcggctggctgcagagctggctgagaaccggcctgtaccccaccaagagagagggctggaacggcgtgatgagcctgcccagagagctgtacgtggagaacaacgagctgaaggtgaagcccgtggacgagctgctggccctgagaaagagaaaggtgttcgagaccgccaagagcggcaccttcctgctggacgtgaaggagaacagctacgagatcgtgtgcgagttcagcggcgagatcgagctgagaatgggcaacgagagcgaggaggtggtgatcaccaagagcagagacgagctgatcgtggacaccaccagaagcggcgtgagcggcggcgaggtgagaaagagcaccgtggaggacgaggccaccaacagaatcagagccttcctggacagctgcagcgtggagttcttcttcaacgacagcatcgccttcagcttcagaatccaccccgagaacgtgtacaacatcctgagcgtgaagagcaaccaggtgaagctggaggtgttcgagctggagaacatctggctg

SEQ ID NO: 35806 - RNA, 1296 nt, synthetic construct; identical to SEQ ID NO: 35805
  misc_feature 1..1296: note = derived and/or modified sequence opt4 from anti-influenza_Chain
  source 1..1296: mol_type = other RNA

SEQ ID NO: 35807 - RNA, 1323 nt, synthetic construct
  misc_feature 1..1323: note = derived and/or modified sequence opt4 from anti-influenza_Chain
  source 1..1323: mol_type = other RNA
gaggtgaagctggtggagagcggcggcggcctggtgcagcccggcggcagcctgagactgagctgcgccaccagcggcttcaccttcagcgactactacatgagctgggtgagacagagccccggcaaggccctggagtggctgggcttcaccagaagcagagtgctgggctacaccaccgactacagcgccagcgtgaagggcagattcaccatcagcagagacaacagccagagcatcctgtacctgcagatgaacagcctgagaggcgaggacagcgccacctactactgcgccagagacagacccatggactactggggccagggcaccagcgtgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagcacctggcccagcgagaccgtgacctgcaacgtggcccaccccgccagcagcaccaaggtggacaagaagatcgtgcccagagactgcggctgcaagccctgcatctgcaccgtgcccgaggtgagcagcgtgttcatcttcccccccaagcccaaggacgtgctgaccatcaccctgacccccaaggtgacctgcgtggtggtggacatcagcaaggacgaccccgaggtgcagttcagctggttcgtggacgacgtggaggtgcacaccgcccagacccagcccagagaggagcagttcaacagcaccttcagaagcgtgagcgagctgcccatcatgcaccaggactggctgaacggcaaggagttcaagtgcagagtgaacagcgccgccttccccgcccccatcgagaagaccatcagcaagaccaagggcagacccaaggccccccaggtgtacaccatccccccccccaaggagcagatggccaaggacaaggtgagcctgacctgcatgatcaccgacttcttccccgaggacatcaccgtggagtggcagtggaacggccagcccgccgagaactacaagaacacccagcccatcatggacaccgacggcagctacttcgtgtacagcaagctgaacgtgcagaagagcaactgggaggccggcaacaccttcacctgcagcgtgctgcacgagggcctgcacaaccaccacaccgagaagagcctgagccacagccccggcaag

SEQ ID NO: 35808 - RNA, 1323 nt, synthetic construct; identical to SEQ ID NO: 35807
  misc_feature 1..1323: note = derived and/or modified sequence opt4 from anti-influenza_Chain
  source 1..1323: mol_type = other RNA

SEQ ID NO: 35809 - RNA, 1329 nt, synthetic construct
  misc_feature 1..1329: note = derived and/or modified sequence opt4 from anti-influenza_Chain
  source 1..1329: mol_type = other RNA
gaggtgcagctgcagcagagcggccccgagctggtgaagcccggcgccagcgtgaagatgagctgcaaggccagcggctacaccttcaccagctacgtgatgcactgggtgaagcagaagcccggccagggcctggagtggatcggctacatcaacccctacaacgacggcaccagatacaacgagaagttcagagtgaaggccaccctgaccagcgacaagagcagcagcaccgcctacatggagctgagcagcctgaccagcgaggacagcgccgtgtactactgcgccagaagaggcctgatcaccacccccaccctggactactggggccagggcaccaccctgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagcacctggcccagcgagaccgtgacctgcaacgtggcccaccccgccagcagcaccaaggtggacaagaagatcgtgcccagagactgcggctgcaagccctgcatctgcaccgtgcccgaggtgagcagcgtgttcatcttcccccccaagcccaaggacgtgctgaccatcaccctgacccccaaggtgacctgcgtggtggtggacatcagcaaggacgaccccgaggtgcagttcagctgggtggacgacgtggaggtgcacaccgcccagacccagcccagagaggagcagttcaacagcaccttcagaagcgtgagcgagctgcccatcatgcaccaggactggctgaacggcaaggagttcaagtgcagagtgaacagcgccgccttccccgcccccatcgagaagaccatcagcaagaccaagggcagacccaaggccccccaggtgtacaccatccccccccccaaggagcagatggccaaggacaaggtgagcctgacctgcatgatcaccgacttcttccccgaggacatcaccgtggagtggcagtggaacggccagcccgccgagaactacaagaacacccagcccatcatggacaccgacggcagctacttcgtgtacagcaagctgaacgtgcagaagagcaactgggaggccggcaacaccttcacctgcagcgtgctgcacgagggcctgcacaaccaccacaccgagaagagcctgagccacagccccggcaag

SEQ ID NO: 35810 - RNA, 1329 nt, synthetic construct; identical to SEQ ID NO: 35809
  misc_feature 1..1329: note = derived and/or modified sequence opt4 from anti-influenza_Chain
  source 1..1329: mol_type = other RNA

SEQ ID NO: 35811 - RNA, 1332 nt, synthetic construct
  misc_feature 1..1332: note = derived and/or modified sequence opt4 from anti-influenza_Chain
  source 1..1332: mol_type = other RNA
aacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggctacatccccgaggcccccagagacggccaggcctacgtgagaaaggacggcgagtgggtgctgctgagcaccttcctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35812 - RNA, 1332 nt, synthetic construct; identical to SEQ ID NO: 35811
  misc_feature 1..1332: note = derived and/or modified sequence opt4 from anti-influenza_Chain
  source 1..1332: mol_type = other RNA

SEQ ID NO: 35813 - RNA, 1341 nt, synthetic construct
  misc_feature 1..1341: note = derived and/or modified sequence opt4 from anti-influenza_Chain
  source 1..1341: mol_type = other RNA
caggtgcagctgcaggagagcggccccggcctggtgaagcccagcgagaccctgagcctgacctgcaccgtgagcggcggcctgatcggcaccggcagctactactggggctggatcagacagacccccggcaagggcatggagtggatcggcagcatcagctacagcggcagcacctactaccaccccagcctgaagagcagagtgaccatcagcgacgacaccagcaagaaccagctgttcctgaagctgagaagcgtgaccgccgccgacaccgcccagtactactgcgccagatacaactggggcatcagatacttcgacttctggggcagaggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagaccagagagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccgcccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 35814 - RNA, 1341 nt, synthetic construct; identical to SEQ ID NO: 35813
  misc_feature 1..1341: note = derived and/or modified sequence opt4 from anti-influenza_Chain
  source 1..1341: mol_type = other RNA

SEQ ID NO: 35815 - RNA, 1344 nt, synthetic construct
  misc_feature 1..1344: note = derived and/or modified sequence opt4 from anti-influenza_Chain
  source 1..1344: mol_type = other RNA
gaggtgcagctgcaggagagcggccccggcctggtgaagcccagccagaccctgagcctgacctgcaacgtgagcggcggcagcatcaccggcgactacaagtggagctggatcagacagccccccggcaagggcctggagtggatcggccacatccacagcaccggcaccacctactacaaccccagcctgagaagcagaatcaccatcagcatggacaccagcaagaacaacctgagcctgagactgaccagcgtgaccgccgccgacaccgccgtgtactactgcgccagccacaccctgaccagcggccactaccccagagacttcgacttctggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgaccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcatggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagcggcaag

SEQ ID NO: 35816 - RNA, 1350 nt, synthetic construct
  misc_feature 1..1350: note = derived and/or modified sequence opt4 from anti-influenza_Chain
  source 1..1350: mol_type = other RNA
caggtgcagctgcagcagagcggcgccgaggtgaagaagcccggcagcagcgtgaaggtgagctgcaaggtgagcggcgtgatcttcagcggcagcgccatcagctgggtgagacaggcccccggccagggcctggagtggatgggcggcatcagccccctgttcggcaccaccaactacgcccagaagttccagggcagagtgaccatcaccgccgaccagagcaccaacaccacctacatggaggtgaacagcctgagatacgaggacaccgccgtgtacttctgcgccagaggccccaagtactacagcgagtacatggacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35817 - RNA, 1350 nt, synthetic construct
  misc_feature 1..1350: note = derived and/or modified sequence opt4 from anti-influenza_Chain
  source 1..1350: mol_type = other RNA
caggtgcagctggtgcagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcatgggcatgttcggcaccaccaactacgcccagaagttccagggcagagtgaccatcaccgccgacgagttcaccagcgccgcctacatggagctgagaagcctgagaagcgaggacaccgccgtgtactactgcgccagaagcagcggctactaccccgagtacttccaggactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35818 - RNA, 1350 nt, synthetic construct
  misc_feature 1..1350: note = derived and/or modified sequence opt4 from anti-influenza_Chain
  source 1..1350: mol_type = other RNA
gaggtgcagctggtggagagcggcgccgaggtgaagaagcccggcagcagcgtgaaggtgagctgcaaggccagcggcggcaccttcagcagctacggcatcagctgggtgagacaggcccccggccagggcctggagtggatgggcgacatcatcggcatgttcggcagcaccaactacgcccagaacttccagggcagactgaccatcaccgccgacgagagcaccagcaccgcctacatggagctgagcagcctgagaagcgaggacaccgccgtgtactactgcgccagaagcagcggctactaccccgcctacctgccccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35819 - RNA, 1350 nt, synthetic construct
  misc_feature 1..1350: note = derived and/or modified sequence opt4 from anti-influenza_Chain
  source 1..1350: mol_type = other RNA
gaggtgcagctggtggagagcggcgccgaggtgaagaagcccggcagcagcgtgaaggtgagctgcaaggccagcggcggcaccttcagcagctacgccatcagctgggtgagacaggcccccggccagggcctggagtggatgggcggcatcatcggcatgttcggcaccgccaactacgcccagaagttccagggcagagtgaccatcaccgccgacgagttcaccagcaccgcctacatggagctgagcagcctgagaagcgaggacaccgccgtgtactactgcgccagaggcaactactactacgagagcagcctggactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35820 - RNA, 1350 nt, synthetic construct
  misc_feature 1..1350: note = derived and/or modified sequence opt4 from anti-influenza_Chain
  source 1..1350: mol_type = other RNA
gaggtgcagctggtgcagagcggcgccgaggtgaagaagcccggcagcagcatgaaggtgagctgcaaggccagcggcagcatcttcagcaactacggcatcagctgggtgagacaggcccccggccagggcctggagtggatgggcggcatcatccccatcttcggcgccgccaactacgcccagaagttccagggcagagtgaccatcaccgccgacgagagcaccagcaccgtgtacatggaggtgagaagcctgagaagcgaggacaccgccgtgtactactgcgccagaagacagcagctgtacaagggctactaccaccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35821 - RNA, 1350 nt, synthetic construct
  misc_feature 1..1350: note = derived and/or modified sequence opt4 from anti-influenza_Chain
  source 1..1350: mol_type = other RNA
caggtgcagctggtgcagagcggcgccggcgtgaagaagcccggcagcagcatgaaggtgagctgcaaggccagcggcagcatcttcagcaactacggcatcagctgggtgagacaggcccccggccagggcctggagtggatgggcggcatcatccccatcttcggcgccgccaactacgcccagaagttccagggcagagtgaccatcaccgccgacgagagcaccagcaccgtgtacatggaggtgagaagcctgagaagcgaggacaccgccgtgtactactgcgccagaagacagcagctgtacaagggctactaccaccactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35822 - RNA, 1350 nt, synthetic construct
  misc_feature 1..1350: note = derived and/or modified sequence opt4 from anti-influenza_Chain
  source 1..1350: mol_type = other RNA
caggtgcagctggtgcagagcggcgccgaggtgagaaagcccggcagcagcgtgaaggtgagctgcaaggtgagcggcggcatcatcagaaagtacgccatcaactgggtgagacaggcccccggccagggcctggagtggatgggcggcatcatcgccatcttcaacaccgccaactacgcccagaagttccagggcagagtgaccatcaccgccgacgagagcaccagcaccgtgtacatggagctgagcagcctgagaagcgaggacaccgccctgtactactgcgccagaggcatgaactactacagcgactacttcgactactggggccagggcagcctggtgaccgtgagccccgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35823 - RNA, 1350 nt, synthetic construct; identical to SEQ ID NO: 35822
  misc_feature 1..1350: note = derived and/or modified sequence opt4 from anti-influenza_Chain
  source 1..1350: mol_type = other RNA

SEQ ID NO: 35824 - RNA, 1350 nt, synthetic construct; identical to SEQ ID NO: 35820
  misc_feature 1..1350: note = derived and/or modified sequence opt4 from anti-influenza_Chain
  source 1..1350: mol_type = other RNA

SEQ ID NO: 35825 - RNA, 1350 nt, synthetic construct; identical to SEQ ID NO: 35821
  misc_feature 1..1350: note = derived and/or modified sequence opt4 from anti-influenza_Chain
  source 1..1350: mol_type = other RNA

SEQ ID NO: 35826 - RNA, 1350 nt, synthetic construct; identical to SEQ ID NO: 35816
  misc_feature 1..1350: note = derived and/or modified sequence opt4 from anti-influenza_Chain
  source 1..1350: mol_type = other RNA

SEQ ID NO: 35827 - RNA, 1350 nt, synthetic construct; identical to SEQ ID NO: 35817
  misc_feature 1..1350: note = derived and/or modified sequence opt4 from anti-influenza_Chain
  source 1..1350: mol_type = other RNA

SEQ ID NO: 35828 - RNA, 1350 nt, synthetic construct; identical to SEQ ID NO: 35818
  misc_feature 1..1350: note = derived and/or modified sequence opt4 from anti-influenza_Chain
  source 1..1350: mol_type = other RNA

SEQ ID NO: 35829 - RNA, 1350 nt, synthetic construct; identical to SEQ ID NO: 35819
  misc_feature 1..1350: note = derived and/or modified sequence opt4 from anti-influenza_Chain
  source 1..1350: mol_type = other RNA

SEQ ID NO: 35830 - RNA, 1353 nt, synthetic construct
  misc_feature 1..1353: note = derived and/or modified sequence opt4 from anti-influenza_Chain
  source 1..1353: mol_type = other RNA
gaggtgcagctggtggagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35831 - RNA, 1353 nt, synthetic construct
  misc_feature 1..1353: note = derived and/or modified sequence opt4 from anti-influenza_Chain
  source 1..1353: mol_type = other RNA
caggtgcagctggtgcagagcggcgccgaggtgaagaagcccggcagcagcgtgaaggtgagctgcaaggccagcggcggccccttcagaagctacgccatcagctgggtgagacaggcccccggccagggccccgagtggatgggcggcatcatccccatcttcggcaccaccaagtacgcccccaagttccagggcagagtgaccatcaccgccgacgacttcgccggcaccgtgtacatggagctgagcagcctgagaagcgaggacaccgccatgtactactgcgccaagcacatgggctaccaggtgagagagaccatggacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35832 - RNA, 1353 nt, synthetic construct
  misc_feature 1..1353: note = derived and/or modified sequence opt4 from anti-influenza_Chain
  source 1..1353: mol_type = other RNA
gaggtgcagctggtggagagcggcgccgaggtgaagaagcccggcagcagcgtgaaggtgagctgcaaggccagcggcggcaccttcagcttctacagcatgagctgggtgagacaggcccccggccagggcctggagtggatgggcggcatcatccccatgttcggcaccaccaactacgcccagaagttccagggcagagtgaccatcaccgccgtggagagcaccagcaccgcctacatggaggtgagcagcctgagaagcgaggacaccgccgtgtactactgcgccagaggcgacaagggcatctactactactacatggacgtgtggggcaagggcaccaccgtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35833 - RNA, 1353 nt, synthetic construct; identical to SEQ ID NO: 35830
  misc_feature 1..1353: note = derived and/or modified sequence opt4 from anti-influenza_Chain
  source 1..1353: mol_type = other RNA

SEQ ID NO: 35834 - RNA, 1353 nt, synthetic construct; identical to SEQ ID NO: 35831
  misc_feature 1..1353: note = derived and/or modified sequence opt4 from anti-influenza_Chain
  source 1..1353: mol_type = other RNA

SEQ ID NO: 35835 - RNA, 1353 nt, synthetic construct; identical to SEQ ID NO: 35832
  misc_feature 1..1353: note = derived and/or modified sequence opt4 from anti-influenza_Chain
  source 1..1353: mol_type = other RNA

SEQ ID NO: 35836 - RNA, 1356 nt, synthetic construct
  misc_feature 1..1356: note = derived and/or modified sequence opt4 from anti-influenza_Chain
  source 1..1356: mol_type = other RNA
caggtgcagctggtgcagagcggcggcggcctggtgaagcccggcggcagcctgagactgagctgcgccgccagcggcttcaccttcagcagctacagcatgaactgggtgagacaggcccccggcaagggcctggagtgggtgagcagcatcagcagcagcagcagctacatctactacgtggacagcgtgaagggcagattcaccatcagcagagacaacgccaagaacagcctgtacctgcagatgaacagcctgagagccgaggacaccgccgtgtactactgcgccagaggcggcggcagctacggcgcctacgagggcttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35837 - RNA, 1356 nt, synthetic construct
  misc_feature 1..1356: note = derived and/or modified sequence opt4 from anti-influenza_Chain
  source 1..1356: mol_type = other RNA
caggtgcagctggtgcagagcggcgccgaggtgaagcagcccggcgccagcgtgaaggtgagctgcaaggccagcggctacaccttcaacgcctactacatccactgggtgagacaggcccccggccagggcctggagtggatgggctggatcaaccccaacttcggcggcacccactacgccagaaagttccagggcagagtgaccatgaccagagacgccagcatcaacaccgcctacatggagctggacagactgatcagcgacgacaccgccgtgtactactgcgtgagatggagagccgccgccgtgatcatggaccagttctacaagatggacgtgtggggccagggcaccctggtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagaccagagagagcaagtacggccccccctgccccagctgccccgcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaagggccagcccagagagccccaggtgtacaccctgccccccgcccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggcaag

SEQ ID NO: 35838 - RNA, 1356 nt, synthetic construct
  misc_feature 1..1356: note = derived and/or modified sequence opt4 from anti-influenza_Chain
  source 1..1356: mol_type = other RNA
gaggtgcagctggtgcagagcggcgccgaggtgaagaagcccggcgccagcgtgaaggtgagctgcaaggccagcggctacatcttcaccggctactacatccactgggtgagacaggcccccggccagggcctggagtggatgggcagaatcgaccccaacggcgccggcaccacctacgcccagaagttccagggcagagtgaccctgaccatggacaccagcatcaccaccgcctacatggagctgagcagactgagattcgacgacaccgccatctactactgcgccagatgggactggaacttcgacctgtacctgggctggttcgacccctggggccagggcacccccgtgaccgtggccagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgcgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35839 - RNA, 1356 nt, synthetic construct; identical to SEQ ID NO: 35837
  misc_feature 1..1356: note = derived and/or modified sequence opt4 from anti-influenza_Chain
  source 1..1356: mol_type = other RNA

SEQ ID NO: 35840 - RNA, 1356 nt, synthetic construct; identical to SEQ ID NO: 35836
  misc_feature 1..1356: note = derived and/or modified sequence opt4 from anti-influenza_Chain
  source 1..1356: mol_type = other RNA

SEQ ID NO: 35841 - RNA, 1356 nt, synthetic construct; identical to SEQ ID NO: 35838
  misc_feature 1..1356: note = derived and/or modified sequence opt4 from anti-influenza_Chain
  source 1..1356: mol_type = other RNA

SEQ ID NO: 35842 - RNA, 1359 nt, synthetic construct
  misc_feature 1..1359: note = derived and/or modified sequence opt4 from anti-influenza_Chain
  source 1..1359: mol_type = other RNA
caggtgcagctggtgcagagcggcgccgaggtgaagaagcccggcagcagcgtgagagtgagctgcaaggccagcggcagcatcttcagaaactacgccatgagctgggtgagacaggcccccggccagggcctggagtggatgggcggcatcatcgccatcttcggcacccccaagtacgcccagaagttccagggcagagtgaccatcaccgccgacgagagcaccagcaccgtgtacatggagctgagcggcctgagaagcgaggacaccgccatgtactactgcgccagaatcccccactacaacttcggcagcggcagctacttcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35843 - RNA, 1359 nt, synthetic construct
  misc_feature 1..1359: note = derived and/or modified sequence opt4 from anti-influenza_Chain
  source 1..1359: mol_type = other RNA
caggtgcagctggtgcagagcggcgccgaggtgaagaagcccggcgccagcgtgaaggtgagctgcaaggccagcggctacatcttcaccggctactacatccactgggtgagacaggcccccggccagggcctggagtggatgggcagaatcgaccccaacggcagcggcaccacctacgcccagaagttccagggcagagtgaccctgaccatggacaccagcatcaccaccgcctacatggagctgagcagactgagattcgacgacaccgccatctactactgcgccagatgggactggaacttcgacctgtacctgggctggttcgacccctggggccagggcacccccgtgaccgtggccagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35844 - RNA, 1359 nt, synthetic construct
  misc_feature 1..1359: note = derived and/or modified sequence opt4 from anti-influenza_Chain
  source 1..1359: mol_type = other RNA
gaggtgcagctggtgcagagcggcgccgaggtgaagaagcccggcgccagcgtgaaggtgagctgcaaggccagcggctacatcttcaccggctactacatccactgggtgagacaggcccccggccagggcctggagtggatgggcagaatcgaccccaacggcgccggcaccacctacgcccagaagttccagggcagagtgaccctgaccatggacaccagcatcaccaccgcctacatggagctgagcagactgagattcgacgacaccgccatctactactgcgccagatgggactggaacttcgacctgtacctgggctggttcgacccctggggccagggcacccccgtgaccgtggccagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35845 - RNA, 1359 nt, synthetic construct
  misc_feature 1..1359: note = derived and/or modified sequence opt4 from anti-influenza_Chain
  source 1..1359: mol_type = other RNA
caggtgcagctggtgcagagcggcgccgaggtgaagaagcccggcgccagcgtgaaggtgagctgcaaggccagcggctacaccttcaacgcccaccacatgcactgggtgagacaggcccccggccagggcctgggctggatgggctggatcgaccccaacaacgacggcaccatctacgcccagaagttccagggcagagtgaccctgaccatggacaccagcatccacaccgcctacatggagctgagcggcctgagatacgacgacaccgccatctactactgcgtgagatgggcctggaacttcgacttcttcctgggctggttcgacccctggggccagggcaccctggtgaccgtggccagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35846 - RNA, 1359 nt, synthetic construct
  misc_feature 1..1359: note = derived and/or modified sequence opt4 from anti-influenza_Chain
  source 1..1359: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacagcgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35847 - RNA, 1359 nt, synthetic construct
  misc_feature 1..1359: note = derived and/or modified sequence opt4 from anti-influenza_Chain
  source 1..1359: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacgccgacgccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35848 - RNA, 1359 nt, synthetic construct; identical to SEQ ID NO: 31591
  misc_feature 1..1359: note = derived and/or modified sequence opt4 from anti-influenza_Chain
  source 1..1359: mol_type = other RNA

SEQ ID NO: 35849 - RNA, 1359 nt, synthetic construct
  misc_feature 1..1359: note = derived and/or modified sequence opt4 from anti-influenza_Chain
  source 1..1359: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacgccgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35850 - RNA, 1359 nt, synthetic construct
  misc_feature 1..1359: note = derived and/or modified sequence opt4 from anti-influenza_Chain
  source 1..1359: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcagcagcgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35851 - RNA, 1359 nt, synthetic construct
  misc_feature 1..1359: note = derived and/or modified sequence opt4 from anti-influenza_Chain
  source 1..1359: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacagcgacgccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35852 - RNA, 1359 nt, synthetic construct
  misc_feature 1..1359: note = derived and/or modified sequence opt4 from anti-influenza_Chain
  source 1..1359: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgacaccgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35853 - RNA, 1359 nt, synthetic construct
  misc_feature 1..1359: note = derived and/or modified sequence opt4 from anti-influenza_Chain
  source 1..1359: mol_type = other RNA
gaggtgcagctggtgcagagcggcgccgaggtgaagaagcccggcgagagcctgaagatcagctgcaaggtgagcggctacagcttcaccagccagtggatcggctgggtgagacagatgcccggcaagggcctggagtggatcggcatgatgtaccccggcgagagcgacaccatctacagccccagcttccagggccaggtgaccatcagcgccgacaacagcatcagcaccgcctacctgcagtggagcagcctgaaggccagcgacaccgccatctactactgcgccagcggccccggctacagcggctaccactacggctggttcgacacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35854 - RNA, 1359 nt, synthetic construct; identical to SEQ ID NO: 35842
  misc_feature 1..1359: note = derived and/or modified sequence opt4 from anti-influenza_Chain
  source 1..1359: mol_type = other RNA

SEQ ID NO: 35855 - RNA, 1359 nt, synthetic construct; identical to SEQ ID NO: 35843
  misc_feature 1..1359: note = derived and/or modified sequence opt4 from anti-influenza_Chain
  source 1..1359: mol_type = other RNA

SEQ ID NO: 35856 - RNA, 1359 nt, synthetic construct; identical to SEQ ID NO: 35844
  misc_feature 1..1359: note = derived and/or modified sequence opt4 from anti-influenza_Chain
  source 1..1359: mol_type = other RNA

SEQ ID NO: 35857 - RNA, 1359 nt, synthetic construct; identical to SEQ ID NO: 35845
  misc_feature 1..1359: note = derived and/or modified sequence opt4 from anti-influenza_Chain
  source 1..1359: mol_type = other RNA

SEQ ID NO: 35858 - RNA, 1359 nt, synthetic construct; identical to SEQ ID NO: 35846
  misc_feature 1..1359: note = derived and/or modified sequence opt4 from anti-influenza_Chain
  source 1..1359: mol_type = other RNA

SEQ ID NO: 35859 - RNA, 1359 nt, synthetic construct; identical to SEQ ID NO: 35847
  misc_feature 1..1359: note = derived and/or modified sequence opt4 from anti-influenza_Chain
  source 1..1359: mol_type = other RNA

SEQ ID NO: 35860 - RNA, 1359 nt, synthetic construct; identical to SEQ ID NO: 31591
  misc_feature 1..1359: note = derived and/or modified sequence opt4 from anti-influenza_Chain
  source 1..1359: mol_type = other RNA

SEQ ID NO: 35861 - RNA, 1359 nt, synthetic construct; identical to SEQ ID NO: 35849
  misc_feature 1..1359: note = derived and/or modified sequence opt4 from anti-influenza_Chain
  source 1..1359: mol_type = other RNA

SEQ ID NO: 35862 - RNA, 1359 nt, synthetic construct; identical to SEQ ID NO: 35850
  misc_feature 1..1359: note = derived and/or modified sequence opt4 from anti-influenza_Chain
  source 1..1359: mol_type = other RNA

SEQ ID NO: 35863 - RNA, 1359 nt, synthetic construct; identical to SEQ ID NO: 35851
  misc_feature 1..1359: note = derived and/or modified sequence opt4 from anti-influenza_Chain
  source 1..1359: mol_type = other RNA

SEQ ID NO: 35864 - RNA, 1359 nt, synthetic construct; identical to SEQ ID NO: 35852
  misc_feature 1..1359: note = derived and/or modified sequence opt4 from anti-influenza_Chain
  source 1..1359: mol_type = other RNA

SEQ ID NO: 35865 - RNA, 1359 nt, synthetic construct; identical to SEQ ID NO: 35853
  misc_feature 1..1359: note = derived and/or modified sequence opt4 from anti-influenza_Chain
  source 1..1359: mol_type = other RNA

SEQ ID NO: 35866 - RNA, 1365 nt, synthetic construct
  misc_feature 1..1365: note = derived and/or modified sequence opt4 from anti-influenza_Chain
  source 1..1365: mol_type = other RNA
caggtgcagctggtggagagcggcggcggcgtggtgcagcccggcagaagcctgagactgagctgcgccgccagcggcttcgccttccacaacagagccatgcactgggtgagacaggcccccggcaagggcctggagtgggtggccctgatctacttcgacggcagcaagcagtactacgccgacagcgtgaagggcagattcaccatcagcagagacaacagcaagaacaccgtgttcctgcagatgaacagcctgagacccgaggacaccgccgtgtactactgcgccgtgcccggccccatcttcggcatcttccccccctggagctacttcgaccactggggccagggcatcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35867 - RNA, 1365 nt, synthetic construct
  misc_feature 1..1365: note = derived and/or modified sequence opt4 from anti-influenza_Chain
  source 1..1365: mol_type = other RNA
gaggtgcagctggtggagagcggcggcggcgtggtgcagcccggcagaagcctgagactgagctgcgccgccagcggcttcgccttccacaacagagccatgcactgggtgagacaggcccccggcaagggcctggagtgggtggccctgatctacttcgacggcagcaagcagtactacgccgacagcgtgaagggcagattcaccatcagcagagacaacagcaagaacaccgtgttcctgcagatgaacagcctgagacccgaggacaccgccgtgtactactgcgccgtgcccggccccatcttcggcatcttccccccctggagctacttcgaccactggggccagggcatcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35868 - RNA, 1365 nt, synthetic construct
  misc_feature 1..1365: note = derived and/or modified sequence opt4 from anti-influenza_Chain
  source 1..1365: mol_type = other RNA
gaggtgcagctggtgcagagcggcggcggcgtggtgcagcccggcaagagcctgagactgagctgcgccgccagcggcctgaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35869 - RNA, 1365 nt, synthetic construct
  misc_feature 1..1365: note = derived and/or modified sequence opt4 from anti-influenza_Chain
  source 1..1365: mol_type = other RNA
caggtgcagctggtggagagcggcggcggcgtggtgcagcccggcaagagcctgagactgagctgcgccgccagcggcctgaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35870 - RNA, 1365 nt, synthetic construct
  misc_feature 1..1365: note = derived and/or modified sequence opt4 from anti-influenza_Chain
  source 1..1365: mol_type = other RNA
caggtgcagctggtggagagcggcggcggcgtggtgcagcccggcaagagccccagactgagctgcgccgccagcggccccaccttcagcagctacgccgtgcactgggtgagacaggcccccggcaagggcctggagtgggtgaccctgatcagctacgacggcgccaaccagtactacgccgacagcgtgaagggcagattcaccatcagcagagacaacagcaagaacaccgtgtacctgcagatgaacagcctgagacccgaggacaccgccgtgtactactgcgccgtgcccggccccgtgttcggcatcttccccccctggagctacttcgacaactggggccagggcatcctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35871 - RNA, 1365 nt, synthetic construct; identical to SEQ ID NO: 31575
  misc_feature 1..1365: note = derived and/or modified sequence opt4 from anti-influenza_Chain
  source 1..1365: mol_type = other RNA

SEQ ID NO: 35872 - RNA, 1365 nt, synthetic construct
  misc_feature 1..1365: note = derived and/or modified sequence opt4 from anti-influenza_Chain
  source 1..1365: mol_type = other RNA
caggtgcagctggtgcagagcggcgccgagctgaagagacccggcgccagcgtgaaggtgagctgcaagaccagcggctacagcttcaacaactacggcatcaactgggtgagacaggcccccggccagggcctggagtggatgggctggatcagcgcctacaccggcaacacccactacgccaagaacttcgagggcagagtgaccctgaccaccgacaccagcaccagcaccgcctacatggaggtgagaagcctgagaagcgacgacagcgccgtgtacttctgcgccagagccatgatccagggcgtggtgaccctgtacctgagacccggcgactactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35873 - RNA, 1365 nt, synthetic construct; identical to SEQ ID NO: 35866
  misc_feature 1..1365: note = derived and/or modified sequence opt4 from anti-influenza_Chain
  source 1..1365: mol_type = other RNA

SEQ ID NO: 35874 - RNA, 1365 nt, synthetic construct; identical to SEQ ID NO: 35867
  misc_feature 1..1365: note = derived and/or modified sequence opt4 from anti-influenza_Chain
  source 1..1365: mol_type = other RNA

SEQ ID NO: 35875 - RNA, 1365 nt, synthetic construct; identical to SEQ ID NO: 35868
  misc_feature 1..1365: note = derived and/or modified sequence opt4 from anti-influenza_Chain
  source 1..1365: mol_type = other RNA

SEQ ID NO: 35876 - RNA, 1365 nt, synthetic construct; identical to SEQ ID NO: 35869
  misc_feature 1..1365: note = derived and/or modified sequence opt4 from anti-influenza_Chain
  source 1..1365: mol_type = other RNA

SEQ ID NO: 35877 - RNA, 1365 nt, synthetic construct; identical to SEQ ID NO: 35870
  misc_feature 1..1365: note = derived and/or modified sequence opt4 from anti-influenza_Chain
  source 1..1365: mol_type = other RNA

SEQ ID NO: 35878 - RNA, 1365 nt, synthetic construct; identical to SEQ ID NO: 31575
  misc_feature 1..1365: note = derived and/or modified sequence opt4 from anti-influenza_Chain
  source 1..1365: mol_type = other RNA

SEQ ID NO: 35879 - RNA, 1365 nt, synthetic construct; identical to SEQ ID NO: 35872
  misc_feature 1..1365: note = derived and/or modified sequence opt4 from anti-influenza_Chain
  source 1..1365: mol_type = other RNA

SEQ ID NO: 35880 - RNA, 1368 nt, synthetic construct
  misc_feature 1..1368: note = derived and/or modified sequence opt4 from anti-influenza_Chain
  source 1..1368: mol_type = other RNA
gaggtgcagctggtgcagagcggcggcggcgtggtgcagcccagaagaagcctgagactgagctgcgccgccagcggcttcaccttcagcagctacgccatgcactgggtgagacaggcccccggcaagggcctggagtgggtggccgtgatcagctacgacggcagaaacaagtactacgccgacagcgtgaagggcagattcaccgtgagcagagacaacagcaagaacaccctgtacctgcagatgaacagcctgagagccgaggacaccagcgtgtactactgcgccagagagctgctgatggactactacgaccacatcggctacagccccggccccacctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35881 - RNA, 1371 nt, synthetic construct
  misc_feature 1..1371: note = derived and/or modified sequence opt4 from anti-influenza_Chain
  source 1..1371: mol_type = other RNA
atggtgatccagagaaacagcatcctgctgctgatcatcatcttcgccagcagcatcagcacctgcagaagcaacgtgatcgacgacaacctgttcaagcaggtgtacgacaacatcctggagcaggagttcgcccacgacttccaggcctacctgagctacctgagcaagaacatcgagagcaacaacaacatcgacaaggtggacaagaacggcatcaaggtgatcaacgtgctgagcttcggcgccaagggcgacggcaagacctacgacaacatcgccttcgagcaggcctggaacgaggcctgcagcagcagaacccccgtgcagttcgtggtgcccaagaacaagaactacctgctgaagcagatcaccttcagcggcccctgcagaagcagcatcagcgtgaagatcttcggcagcctggaggccagcagcaagatcagcgactacaaggacagaagactgtggatcgccttcgacagcgtgcagaacctggtggtgggcggcggcggcaccatcaacggcaacggccaggtgtggtggcccagcagctgcaagatcaacaagagcctgccctgcagagacgcccccaccgccctgaccttctggaactgcaagaacctgaaggtgaacaacctgaagagcaagaacgcccagcagatccacatcaagttcgagagctgcaccaacgtggtggccagcaacctgatgatcaacgccagcgccaagagccccaacaccgacggcgtgcacgtgagcaacacccagtacatccagatcagcgacaccatcatcggcaccggcgacgactgcatcagcatcgtgagcggcagccagaacgtgcaggccaccaacatcacctgcggccccggccacggcatcagcatcggcagcctgggcagcggcaacagcgaggcctacgtgagcaacgtgaccgtgaacgaggccaagatcatcggcgccgagaacggcgtgagaatcaagacctggcagggcggcagcggccaggccagcaacatcaagttcctgaacgtggagatgcaggacgtgaagtaccccatcatcatcgaccagaactactgcgacagagtggagccctgcatccagcagttcagcgccgtgcaggtgaagaacgtggtgtacgagaacatcaagggcaccagcgccaccaaggtggccatcaagttcgactgcagcaccaacttcccctgcgagggcatcatcatggagaacatcaacctggtgggcgagagcggcaagcccagcgaggccacctgcaagaacgtgcacttcaacaacgccgagcacgtgaccccccactgcaccagcctggagatcagcgaggacgaggccctgctgtacaactac

SEQ ID NO: 35882 - RNA, 1371 nt, synthetic construct; identical to SEQ ID NO: 35881
  misc_feature 1..1371: note = derived and/or modified sequence opt4 from anti-influenza_Chain
  source 1..1371: mol_type = other RNA

SEQ ID NO: 35883 - RNA, 1380 nt, synthetic construct
  misc_feature 1..1380: note = derived and/or modified sequence opt4 from anti-influenza_Chain
  source 1..1380: mol_type = other RNA
atgaagctgtggctgaactggatcttcctggtgaccctgctgaacgacatccagtgcgaggtgaagctggtggagagcggcggcggcctggtgcagcccggcggcagcctgagactgagctgcgccaccagcggcttcaccttcagcgactactacatgagctgggtgagacagagccccggcaaggccctggagtggctgggcttcaccagaagcagagtgctgggctacaccaccgactacagcgccagcgtgaagggcagattcaccatcagcagagacaacagccagagcatcctgtacctgcagatgaacagcctgagaggcgaggacagcgccacctactactgcgccagagacagacccatggactactggggccagggcaccagcgtgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagcacctggcccagcgagaccgtgacctgcaacgtggcccaccccgccagcagcaccaaggtggacaagaagatcgtgcccagagactgcggctgcaagccctgcatctgcaccgtgcccgaggtgagcagcgtgttcatcttcccccccaagcccaaggacgtgctgaccatcaccctgacccccaaggtgacctgcgtggtggtggacatcagcaaggacgaccccgaggtgcagttcagctggttcgtggacgacgtggaggtgcacaccgcccagacccagcccagagaggagcagttcaacagcaccttcagaagcgtgagcgagctgcccatcatgcaccaggactggctgaacggcaaggagttcaagtgcagagtgaacagcgccgccttccccgcccccatcgagaagaccatcagcaagaccaagggcagacccaaggccccccaggtgtacaccatccccccccccaaggagcagatggccaaggacaaggtgagcctgacctgcatgatcaccgacttcttccccgaggacatcaccgtggagtggcagtggaacggccagcccgccgagaactacaagaacacccagcccatcatggacaccgacggcagctacttcgtgtacagcaagctgaacgtgcagaagagcaactgggaggccggcaacaccttcacctgcagcgtgctgcacgagggcctgcacaaccaccacaccgagaagagcctgagccacagccccggcaag

SEQ ID NO: 35884 - RNA, 1380 nt, synthetic construct; identical to SEQ ID NO: 35883
  misc_feature 1..1380: note = derived and/or modified sequence opt4 from anti-influenza_Chain
  source 1..1380: mol_type = other RNA

SEQ ID NO: 35885 - RNA, 1386 nt, synthetic construct
  misc_feature 1..1386: note = derived and/or modified sequence opt4 from anti-influenza_Chain
  source 1..1386: mol_type = other RNA
atggagtggagctggatcttcctgttcctgctgagcggcaccgccggcgtgcacagcgaggtgcagctgcagcagagcggccccgagctggtgaagcccggcgccagcgtgaagatgagctgcaaggccagcggctacaccttcaccagctacgtgatgcactgggtgaagcagaagcccggccagggcctggagtggatcggctacatcaacccctacaacgacggcaccagatacaacgagaagttcagagtgaaggccaccctgaccagcgacaagagcagcagcaccgcctacatggagctgagcagcctgaccagcgaggacagcgccgtgtactactgcgccagaagaggcctgatcaccacccccaccctggactactggggccagggcaccaccctgaccgtgagcagcgccaagaccaccccccccagcgtgtaccccctggcccccggcagcgccgcccagaccaacagcatggtgaccctgggctgcctggtgaagggctacttccccgagcccgtgaccgtgacctggaacagcggcagcctgagcagcggcgtgcacaccttccccgccgtgctgcagagcgacctgtacaccctgagcagcagcgtgaccgtgcccagcagcacctggcccagcgagaccgtgacctgcaacgtggcccaccccgccagcagcaccaaggtggacaagaagatcgtgcccagagactgcggctgcaagccctgcatctgcaccgtgcccgaggtgagcagcgtgttcatcttcccccccaagcccaaggacgtgctgaccatcaccctgacccccaaggtgacctgcgtggtggtggacatcagcaaggacgaccccgaggtgcagttcagctgggtggacgacgtggaggtgcacaccgcccagacccagcccagagaggagcagttcaacagcaccttcagaagcgtgagcgagctgcccatcatgcaccaggactggctgaacggcaaggagttcaagtgcagagtgaacagcgccgccttccccgcccccatcgagaagaccatcagcaagaccaagggcagacccaaggccccccaggtgtacaccatccccccccccaaggagcagatggccaaggacaaggtgagcctgacctgcatgatcaccgacttcttccccgaggacatcaccgtggagtggcagtggaacggccagcccgccgagaactacaagaacacccagcccatcatggacaccgacggcagctacttcgtgtacagcaagctgaacgtgcagaagagcaactgggaggccggcaacaccttcacctgcagcgtgctgcacgagggcctgcacaaccaccacaccgagaagagcctgagccacagccccggcaag

SEQ ID NO: 35886 - RNA, 1386 nt, synthetic construct
  misc_feature 1..1386: note = derived and/or modified sequence opt4 from anti-influenza_Chain
  source 1..1386: mol_type = other RNA
caggtgcagctggtgcagagcggcgccgaggtgaagaagcccggcgccagcgtgaaggtgagctgcaagaccagcggctacaccttcaccgcctacaccatccactgggtgagacaggcccccggccagagactggagtggatgggctggatcaacgccggcaacggccacaccaagtacagccagagattcaagggcagagtgaccatcaccagagacaccagcgccagaaccacctacatggagctgagaagcctgaccagcgaggacaccgccctgtacttctgcgccagaggccccgagacctactactacgacaagaccaactggctgaacagccaccccgacgagtacttccagcactggggccacggcacccaggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35887 - RNA, 1386 nt, synthetic construct; identical to SEQ ID NO: 35886
  misc_feature 1..1386: note = derived and/or modified sequence opt4 from anti-influenza_Chain
  source 1..1386: mol_type = other RNA

SEQ ID NO: 35888 - RNA, 1386 nt, synthetic construct; identical to SEQ ID NO: 35885
  misc_feature 1..1386: note = derived and/or modified sequence opt4 from anti-influenza_Chain
  source 1..1386: mol_type = other RNA

SEQ ID NO: 35889 - RNA, 1398 nt, synthetic construct
  misc_feature 1..1398: note = derived and/or modified sequence opt4 from anti-influenza_Chain
  source 1..1398: mol_type = other RNA
atgctgcccagcaccgtgcagaccctgaccctgctgctgaccagcggcggcgtgctgctgagcctgtacgtgagcgccagcctgagctacctgctgtacagcgacgtgctgctgaagttcagcagcaccaagaccaccgcccccaccatgagcctggagtgcaccaacgccagcaacgcccagaccgtgaaccacagcgccaccaaggagatgaccttccccccccccgagcccgagtggacctaccccagactgagctgccagggcagcaccttccagaaggccctgctgatcagcccccacagattcggcgagatcaagggcaacagcgcccccctgatcatcagagagcccttcgtggcctgcggccccaaggagtgcagacacttcgccctgacccactacgccgcccagcccggcggctactacaacggcaccagaaaggacagaaacaagctgagacacctggtgagcgtgaagctgggcaagatccccaccgtggagaacagcatcttccacatggccgcctggagcggcagcgcctgccacgacggcagagagtggacctacatcggcgtggacggccccgacaacgacgccctggtgaagatcaagtacggcgaggcctacaccgacacctaccacagctacgcccacaacatcctgagaacccaggagagcgcctgcaactgcatcggcggcgactgctacctgatgatcaccgacggcagcgccagcggcatcagcaagtgcagattcctgaagatcagagagggcagaatcatcaaggagatcctgcccaccggcagagtggagcacaccgaggagtgcacctgcggcttcgccagcaacaagaccatcgagtgcgcctgcagagacaacagctacaccgccaagagacccttcgtgaagctgaacgtggagaccgacaccgccgagatcagactgatgtgcaccaagacctacctggacacccccagacccgacgacggcagcatcgccggcccctgcgagagcaacggcgacaagtggctgggcggcatcaagggcggcttcgtgcaccagagaatggccagcaagatcggcagatggtacagcagaaccatgagcaagaccaacagaatgggcatggagctgtacgtgaagtacgacggcgacccctggaccgacagcgacgccctgaccctgagcggcgtgatggtgagcatcgaggagcccggctggtacagcttcggcttcgagatcaaggacaagaagtgcgacgtgccctgcatcggcatcgagatggtgcacgacggcggcaaggacacctggcacagcgccgccaccgccatctactgcctgatgggcagcggccagctgctgtgggacaccgtgaccggcgtggacatggccctg

SEQ ID NO: 35890 - RNA, 1398 nt, synthetic construct; identical to SEQ ID NO: 35889
  misc_feature 1..1398: note = derived and/or modified sequence opt4 from anti-influenza_Chain
  source 1..1398: mol_type = other RNA

SEQ ID NO: 35891 - RNA, 1407 nt, synthetic construct
  misc_feature 1..1407: note = derived and/or modified sequence opt4 from anti-influenza_Chain
  source 1..1407: mol_type = other RNA
atggactggacctggagattcctgttcgtggtggccgccgccaccggcgtgcagagccaggtgcagctggtgcagagcggcgccgaggtgaagaagcccggcagcagcgtgaaggtgagctgcaaggccagcggcggcaccctgaacaactacgccatcagctgggtgagacaggcccccggccagggcctggagtggatgggcggcatcagccccatcttcggcaccctgaactacgccgagagattccagggcagagtgaccatcaccgccgacgtgttcaccaacaccgtgtacatggagctgagcagcctgagaagcgaggacaccgccgtgtacttctgcgccagaggctgcggctacaactgctactacttcgacggctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgagggcctgcacaaccactacacccagaagagcctgagcctgagccccggcaag

SEQ ID NO: 35892 - RNA, 1407 nt, synthetic construct; identical to SEQ ID NO: 35891
  misc_feature 1..1407: note = derived and/or modified sequence opt4 from anti-influenza_Chain
  source 1..1407: mol_type = other RNA

SEQ ID NO: 35893 - RNA, 1407 nt, synthetic construct; identical to SEQ ID NO: 35891
  misc_feature 1..1407: note = derived and/or modified sequence opt4 from anti-influenza_Chain
  source 1..1407: mol_type = other RNA

SEQ ID NO: 35894 - RNA, 1413 nt, synthetic construct
  misc_feature 1..1413: note = derived and/or modified sequence opt4 from anti-influenza_Chain
  source 1..1413: mol_type = other RNA
gacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggctacatccccgaggcccccagagacggccaggcctacgtgagaaaggacggcgagtgggtgctgctgagcaccttcctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35895 - RNA, 1413 nt, synthetic construct; identical to SEQ ID NO: 35894
  misc_feature 1..1413: note = derived and/or modified sequence opt4 from anti-influenza_Chain
  source 1..1413: mol_type = other RNA

SEQ ID NO: 35896 - RNA, 1416 nt, synthetic construct
  misc_feature 1..1416: note = derived and/or modified sequence opt4 from anti-influenza_Chain
  source 1..1416: mol_type = other RNA
atggactggacctggagattcctgttcgtggtggccgccgccaccggcgtgcagtgccaggtgcagctggtgcagagcggcgccgaggtgaagatgcccggcagcagcgtgaaggtgagctgcaagaccagcggcgtgttcttcagcagccacgccatcagctgggtgagacaggcccccggccagggcctggagtggatgggcggcatcagccccatgttcggcaccacccactacgcccagaagttccagggcagagtgaccatcaccgccgaccagagcaccaccaccgcctacatggagctgaccagcctgaccagcgaggacaccgccgtgtactactgcgccagagacggcgccggcagctactaccccctgaactggttcgacccctggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgagggcctgcacaaccactacacccagaagagcctgagcctgagccccggcaag

SEQ ID NO: 35897 - RNA, 1416 nt, synthetic construct; identical to SEQ ID NO: 35896
  misc_feature 1..1416: note = derived and/or modified sequence opt4 from anti-influenza_Chain
  source 1..1416: mol_type = other RNA

SEQ ID NO: 35898 - RNA, 1416 nt, synthetic construct; identical to SEQ ID NO: 35896
  misc_feature 1..1416: note = derived and/or modified sequence opt4 from anti-influenza_Chain
  source 1..1416: mol_type = other RNA

SEQ ID NO: 35899 - RNA, 1419 nt, synthetic construct
  misc_feature 1..1419: note = derived and/or modified sequence opt4 from anti-influenza_Chain
  source 1..1419: mol_type = other RNA
atgaccgagagcgccatgaccagcagagccggcagaggcagaggcgccgacctggtggccgccgtggtgcagggccacgccgccgccagcgacgccgccggcgacctgagcttccccgacggcttcatctggggcgccgccaccgccgcctaccagatcgagggcgcctggagagaggacggcagaggcctgtgggacgtgttcagccacacccccggcaaggtggccagcggccacaccggcgacatcgcctgcgaccactaccacagatacgccgacgacgtgagactgatggccggcctgggcgacagagtgtacagattcagcgtggcctggcccagaatcgtgcccgacggcagcggccccgtgaaccccgccggcctggacttctacgacagactggtggacgagctgctgggccacggcatcaccccctaccccaccctgtaccactgggacctgccccagaccctggaggacagaggcggctgggccgccagagacaccgcctacagattcgccgagtacgccctggccgtgcacagaagactgggcgacagagtgagatgctggatcaccctgaacgagccctgggtggccgccttcctggccacccacagaggcgcccccggcgccgccgacgtgcccagattcagagccgtgcaccacctgctgctgggccacggcctgggcctgagactgagaagcgccggcgccggccagctgggcctgaccctgagcctgagccccgtgatcgaggccagacccggcgtgagaggcggcggcagaagagtggacgccctggccaacagacagttcctggaccccgccctgagaggcagataccccgaggaggtgctgaagatcatggccggccacgccagactgggccaccccggcagagacctggagaccatccaccagcccgtggacctgctgggcgtgaactactacagccacgtgagactggccgccgagggcgagcccgccaacagactgcccggcagcgagggcatcagattcgagagacccaccgccgtgaccgcctggcccggcgacagacccgacggcctgagaaccctgctgctgagactgagcagagactaccccggcgtgggcctgatcatcaccgagaacggcgccgccttcgacgacagagccgacggcgacagagtgcacgaccccgagagaatcagatacctgaccgccaccctgagagccgtgcacgacgccatcatggccggcgccgacctgagaggctacttcgtgtggagcgtgctggacaacttcgagtgggcctacggctaccacaagagaggcatcgtgtacgtggactacaccaccatgagaagaatccccagagagagcgccctgtggtacagagacgtggtgagaagaaacggcctgagaaacggcgag

SEQ ID NO: 35900 - RNA, 1419 nt, synthetic construct; identical to SEQ ID NO: 35899
  misc_feature 1..1419: note = derived and/or modified sequence opt4 from anti-influenza_Chain
  source 1..1419: mol_type = other RNA

SEQ ID NO: 35901 - RNA, 1422 nt, synthetic construct
  misc_feature 1..1422: note = derived and/or modified sequence opt4 from anti-influenza_Chain
  source 1..1422: mol_type = other RNA
ctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctgggctacatccccgaggcccccagagacggccaggcctacgtgagaaaggacggcgagtgggtgctgctgagcaccttcctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35902 - RNA, 1422 nt, synthetic construct; identical to SEQ ID NO: 35901
  misc_feature 1..1422: note = derived and/or modified sequence opt4 from anti-influenza_Chain
  source 1..1422: mol_type = other RNA

SEQ ID NO: 35903 - RNA, 1428 nt, synthetic construct
  misc_feature 1..1428: note = derived and/or modified sequence opt4 from anti-influenza_Chain
  source 1..1428: mol_type = other RNA
atggagttcggcctgagctgggtgttcctggtggccctgctgagaggcgtgcagtgccaggtgcagctggtggagagcggcggcggcgtggtgcagcccggcagaagcctgagactgagctgcgccgccagcggcttcaccttcagcagattcggcatccactgggtgagacaggcccccggcaagggcctggagtggatggccgtgatctggtacgacggcagcaacaagttctacgccgacagcgtgaagggcagattcaccatcagcagagacaacagcaagaacaccgtgtacctgcagatgaacagcctgagagccgaggacaccgccgtgtactactgcgccaaggacagcagaggctactgcagcagcatcatctgcttcgagggcggcctggacaactggggccagggcaccctggtgaccgtgagcagcgccagcaccaagggccccagcgtgttccccctggcccccagcagcaagagcaccagcggcggcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtggagcccaagagctgcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgagggcctgcacaaccactacacccagaagagcctgagcctgagccccggcaag

SEQ ID NO: 35904 - RNA, 1428 nt, synthetic construct; identical to SEQ ID NO: 35903
  misc_feature 1..1428: note = derived and/or modified sequence opt4 from anti-influenza_Chain
  source 1..1428: mol_type = other RNA

SEQ ID NO: 35905 - RNA, 1428 nt, synthetic construct; identical to SEQ ID NO: 35903
  misc_feature 1..1428: note = derived and/or modified sequence opt4 from anti-influenza_Chain
  source 1..1428: mol_type = other RNA

SEQ ID NO: 35906 - RNA, 1440 nt, synthetic construct
  misc_feature 1..1440: note = derived and/or modified sequence opt4 from anti-influenza_Chain
  source 1..1440: mol_type = other RNA
atgcccagcgtgaagatcggcatcatcggcgccggcagcgccgtgttcagcctgagactggtgagcgacctgtgcaagacccccggcctgagcggcagcaccgtgaccctgatggacatcgacgaggagagactggacgccatcctgaccatcgccaagaagtacgtggaggaggtgggcgccgacctgaagttcgagaagaccatgaacctggacgacgtgatcatcgacgccgacttcgtgatcaacaccgccatggtgggcggccacacctacctggagaaggtgagacagatcggcgagaagtacggctactacagaggcatcgacgcccaggagttcaacatggtgagcgactactacaccttcagcaactacaaccagctgaagtacttcgtggacatcgccagaaagatcgagaagctgagccccaaggcctggtacctgcaggccgccaaccccatcttcgagggcaccaccctggtgaccagaaccgtgcccatcaaggccgtgggcttctgccacggccactacggcgtgatggagatcgtggagaagctgggcctggaggaggagaaggtggactggcaggtggccggcgtgaaccacggcatctggctgaacagattcagatacaacggcggcaacgcctaccccctgctggacaagtggatcgaggagaagagcaaggactggaagcccgagaaccccttcaacgaccagctgagccccgccgccatcgacatgtacagattctacggcgtgatgcccatcggcgacaccgtgagaaacagcagctggagataccacagagacctggagaccaagaagaagtggtacggcgagccctggggcggcgccgacagcgagatcggctggaagtggtaccaggacaccctgggcaaggtgaccgagatcaccaagaaggtggccaagttcatcaaggagaaccccagcgtgagactgagcgacctgggcagcgtgctgggcaaggacctgagcgagaagcagttcgtgctggaggtggagaagatcctggaccccgagagaaagagcggcgagcagcacatccccttcatcgacgccctgctgaacgacaacaaggccagattcgtggtgaacatccccaacaagggcatcatccacggcatcgacgacgacgtggtggtggaggtgcccgccctggtggacaagaacggcatccaccccgagaagatcgagccccccctgcccgacagagtggtgaagtactacctgagacccagaatcatgagaatggagatggccctggaggccttcctgaccggcgacatcagaatcatcaaggagctgctgtacagagaccccagaaccaagagcgacgagcaggtggagaaggtgatcgaggagatcctggccctgcccgagaacgaggagatgagaaagcactacctgaagaga

SEQ ID NO: 35907 - RNA, 1440 nt, synthetic construct; identical to SEQ ID NO: 35906
  misc_feature 1..1440: note = derived and/or modified sequence opt4 from anti-influenza_Chain
  source 1..1440: mol_type = other RNA

SEQ ID NO: 35908 - RNA, 1443 nt, synthetic construct
  misc_feature 1..1443: note = derived and/or modified sequence opt4 from anti-influenza_Chain
  source 1..1443: mol_type = other RNA
atgaagttccccaaggacttcatgatcggctacagcagcagccccttccagttcgaggccggcatccccggcagcgaggaccccaacagcgactggtgggtgtgggtgcacgaccccgagaacaccgccgccggcctggtgagcggcgacttccccgagaacggccccggctactggaacctgaaccagaacgaccacgacctggccgagaagctgggcgtgaacaccatcagagtgggcgtggagtggagcagaatcttccccaagcccaccttcaacgtgaaggtgcccgtggagagagacgagaacggcagcatcgtgcacgtggacgtggacgacaaggccgtggagagactggacgagctggccaacaaggaggccgtgaaccactacgtggagatgtacaaggactgggtggagagaggcagaaagctgatcctgaacctgtaccactggcccctgcccctgtggctgcacaaccccatcatggtgagaagaatgggccccgacagagcccccagcggctggctgaacgaggagagcgtggtggagttcgccaagtacgccgcctacatcgcctggaagatgggcgagctgcccgtgatgtggagcaccatgaacgagcccaacgtggtgtacgagcagggctacatgttcgtgaagggcggcttcccccccggctacctgagcctggaggccgccgacaaggccagaagaaacatgatccaggcccacgccagagcctacgacaacatcaagagattcagcaagaagcccgtgggcctgatctacgccttccagtggttcgagctgctggagggccccgccgaggtgttcgacaagttcaagagcagcaagctgtactacttcaccgacatcgtgagcaagggcagcagcatcatcaacgtggagtacagaagagacctggccaacagactggactggctgggcgtgaactactacagcagactggtgtacaagatcgtggacgacaagcccatcatcctgcacggctacggcttcctgtgcacccccggcggcatcagccccgccgagaacccctgcagcgacttcggctgggaggtgtaccccgagggcctgtacctgctgctgaaggagctgtacaacagatacggcgtggacctgatcgtgaccgagaacggcgtgagcgacagcagagacgccctgagacccgcctacctggtgagccacgtgtacagcgtgtggaaggccgccaacgagggcatccccgtgaagggctacctgcactggagcctgaccgacaactacgagtgggcccagggcttcagacagaagttcggcctggtgatggtggacttcaagaccaagaagagatacctgagacccagcgccctggtgttcagagagatcgccacccacaacggcatccccgacgagctgcagcacctgaccctgatccag

SEQ ID NO: 35909 - RNA, 1443 nt, synthetic construct; identical to SEQ ID NO: 35908
  misc_feature 1..1443: note = derived and/or modified sequence opt4 from anti-influenza_Chain
  source 1..1443: mol_type = other RNA

SEQ ID NO: 35910 - RNA, 1464 nt, synthetic construct
  misc_feature 1..1464: note = derived and/or modified sequence opt4 from anti-influenza_Chain
  source 1..1464: mol_type = other RNA
cacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggctacatccccgaggcccccagagacggccaggcctacgtgagaaaggacggcgagtgggtgctgctgagcaccttcctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35911 - RNA, 1464 nt, synthetic construct; identical to SEQ ID NO: 35910
  misc_feature 1..1464: note = derived and/or modified sequence opt4 from anti-influenza_Chain
  source 1..1464: mol_type = other RNA

SEQ ID NO: 35912 - RNA, 1473 nt, synthetic construct
  misc_feature 1..1473: note = derived and/or modified sequence opt4 from anti-influenza_Chain
  source 1..1473: mol_type = other RNA
atgctgagcttccccaagggcttcaagttcggctggagccagagcggcttccagagcgagatgggcacccccggcagcgaggaccccaacagcgactggcacgtgtgggtgcacgacagagagaacatcgtgagccaggtggtgagcggcgacctgcccgagaacggccccggctactggggcaactacaagagattccacgacgaggccgagaagatcggcctgaacgccgtgagaatcaacgtggagtggagcagaatcttccccagacccctgcccaagcccgagatgcagaccggcaccgacaaggagaacagccccgtgatcagcgtggacctgaacgagagcaagctgagagagatggacaactacgccaaccacgaggccctgagccactacagacagatcctggaggacctgagaaacagaggcttccacatcgtgctgaacatgtaccactggaccctgcccatctggctgcacgaccccatcagagtgagaagaggcgacttcaccggccccaccggctggctgaacagcagaaccgtgtacgagttcgccagattcagcgcctacgtggcctggaagctggacgacctggccagcgagtacgccaccatgaacgagcccaacgtggtgtggggcgccggctacgccttccccagagccggcttcccccccaactacctgagcttcagactgagcgagatcgccaagtggaacatcatccaggcccacgccagagcctacgacgccatcaagagcgtgagcaagaagagcgtgggcatcatctacgccaacaccagctactaccccctgagaccccaggacaacgaggccgtggagatcgccgagagactgaacagatggagcttcttcgacagcatcatcaagggcgagatcaccagcgagggccagaacgtgagagaggacctgagaaacagactggactggatcggcgtgaactactacaccagaaccgtggtgaccaaggccgagagcggctacctgaccctgcccggctacggcgacagatgcgagagaaacagcctgagcctggccaacctgcccaccagcgacttcggctgggagttcttccccgagggcctgtacgacgtgctgctgaagtactggaacagatacggcctgcccctgtacgtgatggagaacggcatcgccgacgacgccgactaccagagaccctactacctggtgagccacatctaccaggtgcacagagccctgaacgagggcgtggacgtgagaggctacctgcactggagcctggccgacaactacgagtggagcagcggcttcagcatgagattcggcctgctgaaggtggactacctgaccaagagactgtactggagacccagcgccctggtgtacagagagatcaccagaagcaacggcatccccgaggagctggagcacctgaacagagtgccccccatcaagcccctgagacac

SEQ ID NO: 35913 - RNA, 1473 nt, synthetic construct; identical to SEQ ID NO: 35912
  misc_feature 1..1473: note = derived and/or modified sequence opt4 from anti-influenza_Chain
  source 1..1473: mol_type = other RNA

SEQ ID NO: 35914 - RNA, 1494 nt, synthetic construct
  misc_feature 1..1494: note = derived and/or modified sequence opt4 from anti-influenza_Chain
  source 1..1494: mol_type = other RNA
atggccagccagggcaccaagagaagctacgagcagatggagaccgacggcgagagacagaacgccaccgagatcagagccagcgtgggcaagatgatcggcggcatcggcagattctacatccagatgtgcaccgagctgaagctgagcgactacgagggcagactgatccagaacagcctgaccatcgagagaatggtgctgagcgccttcgacgagagaagaaacaagtacctggaggagcaccccagcgccggcaaggaccccaagaagaccggcggccccatctacagaagagtgaacggcaagtggatgagagagctgatcctgtacgacaaggaggagatcagaagaatctggagacaggccaacaacggcgacgacgccaccgccggcctgacccacatgatgatctggcacagcaacctgaacgacgccacctaccagagaaccagagccctggtgagaaccggcatggaccccagaatgtgcagcctgatgcagggcagcaccctgcccagaagaagcggcgccgccggcgccgccgtgaagggcgtgggcaccatggtgatggagctggtgagaatgatcaagagaggcatcaacgacagaaacttctggagaggcgagaacggcagaaagaccagaatcgcctacgagagaatgtgcaacatcctgaagggcaagttccagaccgccgcccagaaggccatgatggaccaggtgagagagagcagagaccccggcaacgccgagttcgaggacctgaccttcctggccagaagcgccctgatcctgagaggcagcgtggcccacaagagctgcctgcccgcctgcgtgtacggccccgccgtggccagcggctacgacttcgagagagagggctacagcctggtgggcatcgaccccttcagactgctgcagaacagccaggtgtacagcctgatcagacccaacgagaaccccgcccacaagagccagctggtgtggatggcctgccacagcgccgccttcgaggacctgagagtgctgagcttcatcaagggcaccaaggtggtgcccagaggcaagctgagcaccagaggcgtgcagatcgccagcaacgagaacatggagaccatggagagcagcaccctggagctgagaagcagatactgggccatcagaaccagaagcggcggcaacaccaaccagcagagagccagcgccggccagatcagcatccagcccaccttcagcgtgcagagaaacctgcccttcgacagaaccaccgtgatggccgccttcaccggcaacaccgagggcagaaccagcgacatgagaaccgagatcatcagaatgatggagagcgccagacccgaggacgtgagcttccagggcagaggcgtgttcgagctgagcgacgagaaggccgccagccccatcgtgcccagcttcgacatgagcaacgagggcagctacttcttcggcgacaacgccgaggagtacgacaac

SEQ ID NO: 35915 - RNA, 1494 nt, synthetic construct
  misc_feature 1..1494: note = derived and/or modified sequence opt4 from anti-influenza_Chain
  source 1..1494: mol_type = other RNA
atggccagccagggcaccaagagaagctacgagcagatggagaccgacggcgagagacagaacgccaccgagatcagagccagcgtgggcaagatgatcgacggcatcggcagattctacatccagatgtgcaccgagctgaagctgagcgactacgagggcagactgatccagaacagcctgaccatcgagagaatggtgctgagcgccttcgacgagagaagaaacaagtacctggaggagcaccccagcgccggcaaggaccccaagaagaccggcggccccatctacaagagagtggacggcaagtggatgagagagctggtgctgtacgacaaggaggagatcagaagaatctggagacaggccaacaacggcgacgacgccaccgccggcctgacccacatgatgatctggcacagcaacctgaacgacaccacctaccagagaaccagagccctggtgagaaccggcatggaccccagaatgtgcagcctgatgcagggcagcaccctgcccagaagaagcggcgccgccggcgccgccgtgaagggcgtgggcaccatggtgatggagctgatcagaatgatcaagagaggcatcaacgacagaaacttctggagaggcgagaacggcagaaagaccagaagcgcctacgagagaatgtgcaacatcctgaagggcaagttccagaccgccgcccagagagccatgatggaccaggtgagagagagcagaaaccccggcaacgccgagatcgaggacctgatcttcctggccagaagcgccctgatcctgagaggcagcgtggcccacaagagctgcctgcccgcctgcgtgtacggccccgccatcgccagcggctacaacttcgagaaggagggctacagcctggtgggcatcgaccccttcaagctgctgcagaacagccaggtgtacagcctgatcagacccaacgagaaccccgcccacaagagccagctggtgtggatggcctgcaacagcgccgccttcgaggacctgagagtgctgagcttcatcagaggcaccaaggtgagccccagaggcaagctgagcaccagaggcgtgcagatcgccagcaacgagaacatggacaccatggagagcagcaccctggagctgagaagcagatactgggccatcagaaccagaagcggcggcaacaccaaccagcagagagccagcgccggccagatcagcgtgcagcccgccttcagcgtgcagagaaacctgcccttcgacaagcccaccatcatggccgccttcaccggcaacaccgagggcagaaccagcgacatgagagccgagatcatcagaatgatggagggcgccaagcccgaggagatgagcttccagggcagaggcgtgttcgagctgagcgacgagaaggccaccaaccccatcgtgcccagcttcgacatgagcaacgagggcagctacttcttcggcgacaacgccgaggagtacgacaac

SEQ ID NO: 35916 - RNA, 1494 nt, synthetic construct
  misc_feature 1..1494: note = derived and/or modified sequence opt4 from anti-influenza_Chain
  source 1..1494: mol_type = other RNA
atggccagccagggcaccaagagaagctacgagcagatggagaccggcggcgagagacagaacgccaccgagatcagagccagcgtgggcagaatggtgggcggcatcggcagattctacgtgcagatgtgcaccgagctgaagctgagcgaccaggagggcagactgatccagaacagcatcaccatcgagagaatggtgctgagcgccttcgacgagagaagaaacagatacctggaggagcaccccagcgccggcaaggaccccaagaagaccggcggccccatctacagaagaagagacggcaagtgggtgagagagctgatcctgtacgacaaggaggagatcagaagaatctggagacaggccaacaacggcgaggacgccaccgccggcctgacccacatgatgatctggcacagcaacctgaacgacgccacctaccagagaaccagagccctggtgagaaccggcatggaccccagaatgtgcagcctgatgcagggcagcaccctgcccagaagaagcggcgccgccggcgccgccatcaagggcgtgggcaccatggtgatggagctgatcagaatgatcaagagaggcatcaacgacagaaacttctggagaggcgacaacggcagaagaaccagaatcgcctacgagagaatgtgcaacatcctgaagggcaagttccagaccgccgcccagagagccatgatggaccaggtgagagagagcagaaaccccggcaacgccgagatcgaggacctgatcttcctggccagaagcgccctgatcctgagaggcagcgtggcccacaagagctgcctgcccgcctgcgtgtacggcctggccgtggccagcggctacgacttcgagagagagggctacagcctggtgggcatcgaccccttcagactgctgcagaacagccaggtgttcagcctgatcagacccaacgagaaccccgcccacaagagccagctggtgtggatggcctgccacagcgccgccttcgaggacctgagagtgagcagcttcatcagaggcaccagagtgatccccagaggccagctgagcaccagaggcgtgcagatcgccagcaacgagaacgtggaggccatggacagcagcaccctggagctgagaagcagatactgggccatcagaaccagaagcggcggcaacaccaaccagcagagagccagcgccggccagatcagcgtgcagcccaccttcagcgtgcagagaaacctgcccttcgagagacccaccatcatggccgccttcaagggcaacaccgagggcagaaccagcgacatgagaaccgagatcatcagaatgatggagagcgccagacccgaggacgtgagcttccagggcagaggcgtgttcgagctgagcgacgagaaggccaccaaccccatcgtgcccagcttcgacatgagcaacgagggcagctacttcttcggcgacaacgccgaggagtacgacaac

SEQ ID NO: 35917 - RNA, 1494 nt, synthetic construct; identical to SEQ ID NO: 35914
  misc_feature 1..1494: note = derived and/or modified sequence opt4 from anti-influenza_Chain
  source 1..1494: mol_type = other RNA

SEQ ID NO: 35918 - RNA, 1494 nt, synthetic construct; identical to SEQ ID NO: 35915
  misc_feature 1..1494: note = derived and/or modified sequence opt4 from anti-influenza_Chain
  source 1..1494: mol_type = other RNA

SEQ ID NO: 35919 - RNA, 1494 nt, synthetic construct; identical to SEQ ID NO: 35916
  misc_feature 1..1494: note = derived and/or modified sequence opt4 from anti-influenza_Chain
  source 1..1494: mol_type = other RNA

SEQ ID NO: 35920 - RNA, 1530 nt, synthetic construct
  misc_feature 1..1530: note = derived and/or modified sequence opt4 from anti-influenza_Chain
  source 1..1530: mol_type = other RNA
atgttccccgagaagttcctgtggggcgtggcccagagcggcttccagttcgagatgggcgacaagctgagaagaaacatcgacaccaacaccgactggtggcactgggtgagagacaagaccaacatcgagaagggcctggtgagcggcgacctgcccgaggagggcatcaacaactacgagctgtacgagaaggaccacgagatcgccagaaagctgggcctgaacgcctacagaatcggcatcgagtggagcagaatcttcccctggcccaccaccttcatcgacgtggactacagctacaacgagagctacaacctgatcgaggacgtgaagatcaccaaggacaccctggaggagctggacgagatcgccaacaagagagaggtggcctactacagaagcgtgatcaacagcctgagaagcaagggcttcaaggtgatcgtgaacctgaaccacttcaccctgccctactggctgcacgaccccatcgaggccagagagagagccctgaccaacaagagaaacggctgggtgaaccccagaaccgtgatcgagttcgccaagtacgccgcctacatcgcctacaagttcggcgacatcgtggacatgtggagcaccttcaacgagcccatggtggtggtggagctgggctacctggccccctacagcggcttcccccccggcgtgctgaaccccgaggccgccaagctggccatcctgcacatgatcaacgcccacgccctggcctacagacagatcaagaagttcgacaccgagaaggccgacaaggacagcaaggagcccgccgaggtgggcatcatctacaacaacatcggcgtggcctaccccaaggaccccaacgacagcaaggacgtgaaggccgccgagaacgacaacttcttccacagcggcctgttcttcgaggccatccacaagggcaagctgaacatcgagttcgacggcgagaccttcatcgacgccccctacctgaagggcaacgactggatcggcgtgaactactacaccagagaggtggtgacctaccaggagcccatgttccccagcatccccctgatcaccttcaagggcgtgcagggctacggctacgcctgcagacccggcaccctgagcaaggacgacagacccgtgagcgacatcggctgggagctgtaccccgagggcatgtacgacagcatcgtggaggcccacaagtacggcgtgcccgtgtacgtgaccgagaacggcatcgccgacagcaaggacatcctgagaccctactacatcgccagccacatcaagatgaccgagaaggccttcgaggacggctacgaggtgaagggctacttccactgggccctgaccgacaacttcgagtgggccctgggcttcagaatgagattcggcctgtacgaggtgaacctgatcaccaaggagagaatccccagagagaagagcgtgagcatcttcagagagatcgtggccaacaacggcgtgaccaagaagatcgaggaggagctgctgagaggc

SEQ ID NO: 35921 - RNA, 1530 nt, synthetic construct; identical to SEQ ID NO: 35920
  misc_feature 1..1530: note = derived and/or modified sequence opt4 from anti-influenza_Chain
  source 1..1530: mol_type = other RNA

SEQ ID NO: 35922 - RNA, 1536 nt, synthetic construct
  misc_feature 1..1536: note = derived and/or modified sequence opt4 from anti-influenza_Chain
  source 1..1536: mol_type = other RNA
atgaagagaaaggtgaagaagatggccgccatggccaccagcatcatcatggccatcatgatcatcctgcacagcatccccgtgctggccggcagaatcatctacgacaacgagaccggcacccacggcggctacgactacgagctgtggaaggactacggcaacaccatcatggagctgaacgacggcggcaccttcagctgccagtggagcaacatcggcaacgccctgttcagaaagggcagaaagttcaacagcgacaagacctaccaggagctgggcgacatcgtggtggagtacggctgcgactacaaccccaacggcaacagctacctgtgcgtgtacggctggaccagaaaccccctggtggagtactacatcgtggagagctggggcagctggagaccccccggcgccacccccaagggcaccatcacccagtggatggccggcacctacgagatctacgagaccaccagagtgaaccagcccagcatcgacggcaccgccaccttccagcagtactggagcgtgagaaccagcaagagaaccagcggcaccatcagcgtgaccgagcacttcaagcagtgggagagaatgggcatgagaatgggcaagatgtacgaggtggccctgaccgtggagggctaccagagcagcggctacgccaacgtgtacaagaacgagatcagaatcggcgccaaccccacccccgcccccagccagagccccatcagaagagacgccttcagcatcatcgaggccgaggagtacaacagcaccaacagcagcaccctgcaggtgatcggcacccccaacaacggcagaggcatcggctacatcgagaacggcaacaccgtgacctacagcaacatcgacttcggcagcggcgccaccggcttcagcgccaccgtggccaccgaggtgaacaccagcatccagatcagaagcgacagccccaccggcaccctgctgggcaccctgtacgtgagcagcaccggcagctggaacacctaccagaccgtgagcaccaacatcagcaagatcaccggcgtgcacgacatcgtgctggtgttcagcggccccgtgaacgtggacaacttcatcttcagcagaagcagccccgtgcccgcccccggcgacaacaccagagacgcctacagcatcatccaggccgaggactacgacagcagctacggccccaacctgcagatcttcagcctgcccggcggcggcagcgccatcggctacatcgagaacggctacagcaccacctacaagaacatcgacttcggcgacggcgccaccagcgtgaccgccagagtggccacccagaacgccaccaccatccaggtgagactgggcagccccagcggcaccctgctgggcaccatctacgtgggcagcaccggcagcttcgacacctacagagacgtgagcgccaccatcagcaacaccgccggcgtgaaggacatcgtgctggtgttcagcggccccgtgaacgtggactggttcgtgttcagcaagagcggcacc

SEQ ID NO: 35923 - RNA, 1536 nt, synthetic construct; identical to SEQ ID NO: 35922
  misc_feature 1..1536: note = derived and/or modified sequence opt4 from anti-influenza_Chain
  source 1..1536: mol_type = other RNA

SEQ ID NO: 35924 - RNA, 1539 nt, synthetic construct
  misc_feature 1..1539: note = derived and/or modified sequence opt4 from anti-influenza_Chain
  source 1..1539: mol_type = other RNA
atctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggctacatccccgaggcccccagagacggccaggcctacgtgagaaaggacggcgagtgggtgctgctgagcaccttcctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35925 - RNA, 1539 nt, synthetic construct; identical to SEQ ID NO: 35924
  misc_feature 1..1539: note = derived and/or modified sequence opt4 from anti-influenza_Chain
  source 1..1539: mol_type = other RNA

SEQ ID NO: 35926 - RNA, 1593 nt, synthetic construct
  misc_feature 1..1593: note = derived and/or modified sequence opt4 from anti-influenza_Chain
  source 1..1593: mol_type = other RNA
accctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagaccagcagcagcgacaacggcacctgctaccccggcgacttcatcgactacgaggagctgagagagcagctgagcagcgtgagcagcttcgagagattcgagatcttccccaagaccagcagctggcccaaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccaccccagcaccagcgccgaccagcagagcctgtaccagaacgccgacgcctacgtgttcgtgggcaccagcagatacagcaagaagttcaagcccgagatcgccatcagacccaaggtgagagaccaggagggcagaatgaactactactggaccctggtggagcccggcgacaagatcaccttcgaggccaccggcaacctggtggtgcccagatacgccttcgccatggagagagacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacgtgcccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacgagatcaccaacaaggtgaacagcgtgatcgagaagatgaacacccagttcaccgccgtgggcaaggagttcaaccacctggagaagagaatcgagaacctgaacaagaagatcgacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgcc

SEQ ID NO: 35927 - RNA, 1593 nt, synthetic construct
  misc_feature 1..1593: note = derived and/or modified sequence opt4 from anti-influenza_Chain
  source 1..1593: mol_type = other RNA
accctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctgcatcgtggagaccagcagcagcgacaacggcacctgctaccccggcgacttcatcgactacgaggagctgagagagcagctgagcagcgtgagcagcttcgagagattcgagatcttccccaagaccagcagctggcccaaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccaccccagcaccagcgccgaccagcagagcctgtaccagaacgccgacgcctacgtgttcgtgggcaccagcagatacagcaagaagttcaagcccgagatcgccatcagacccaaggtgagagaccaggagggcagaatgaactactactggaccctggtggagcccggcgacaagatcaccttcgaggccaccggcaacctggtggtgcccagatacgccttcgccatggagagagacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacgtgcccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacgagatcaccaacaaggtgaacagcgtgatcgagaagatgaacacccagttcaccgccgtgggcaaggagttcaaccacctggagaagagaatcgagaacctgaacaagaagatcgacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgcc

SEQ ID NO: 35928 - RNA, 1593 nt, synthetic construct
  misc_feature 1..1593: note = derived and/or modified sequence opt4 from anti-influenza_Chain
  source 1..1593: mol_type = other RNA
accctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagaccagcagcagcgacaacggcacctgctaccccggcgacttcatcgactacgaggagctgagagagcagctgagcagcgtgagcagcttcgagagattcgagatcttccccaacaccagcagctggcccaaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccaccccagcaccagcgccgaccagcagagcctgtaccagaacgccgacgcctacgtgttcgtgggcaccagcagatacagcaagaagttcaagcccgagatcgccatcagacccaaggtgagagaccaggagggcagaatgaactactactggaccctggtggagcccggcgacaagatcaccttcgaggccaccggcaacctggtggtgcccagatacgccttcgccatggagagagacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacgtgcccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacgagatcaccaacaaggtgaacagcgtgatcgagaagatgaacacccagttcaccgccgtgggcaaggagttcaaccacctggagaagagaatcgagaacctgaacaagaagatcgacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgcc

SEQ ID NO: 35929 - RNA, 1593 nt, synthetic construct
  misc_feature 1..1593: note = derived and/or modified sequence opt4 from anti-influenza_Chain
  source 1..1593: mol_type = other RNA
accctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagaccagcagcagcgacaacggcacctgctaccccggcgacttcatcgactacgaggagctgagagagcagctgagcagcgtgagcagcttcgagagattcgagatcttccccaagaccagcagctggcccaaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccaccccagcaccagcgccgaccagcagagcctgtaccagaacgccgacgcctacgtgttcgtgggcaccagcagatacagcaagaagttcggccccgagatcgccatcagacccaaggtgagagaccaggagggcagaatgaactactactggaccctggtggagcccggcgacaagatcaccttcgaggccaccggcaacctggtggtgcccagatacgccttcgccatggagagagacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacgtgcccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacgagatcaccaacaaggtgaacagcgtgatcgagaagatgaacacccagttcaccgccgtgggcaaggagttcaaccacctggagaagagaatcgagaacctgaacaagaagatcgacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgcc

SEQ ID NO: 35930 - RNA, 1593 nt, synthetic construct; identical to SEQ ID NO: 35926
  misc_feature 1..1593: note = derived and/or modified sequence opt4 from anti-influenza_Chain
  source 1..1593: mol_type = other RNA

SEQ ID NO: 35931 - RNA, 1593 nt, synthetic construct; identical to SEQ ID NO: 35927
  misc_feature 1..1593: note = derived and/or modified sequence opt4 from anti-influenza_Chain
  source 1..1593: mol_type = other RNA

SEQ ID NO: 35932 - RNA, 1593 nt, synthetic construct; identical to SEQ ID NO: 35928
  misc_feature 1..1593: note = derived and/or modified sequence opt4 from anti-influenza_Chain
  source 1..1593: mol_type = other RNA

SEQ ID NO: 35933 - RNA, 1593 nt, synthetic construct; identical to SEQ ID NO: 35929
  misc_feature 1..1593: note = derived and/or modified sequence opt4 from anti-influenza_Chain
  source 1..1593: mol_type = other RNA

SEQ ID NO: 35934 - RNA, 1605 nt, synthetic construct
  misc_feature 1..1605: note = derived and/or modified sequence opt4 from anti-influenza_Chain
  source 1..1605: mol_type = other RNA
gccaacgccgacaccctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagaccagcagcagcgacaacggcacctgctaccccggcgacttcatcgactacgaggagctgagagagcagctgagcagcgtgagcagcttcgagagattcgagatcttccccaagaccagcagctggcccgaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccaccccagcaccagcgccgaccagcagagcctgtaccagaacgccgacgcctacgtgttcgtgggcaccagcagatacagcaagaagttcaagcccgagatcgccatcagacccaaggtgagagaccaggagggcagaatgaactactactggaccctggtggagcccggcgacaagatcaccttcgaggccaccggcaacctggtggtgcccagatacgccttcgccatggagagaaacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacgtgcccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacaagatcaccaacaaggtgaacagcgtgatcgagaagatgaacacccagttcaccgccgtgggcaaggagttcaaccacctggagaagagaatcgagaacctgaacaagaaggtggacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgcc

SEQ ID NO: 35935 - RNA, 1605 nt, synthetic construct
  misc_feature 1..1605: note = derived and/or modified sequence opt4 from anti-influenza_Chain
  source 1..1605: mol_type = other RNA
gccaacgccgacaccctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagaccagcagcagcgacaacggcacctgctaccccggcgacttcatcgactacgaggagctgagagagcagctgagcagcgtgagcagcttcgagagattcgagatcttccccaagaccagcagctggcccaaccacgacagcaacaagggcgtgaccgccgcctgccccagagccggcgccaagggcttctacaagaacctgatctggctggtgaagaagggcaacagctaccccaagctgaacaagagctacatcaacgacaagggcaaggaggtgctggtgctgtggggcatccaccaccccagcaccaccgccgaccagcagagcctgtaccagaacgccgacacctacgtgttcgtgggcaccagcagatacagcaagaagttcaagcccgagatcgagatcagacccaaggtgagagaccaggagggcagaatgaactactactggaccctggtggagcccggcgacaagatcaccttcgaggccaccggcaacctggtggtgcccagatacgccttcgccatggagagaaacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacgtgcccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacaagatcaccaacaaggtgaacagcgtgatcgagaagatgaacacccagttcaccgccgtggacaaggagttcaaccacctggagaagagaatcgagaacctgaacaagaaggtggacgacggcttcctggacatctggacctacaacgccgagctgctggtgctgctggagaacgagagaaccctggactaccacgacagcaacgtgaagaacctgtacgagaaggtgagaaaccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgcc

SEQ ID NO: 35936 - RNA, 1605 nt, synthetic construct; identical to SEQ ID NO: 35934
  misc_feature 1..1605: note = derived and/or modified sequence opt4 from anti-influenza_Chain
  source 1..1605: mol_type = other RNA

SEQ ID NO: 35937 - RNA, 1605 nt, synthetic construct; identical to SEQ ID NO: 35935
  misc_feature 1..1605: note = derived and/or modified sequence opt4 from anti-influenza_Chain
  source 1..1605: mol_type = other RNA

SEQ ID NO: 35938 - RNA, 1644 nt, synthetic construct
  misc_feature 1..1644: note = derived and/or modified sequence opt4 from anti-influenza_Chain
  source 1..1644: mol_type = other RNA
cagaagctgcccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcgagatctgcgacagcccccaccagatcctggacggcgagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaacaacgagagcttcaactggaccggcgtgacccagaacggcaccagcagcgcctgcatcagaagaagcaacaacagcttcttcagcagactgaactggctgacccacctgaagttcaagtaccccgccctgaacgtgaccatgcccaacaacgagaagttcgacaagctgtacatctggggcgtgcaccaccccggcaccgacaacgaccagatcttcccctacgcccaggccagcggcagaatcaccgtgagcaccaagagaagccagcagaccgtgatccccaacatcggcagcagacccagagtgagaaacatccccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcatcggccaggccgccgacctgaagagcacccaggccgccatcgaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagaagaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcgtggagctgaagagcggctacaaggactggatcctgtggatcagcttcgccatcagctgcttcctgctgtgcgtggccctgctgggcttcatcatgtgggcctgccagaagggcaacatcagatgcaacatc

SEQ ID NO: 35939 - RNA, 1644 nt, synthetic construct; identical to SEQ ID NO: 35938
  misc_feature 1..1644: note = derived and/or modified sequence opt4 from anti-influenza_Chain
  source 1..1644: mol_type = other RNA

SEQ ID NO: 35940 - RNA, 1647 nt, synthetic construct
  misc_feature 1..1647: note = derived and/or modified sequence opt4 from anti-influenza_Chain
  source 1..1647: mol_type = other RNA
atgctgaccttccacagaatcatcagaaagggctggatgttcctgctggccttcctgctgaccgccctgctgttctgccccaccggccagcccgccaaggccgccgcccccttcaacggcaccatgatgcagtacttcgagtggtacctgcccgacgacggcaccctgtggaccaaggtggccaacgaggccaacaacctgagcagcctgggcatcaccgccctgtggctgccccccgcctacaagggcaccagcagaagcgacgtgggctacggcgtgtacgacctgtacgacctgggcgagttcaaccagaagggcgccgtgagaaccaagtacggcaccaaggcccagtacctgcaggccatccaggccgcccacgccgccggcatgcaggtgtacgccgacgtggtgttcgaccacaagggcggcgccgacggcaccgagtgggtggacgccgtggaggtgaaccccagcgacagaaaccaggagatcagcggcacctaccagatccaggcctggaccaagttcgacttccccggcagaggcaacacctacagcagcttcaagtggagatggtaccacttcgacggcgtggactgggacgagagcagaaagctgagcagaatctacaagttcagaggcatcggcaaggcctgggactgggaggtggacaccgagaacggcaactacgactacctgatgtacgccgacctggacatggaccaccccgaggtggtgaccgagctgaagagctggggcaagtggtacgtgaacaccaccaacatcgacggcttcagactggacgccgtgaagcacatcaagttcagcttcttccccgactggctgagcgacgtgagaagccagaccggcaagcccctgttcaccgtgggcgagtactggagctacgacatcaacaagctgcacaactacatcatgaagaccaacggcaccatgagcctgttcgacgcccccctgcacaacaagttctacaccgccagcaagagcggcggcaccttcgacatgagaaccctgatgaccaacaccctgatgaaggaccagcccaccctggccgtgaccttcgtggacaaccacgacaccgagcccggccaggccctgcagagctgggtggacccctggttcaagcccctggcctacgccttcatcctgaccagacaggagggctacccctgcgtgttctacggcgactactacggcatcccccagtacaacatccccagcctgaagagcaagatcgaccccctgctgatcgccagaagagactacgcctacggcacccagcacgactacctggaccacagcgacatcatcggctggaccagagagggcgtgaccgagaagcccggcagcggcctggccgccctgatcaccgacggccccggcggcagcaagtggatgtacgtgggcaagcagcacgccggcaaggtgttctacgacctgaccggcaacagaagcgacaccgtgaccatcaacagcgacggctggggcgagttcaaggtgaacggcggcagcgtgagcgtgtgggtgcccagaaagaccaccgtgagcaccatcgcctggagcatcaccaccagaccctggaccgacgagttcgtgagatggaccgagcccagactggtggcctggccc

SEQ ID NO: 35941 - RNA, 1647 nt, synthetic construct
  misc_feature 1..1647: note = derived and/or modified sequence opt4 from anti-influenza_Chain
  source 1..1647: mol_type = other RNA
atctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 35942 - RNA, 1647 nt, synthetic construct; identical to SEQ ID NO: 35941
  misc_feature 1..1647: note = derived and/or modified sequence opt4 from anti-influenza_Chain
  source 1..1647: mol_type = other RNA

SEQ ID NO: 35943 - RNA, 1647 nt, synthetic construct; identical to SEQ ID NO: 35940
  misc_feature 1..1647: note = derived and/or modified sequence opt4 from anti-influenza_Chain
  source 1..1647: mol_type = other RNA

SEQ ID NO: 35944 - RNA, 1650 nt, synthetic construct
  misc_feature 1..1650: note = derived and/or modified sequence opt4 from anti-influenza_Chain
  source 1..1650: mol_type = other RNA
gaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccaccaacgacctgtgctaccccggcagcttcaacgactacgaggagctgaagcacctgctgagcagaatcaaccacttcgagaagatccagatcatccccaagagcagctggagcgaccacgaggccagcagcggcgtgagcagcgcctgcccctacctgggcagccccagcttcttcagaaacgtggtgtggctgatcaagaagaacagcacctaccccaccatcaagaagagctacaacaacaccaaccaggaggacctgctggtgctgtggggcatccaccaccccaacgacgccgccgagcagaccagactgtaccagaaccccaccacctacatcagcatcggcaccagcaccctgaaccagagactggtgcccaagatcgccaccagaagcaaggtgaacggccagagcggcagaatggagttcttctgggccatcctgaagcccaacgacgccatcaacttcgagagcaacggcaacttcatcgcccccgagtacgcctacaagatcgtgaagaagggcgacagcgccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagcagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcatcagaaacggcacctacaacccccagtacagcgaggaggccagactgaagagagaggagatcagcggcgtgaagctggagagcatcggcacctaccagatcctgagcatctacagcaccgtggccagcagcctggccctggccatcatgatcgccggcctgagcctgtggatgtgcagcaacggcagcctgcagtgcagaatctgcatc

SEQ ID NO: 35945 - RNA, 1650 nt, synthetic construct; identical to SEQ ID NO: 35944
  misc_feature 1..1650: note = derived and/or modified sequence opt4 from anti-influenza_Chain
  source 1..1650: mol_type = other RNA

SEQ ID NO: 35946 - RNA, 1656 nt, synthetic construct
  misc_feature 1..1656: note = derived and/or modified sequence opt4 from anti-influenza_Chain
  source 1..1656: mol_type = other RNA
atgaacatccagatcctggccttcatcgcctgcgtgctgaccggcgccaagggcgacaagatctgcctgggccaccacgccgtggccaacggcaccaaggtgaacaccctgaccgagaagggcatcgaggtggtgaacgccaccgagaccgtggagaccgccgacgtgaagaagatctgcacccagggcaagagagccaccgacctgggcagatgcggcctgctgggcaccctgatcggccccccccagtgcgaccagttcctggagttcagcagcgacctgatcatcgagagaagagagggcaccgacgtgtgctaccccggcagattcaccaacgaggagagcctgagacagatcctgagaagaagcggcggcatcggcaaggagagcatgggcttcacctacagcggcatcagaaccaacggcgccgccagcgcctgcaccagaagcggcagcagcttctacgccgagatgaagtggctgctgagcaacagcgacaacagcgccttcccccagatgaccaaggcctacagaaaccccagaaacaagcccgccctgatcatctggggcgtgcaccacagcgagagcgccagcgagcagaccaagctgtacggcagcggcaacaagctgatcaccgtgagaagcagcaagtaccagcagagcttcacccccagccccggcaccagaagaatcgacttccactggctgctgctggaccccaacgacaccgtgaccttcaccttcaacggcgccttcatcgcccccgacagagccagcttcttcagaggcgagagcctgggcgtgcagagcgacgcccccctggacagcagctgcagaggcgactgcttccacagcggcggcaccatcgtgagcagcctgcccttccagaacatcaacagcagaaccgtgggcagatgccccagatacgtgaagcagaagagcctgctgctggccaccggcatgagaaacgtgcccgagaagcccaagcccagaggcctgttcggcgccatcgccggcttcatcgagaacggctgggagggcctgatcaacggctggtacggcttcagacaccagaacgcccagggcgagggcaccgccgccgactacaagagcacccagagcgccatcgaccagatcaccggcaagctgaacagactgatcggcaagaccaaccagcagttcgagctgatcgacaacgagttcaacgagatcgagcagcagatcggcaacgtgatcaactggaccagagacgccatgaccgagatctggagctacaacgccgagctgctggtggccatggagaaccagcacaccatcgacctggccgacagcgagatgagcaagctgtacgagagagtgaagaagcagctgagagagaacgccgaggaggacggcaccggctgcttcgagatcttccacaagtgcgacgaccagtgcatggagagcatcagaaacaacacctacgaccacacccagtacagaaccgagagcctgcagaacagaatccagatcgaccccgtgaagctgagcagcggctacaaggacatcatcctgtggttcagcttcggcgccagctgcttcatcctgctggccatcgccatgggcctggtgttcatctgcatcaagaacggcaacatgcagtgcaccatctgcatc

SEQ ID NO: 35947 - RNA, 1656 nt, synthetic construct
  misc_feature 1..1656: note = derived and/or modified sequence opt4 from anti-influenza_Chain
  source 1..1656: mol_type = other RNA
atgaacacccagatcctggccttcatcgcctgcgtgctgaccggcgtgaagggcgacaagatctgcctgggccaccacgccgtggccaacggcaccaaggtgaacaccctgaccgagaagggcatcgaggtggtgaacgccaccgagaccgtggagaccgccgacgtgaagaagatctgcacccagggcaagagagccaccgacctgggcagatgcggcctgctgggcaccctgatcggccccccccagtgcgaccagttcctggagttcagcagcgacctgatcatcgagagaagagagggcaccgacgtgtgctaccccggcagattcaccaacgaggagagcctgagacagatcctgagaagaagcggcggcatcggcaaggagagcatgggcttcacctacagcggcatcagaaccaacggcgccaccagcgcctgcaccagaagcggcagcagcttctacgccgagatgaagtggctgctgagcaacagcgacaacagcgccttcccccagatgaccaaggcctacagaaaccccagaaacaagcccgccctgatcatctggggcgtgcaccacagcgagagcgtgagcgagcagaccaagctgtacggcagcggcaacaagctgatcaccgtgagaagcagcaagtaccagcagagcttcacccccagccccggcgccagaagaatcgacttccactggctgctgctggaccccaacgacaccgtgaccttcaccttcaacggcgccttcatcgcccccgacagagccagcttcttcagaggcgagagcctgggcgtgcagagcgacgtgcccctggacagcagctgcagaggcgactgcttccacagcggcggcaccatcgtgagcagcctgcccttccagaacatcaacagcagaaccgtgggcaagtgccccagatacgtgaagcagaagagcctgctgctggccaccggcatgagaaacgtgcccgagaagcccaagcccagaggcctgttcggcgccatcgccggcttcatcgagaacggctgggagggcctgatcaacggctggtacggcttcagacaccagaacgcccagggcgagggcaccgccgccgactacaagagcacccagagcgccatcgaccagatcaccggcaagctgaacagactgatcggcaagaccaaccagcagttcgagctgatcgacaacgagttcaacgagatcgagcagcagatcggcaacgtgatcaactggaccagagacgccatgaccgagatctggagctacaacgccgagctgctggtggccatggagaaccagcacaccatcgacctggccgacagcgagatgagcaagctgtacgagagagtgaagaagcagctgagagagaacgccgaggaggacggcaccggctgcttcgagatcttccacaagtgcgacgaccagtgcatggagagcatcagaaacaacacctacgaccacacccagtacagaaccgagagcctgcagaacagaatccagatcgaccccgtgaagctgagcagcggctacaaggacatcatcctgtggttcagcttcggcgccagctgcttcctgctgctggccatcgccatgggcctggtgttcatctgcatcaagaacggcaacatgcagtgcaccatctgcatc

SEQ ID NO: 35948 - RNA, 1656 nt, synthetic construct
  misc_feature 1..1656: note = derived and/or modified sequence opt4 from anti-influenza_Chain
  source 1..1656: mol_type = other RNA
atgaacatccagatcctggccttcatcgcctgcgtgctgaccggcgccaagggcgacaagatctgcctgggccaccacgccgtggccaacggcaccaaggtgaacaccctgaccgagaagggcatcgaggtggtgaacgccaccgagaccgtggagaccgccaacatcaagaagatctgcacccagggcaagagacccaccgacctgggccagtgcggcctgctgggcaccctgatcggccccccccagtgcgaccagttcctggagttcagcagcgacctgatcatcgagagaagagagggcaccgacgtgtgctaccccggcaagttcaccaacgaggagagcctgagacagatcctgagaagaagcggcggcatcggcaaggagagcatgggcttcacctacagcggcatcagaaccaacggcgccaccagcgcctgcaccagaagcggcagcagcttctacgccgagatgaagtggctgctgagcaacagcgacaacgccgccttcccccagatgaccaagagctacagaaaccccagaaacaagcccgccctgatcatctggggcgtgcaccacagcgagagcgtgagcgagcagaccaagctgtacggcagcggcaacaagctgatcaaggtgagaagcagcaagtaccagcagagcttcacccccaaccccggcgccagaagaatcgacttccactggctgctgctggaccccaacgacaccgtgaccttcaccttcaacggcgccttcatcgcccccgacagagccagcttcttcagaggcgagagcatcggcgtgcagagcgacgcccccctggacagcagctgcggcggcaactgcttccacaacggcggcaccatcgtgagcagcctgcccttccagaacatcaaccccagaaccgtgggcaagtgccccagatacgtgaagcagaagagcctgctgctggccaccggcatgagaaacgtgcccgagaagcccaagaagagaggcctgttcggcgccatcgccggcttcatcgagaacggctgggagggcctgatcaacggctggtacggcttcagacaccagaacgcccagggcgagggcaccgccgccgactacaagagcacccagagcgccatcgaccagatcaccggcaagctgaacagactgatcggcaagaccaaccagcagttcgagctgatcaacaacgagttcaacgaggtggagcagcagatcggcaacgtgatcaactggacccaggacgccatgaccgaggtgtggagctacaacgccgagctgctggtggccatggagaaccagcacaccatcgacctgaccgacagcgagatgagcaagctgtacgagagagtgagaaagcagctgagagagaacgccgaggaggacggcaccggctgcttcgagatcttccacaagtgcgacgaccactgcatggagagcatcagaaacaacacctacgaccacacccagtacagaaccgagagcctgcagaacagaatccagatcgaccccgtgaagctgagcggcggctacaaggacatcatcctgtggttcagcttcggcgccagctgcttcctgctgctggccatcgccatgggcctggtgttcatctgcatcaagaacggcaacatgcagtgcaccatctgcatc

SEQ ID NO: 35949 - RNA, 1656 nt, synthetic construct
  misc_feature 1..1656: note = derived and/or modified sequence opt4 from anti-influenza_Chain
  source 1..1656: mol_type = other RNA
gaccagatctgcatcggctaccacgccaacaacagcaccgagcaggtggacaccatcatggagaagaacgtgaccgtgacccacgcccagaacatcctggagaagacccacaacggcaagctgtgcgacctggacggcgtgaagcccctgatcctgagagactgcagcgtggccggctggctgctgggcaaccccatgtgcgacgagttcctgaacgtgcccgagtggagctacatcgtggagaagatcaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcagaagcagcttcttcagaaacgtggtgtggctgatcaagaaggacaacgcctaccccaccatcaagagaagctacaacaacaccaaccaggaggacctgctggtgctgtggggcatccaccaccccaacgacgccgccgagcagaccagactgtaccagaaccccaccacctacatcagcgtgggcaccagcaccctgaaccagagactggtgcccaagatcgccaccagaagcaaggtgaacggccagagcggcagaatggagttcttctggaccatcctgaagcccaacgacgccatcaacttcgagagcaacggcaacttcatcgcccccgagaacgcctacaagatcgtgaagaagggcgacagcaccatcatgaagagcgagctggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagcccccagggcgagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaagatcagactgcagctgagagacaacgccaaggagctgggcaacggctgcttcgagttctaccacagatgcgacaacgagtgcatggagagcgtgagaaacggcacctacgactacccccagtacagcgaggaggccagactgaagagagaggagatcagcggcgtgaagctggagagcatcggcacctaccagatcctgagcatctacagcaccgtggccagcagcctgaccctggccatcatggtggccggcctgagcctgtggatgtgcagcaacggcagcctgcagtgcagaatctgcatc

SEQ ID NO: 35950 - RNA, 1656 nt, synthetic construct
  misc_feature 1..1656: note = derived and/or modified sequence opt4 from anti-influenza_Chain
  source 1..1656: mol_type = other RNA
gaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccaccaacgacctgtgctaccccggcagcttcaacgactacgaggagctgaagcacctgctgagcagaatcaaccacttcgagaagatccagatcatccccaagagcagctggagcgaccacgaggccagcagcggcgtgagcagcgcctgcccctacctgggcagccccagcttcttcagaaacgtggtgtggctgatcaagaagaacagcacctaccccaccatcaagaagagctacaacaacaccaaccaggaggacctgctggtgctgtggggcatccaccaccccaacgacgccgccgagcagaccagactgtaccagaaccccaccacctacatcagcatcggcaccagcaccctgaaccagagactggtgcccaagatcgccaccagaagcaaggtgaacggccagagcggcagaatggagttcttctggaccatcctgaaccccaacgacgccatcaacttcgagagcaacggcaacttcatcgcccccgagtacgcctacaagatcgtgaagaagggcgacagcgccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagcagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcatcagaaacggcacctacaactacccccagtacagcgaggaggccagactgaagagagaggagatcagcggcgtgaagctggagagcatcggcacctaccagatcctgagcatctacagcaccgtggccagcagcctggccctggccatcatgatggccggcctgagcctgtggatgtgcagcaacggcagcctgcagtgcagaatctgcatc

SEQ ID NO: 35951 - RNA, 1656 nt, synthetic construct; identical to SEQ ID NO: 35946
  misc_feature 1..1656: note = derived and/or modified sequence opt4 from anti-influenza_Chain
  source 1..1656: mol_type = other RNA

SEQ ID NO: 35952 - RNA, 1656 nt, synthetic construct; identical to SEQ ID NO: 35947
  misc_feature 1..1656: note = derived and/or modified sequence opt4 from anti-influenza_Chain
  source 1..1656: mol_type = other RNA

SEQ ID NO: 35953 - RNA, 1656 nt, synthetic construct; identical to SEQ ID NO: 35948
  misc_feature 1..1656: note = derived and/or modified sequence opt4 from anti-influenza_Chain
  source 1..1656: mol_type = other RNA

SEQ ID NO: 35954 - RNA, 1656 nt, synthetic construct; identical to SEQ ID NO: 35949
  misc_feature 1..1656: note = derived and/or modified sequence opt4 from anti-influenza_Chain
  source 1..1656: mol_type = other RNA

SEQ ID NO: 35955 - RNA, 1656 nt, synthetic construct; identical to SEQ ID NO: 35950
  misc_feature 1..1656: note = derived and/or modified sequence opt4 from anti-influenza_Chain
  source 1..1656: mol_type = other RNA

SEQ ID NO: 35956 - RNA, 1680 nt, synthetic construct
  misc_feature 1..1680: note = derived and/or modified sequence opt4 from anti-influenza_Chain
  source 1..1680: mol_type = other RNA
atgagcaacatggacatcgacagcatcaacaccggcaccatcgacaagacccccgaggagctgacccccggcaccagcggcgccaccagacccatcatcaagcccgccaccctggccccccccagcaacaagagaaccagaaaccccagccccgagagaaccaccaccagcagcgagaccgacatcggcagaaagatccagaagaagcagacccccaccgagatcaagaagagcgtgtacaagatggtggtgaagctgggcgagttctacaaccagatgatggtgaaggccggcctgaacgacgacatggagagaaacctgatccagaacgcccaggccgtggagagaatcctgctggccgccaccgacgacaagaagaccgagtaccagaagaagagaaacgccagagacgtgaaggagggcaaggaggagatcgaccacaacaagaccggcggcaccttctacaagatggtgagagacgacaagaccatctacttcagccccatcaagatcaccttcctgaaggaggaggtgaagaccatgtacaagaccaccatgggcagcgacggcttcagcggcctgaaccacatcatgatcggccacagccagatgaacgacgtgtgcttccagagaagcaagggcctgaagagagtgggcctggaccccagcctgatcagcaccttcgccggcagcaccctgcccagaagaagcggcaccaccggcgtggccatcaagggcggcggcaccctggtggacgaggccatcagattcatcggcagagccatggccgacagaggcctgctgagagacatcaaggccaagaccgcctacgagaagatcctgctgaacctgaagaacaagtgcagcgccccccagcagaaggccctggtggaccaggtgatcggcagcagaaaccccggcatcgccgacatcgaggacctgaccctgctggccagaagcatggtggtggtgagacccagcgtggccagcaaggtggtgctgcccatcagcatctacgccaagatcccccagctgggcttcaacaccgaggagtacagcatggtgggctacgaggccatggccctgtacaacatggccacccccgtgagcatcctgagaatgggcgacgacgccaaggacaagagccagctgttcttcatgagctgcttcggcgccgcctacgaggacctgagagtgctgagcgccctgaccggcaccgagttcaagcccagaagcgccctgaagtgcaagggcttccacgtgcccgccaaggagcaggtggagggcatgggcgccgccctgatgagcatcaagctgcagttctgggcccccatgaccagaagcggcggcaacgaggtgagcggcgagggcggcagcggccagatcagctgcagccccgtgttcgccgtggagagacccatcgccctgagcaagcaggccgtgagaagaatgctgagcatgaacgtggagggcagagacgccgacgtgaagggcaacctgctgaagatgatgaacgacagcatggccaagaagaccagcggcaacgccttcatcggcaagaagatgttccagatcagcgacaagaacaaggtgaaccccatcgagatccccatcaagcagaccatccccaacttcttcttcggcagagacaccgccgaggactacgacgacctggactac

SEQ ID NO: 35957 - RNA, 1680 nt, synthetic construct
  misc_feature 1..1680: note = derived and/or modified sequence opt4 from anti-influenza_Chain
  source 1..1680: mol_type = other RNA
atgaacacccagatcctggccctgatcgcctacatgctgatcggcgccaagggcgacaagatctgcctgggccaccacgccgtggccaacggcaccaaggtgaacaccctgaccgagagaggcatcgaggtggtgaacgccaccgagaccgtggagaccgtgaacatcaagaagatctgcacccagggcaagagacccaccgacctgggccagtgcggcctgctgggcaccctgatcggccccccccagtgcgaccagttcctggagttcgacgccgacctgatcatcgagagaagagagggcaccgacgtgtgctaccccggcaagttcaccaacgaggagagcctgagacagatcctgagaggcagcggcggcatcgacaaggagagcatgggcttcacctacagcggcatcagaaccaacggcgtgaccagcgcctgcagaagaagcggcagcagcttctacgccgagatgaagtggctgctgagcaacagcgacaacgccgccttcccccagatgaccaagagctacagaaaccccagaaacaagcccgccctgatcatctggggcgtgcaccacagcggcagcgccaccgagcagaccaagctgtacggcagcggcaacaagctgatcaccgtgggcagcagcaagtaccagcagagcttcacccccagccccggcgccagaccccaggtgaacggccagagcggcagaatcgacttccactggctgctgctggaccccaacgacaccgtgaccttcaccttcaacggcgccttcatcgcccccgacagagccagcttcttcagaggcgagagcctgggcgtgcagagcgacgtgcccctggacagcggctgcgagggcgactgcttccacagcagaggcaccatcgtgagcagcctgcccttccagaacatcaaccccagaaccgtgggcaagtgccccagatacgtgaagcagaccagcctgctgctggccaccggcatgagaaacgtgcccgagaaccccaagaccagaggcctgttcggcgccatcgccggcttcatcgagaacggctgggagggcctgatcgacggctggtacggcttcagacaccagaacgcccagggcgagggcaccgccgccgactacaagagcacccagagcgccatcgaccagatcaccggcaagctgaacagactgatcgacaagaccaaccagcagttcgagctgatcgacaacgagttcagcgagatcgagcagcagatcggcaacgtgatcaactggaccagagacagcatgaccgaggtgtggagctacaacgccgagctgctggtggccatggagaaccagcacaccatcgacctggccgacagcgagatgaacaagctgtacgagagagtgagaaagcagctgagagagaacgccgaggaggacggcaccggctgcttcgagatcttccacaagtgcgacgaccagtgcatggagagcatcagaaacaacacctacgaccacacccagtacagaaccgagagcctgcagaacagaatccagatcgaccccgtgaagctgagcagcggctacaaggacatcatcctgtggttcagcttcggcgccagctgcttcctgctgctggccatcgccatgggcctggtgttcatctgcatcaagaacggcaacatgagatgcaccatctgcatc

SEQ ID NO: 35958 - RNA, 1680 nt, synthetic construct
  misc_feature 1..1680: note = derived and/or modified sequence opt4 from anti-influenza_Chain
  source 1..1680: mol_type = other RNA
atgaacacccagatcctggccctgatcgcctgcatgctgatcggcgccaagggcgacaagatctgcctgggccaccacgccgtggccaacggcaccaaggtgaacaccctgaccgagagaggcatcgaggtggtgaacgccaccgagaccgtggagaccgccaacatcaagaagatctgcacccagggcaagagacccaccgacctgggccagtgcggcctgctgggcaccctgatcggccccccccagtgcgaccagttcctggagttcgacgccgacctgatcatcgagagaagagagggcaccgacgtgtgctaccccggcaagttcaccaacgaggagagcctgagacagatcctgagaggcagcggcggcatcgacaaggagagcatgggcttcacctacagcggcatcagaaccaacggcgccaccagcgcctgcagaagaagcggcagcagcttctacgccgagatgaagtggctgctgagcaacagcgacaacgccgccttcccccagatgaccaagagctacagaaaccccagaaacaagcccgccctgatcatctggggcgtgcaccacagcggcagcgccaccgagcagaccaagctgtacggcagcggcaacaagctgatcaccgtgggcagcagcaagtaccagcagagcttcacccccagccccggcgccagaccccaggtgaacggccagagcggcagaatcgacttccactggctgctgctggaccccaacgacaccgtgaccttcaccttcaacggcgccttcatcgcccccgacagagccagcttcttcagaggcggcagcctgggcgtgcagagcgacgtgcccctggacagcggctgcgagggcgactgcttccacagcggcggcaccatcgtgagcagcctgcccttccagaacatcaaccccagaaccgtgggcaagtgccccagatacgtgaagcagaccagcctgctgctggccaccggcatgagaaacgtgcccgagaaccccaagaccagaggcctgttcggcgccatcgccggcttcatcgagaacggctgggagggcctgatcgacggctggtacggcttcagacaccagaacgcccagggcgagggcaccgccgccgactacaagagcacccagagcgccatcgaccagatcaccggcaagctgaacagactgatcgacaagaccaaccagcagttcgagctgatcgacaacgagttcaacgagatcgagcagcagatcggcaacgtgatcaactggaccagagacagcatgaccgaggtgtggagctacaacgccgagctgctggtggccatggagaaccagcacaccatcgacctggccgacagcgagatgaacaagctgtacgagagagtgagaaagcagctgagagagaacgccgaggaggacggcaccggctgcttcgagatcttccacaagtgcgacgaccagtgcatggagagcatcagaaacaacacctacgaccacacccagtacagaaccgagagcctgcagaacagaatccagatcaaccccgtgaagctgagcagcggctacaaggacatcatcctgtggttcagcttcggcgccagctgcttcctgctgctggccatcgccatgggcctggtgttcatctgcatcaagaacggcaacatgagatgcaccatctgcatc

SEQ ID NO: 35959 - RNA, 1680 nt, synthetic construct
  misc_feature 1..1680: note = derived and/or modified sequence opt4 from anti-influenza_Chain
  source 1..1680: mol_type = other RNA
atggagagaatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcctgaacgtgcccgagtggagctacatcgtggagaagatcaaccccgccaacgacctgtgctaccccggcaacttcaacgactacgaggagctgaagcacctgctgagcagaatcaaccacttcgagagaatccagatcatccccaagagcagctggagcgaccacgaggccagcagcggcgtgagcagcgcctgcccctaccagggcagaagcagcttcttcagaaacgtggtgtggctgatcaagaagaacaacgcctaccccaccatcaagagaagctacaacaacaccaaccaggaggacctgctggtgctgtggggcatccaccaccccaacgacgccgccgagcagaccagactgtaccagaaccccaccacctacatcagcgtgggcaccagcaccctgaaccagagactggtgcccaagatcgccaccagaagcaaggtgaacggccagagcggcagaatggagttcttctggaccatcctgaagcccaacgacgccatcaacttcgagagcaacggcaacttcatcgcccccgagaacgcctacaagaactgccagaagggcgacagcaccatcatgaagagcgagctggagtacggcaactgcaacaccaagtgccagacccccatcggcgccatcaacagcagcatgcccttccacaacatccaccccctgaccatcggcgagtgccccaagtacgtgaagagcaacagactggtgctggccaccggcctgagaaacagcccccagggcgagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacagatgcgacaacgagtgcatggagagcgtgagaaacggcacctacgactacccccagtacagcgaggaggccagactgaagagagaggagatcagcggcgtgaagctggagagcatcggcacctaccagatcctgagcatctacagcaccgtggccagcagcctggccctggccatcatggtggccggcctgagcctgtggatgtgcagcaacggc

SEQ ID NO: 35960 - RNA, 1680 nt, synthetic construct; identical to SEQ ID NO: 35956
  misc_feature 1..1680: note = derived and/or modified sequence opt4 from anti-influenza_Chain
  source 1..1680: mol_type = other RNA

SEQ ID NO: 35961 - RNA, 1680 nt, synthetic construct; identical to SEQ ID NO: 35957
  misc_feature 1..1680: note = derived and/or modified sequence opt4 from anti-influenza_Chain
  source 1..1680: mol_type = other RNA

SEQ ID NO: 35962 - RNA, 1680 nt, synthetic construct; identical to SEQ ID NO: 35958
  misc_feature 1..1680: note = derived and/or modified sequence opt4 from anti-influenza_Chain
  source 1..1680: mol_type = other RNA

SEQ ID NO: 35963 - RNA, 1680 nt, synthetic construct; identical to SEQ ID NO: 35959
  misc_feature 1..1680: note = derived and/or modified sequence opt4 from anti-influenza_Chain
  source 1..1680: mol_type = other RNA

SEQ ID NO: 35964 - RNA, 1686 nt, synthetic construct
  misc_feature 1..1686: note = derived and/or modified sequence opt4 from anti-influenza_Chain
  source 1..1686: mol_type = other RNA
atgcccagagccctgagaagagtgcccggcagcagagtgatgctgagagtgggcgtggtggtggccgtgctggccctggtggccgccctggccaacctggccgtgcccagacccgccagagccgccggcggcggctactggcacaccagcggcagagagatcctggacgccaacaacgtgcccgtgagaatcgccggcatcaactggttcggcttcgagacctgcaactacgtggtgcacggcctgtggagcagagactacagaagcatgctggaccagatcaagagcctgggctacaacaccatcagactgccctacagcgacgacatcctgaagcccggcaccatgcccaacagcatcaacttctaccagatgaaccaggacctgcagggcctgaccagcctgcaggtgatggacaagatcgtggcctacgccggccagatcggcctgagaatcatcctggacagacacagacccgactgcagcggccagagcgccctgtggtacaccagcagcgtgagcgaggccacctggatcagcgacctgcaggccctggcccagagatacaagggcaaccccaccgtggtgggcttcgacctgcacaacgagccccacgaccccgcctgctggggctgcggcgaccccagcatcgactggagactggccgccgagagagccggcaacgccgtgctgagcgtgaaccccaacctgctgatcttcgtggagggcgtgcagagctacaacggcgacagctactggtggggcggcaacctgcagggcgccggccagtaccccgtggtgctgaacgtgcccaacagactggtgtacagcgcccacgactacgccaccagcgtgtacccccagacctggttcagcgaccccaccttccccaacaacatgcccggcatctggaacaagaactggggctacctgttcaaccagaacatcgcccccgtgtggctgggcgagttcggcaccaccctgcagagcaccaccgaccagacctggctgaagaccctggtgcagtacctgagacccaccgcccagtacggcgccgacagcttccagtggaccttctggagctggaaccccgacagcggcgacaccggcggcatcctgaaggacgactggcagaccgtggacaccgtgaaggacggctacctggcccccatcaagagcagcatcttcgaccccgtgggcgccagcgccagccccagcagccagcccagccccagcgtgagccccagccccagccccagccccagcgccagcagaacccccacccccacccccacccccaccgccagccccacccccaccctgacccccaccgccacccccacccccaccgccagccccacccccagccccaccgccgccagcggcgccagatgcaccgccagctaccaggtgaacagcgactggggcaacggcttcaccgtgaccgtggccgtgaccaacagcggcagcgtggccaccaagacctggaccgtgagctggaccttcggcggcaaccagaccatcaccaacagctggaacgccgccgtgacccagaacggccagagcgtgaccgccagaaacatgagctacaacaacgtgatccagcccggccagaacaccaccttcggcttccaggccagctacaccggcagcaacgccgcccccaccgtggcctgcgccgccagc

SEQ ID NO: 35965 - RNA, 1686 nt, synthetic construct
  misc_feature 1..1686: note = derived and/or modified sequence opt4 from anti-influenza_Chain
  source 1..1686: mol_type = other RNA
atggagagagtgtggtggaaggaggccgtggtgtaccagatctaccccagaagcttctacgacagcaacggcgacggcatcggcgacatcagaggcatcatcgccaagctggactacctgaaggagctgggcgtggacgtggtgtggctgagccccgtgtacaagagccccaacgacgacaacggctacgacatcagcgactacagagacatcatggacgagttcggcaccatggccgactggaagaccatgctggaggagatgcacaagagaggcatcaagctggtgatggacctggtggtgaaccacaccagcgacgagcacccctggttcatcgagagcagaaagagcaaggacaacccctacagagactactacatctggagacccggcaagaacggcaaggagcccaacaactgggagagcgtgttcagcggcagcgcctgggagtacgacgagatgaccggcgagtactacctgcacctgttcagcaagaagcagcccgacctgaactgggagaaccccaaggtgagaagagaggtgtacgagatgatgaagttctggctggacaagggcgtggacggcttcagaatggacgtgatcaacatgatcagcaaggtgcccgagctgcccgacggcgagccccagagcggcaagaagtacgccagcggcagcagatactacatgaacggccccagagtgcacgagttcctgcaggagatgaacagagaggtgctgagcaagtacgacatcatgaccgtgggcgagacccccggcgtgacccccaaggagggcatcctgtacaccgaccccagcagaagagagctgaacatggtgttccagttcgagcacatggacctggacagcggccccggcggcaagtgggacatcagaccctggagcctggccgacctgaagaagaccatgaccaagtggcagaaggagctggagggcaagggctggaacagcctgtacctgaacaaccacgaccagcccagagccgtgagcagattcggcgacgacggcaagtacagagtggagagcgccaagatgctggccaccttcctgcacatgatgcagggcaccccctacatctaccagggcgaggagatcggcatgaccaacgtgagattccccagcatcgaggactacagagacatcgagaccctgaacatgtacaaggagagagtggaggagtacggcgaggacccccaggaggtgatggagaagatctactacaagggcagagacaacgccagaacccccatgcagtgggacgacagcgagaacgccggcttcaccgccggcaccccctggatccccgtgaaccccaactacaaggagatcaacgtgaaggccgccctggaggaccccaacagcgtgttccactactacaagaagctgatccagctgagaaagcagcacgacatcatcgtgtacggcacctacgacctgatcctggaggacgacccctacatctacagatacaccagaaccctgggcaacgagcagctgatcgtgatcaccaacttcagcgagaagacccccgtgttcagactgcccgaccacatcatctacaagaccaaggagctgctgatcagcaactacgacgtggacgaggccgaggagctgaaggagatcagactgagaccctgggaggccagagtgtacaagatcagactgccc

SEQ ID NO: 35966 - RNA, 1686 nt, synthetic construct; identical to SEQ ID NO: 35964
  misc_feature 1..1686: note = derived and/or modified sequence opt4 from anti-influenza_Chain
  source 1..1686: mol_type = other RNA

SEQ ID NO: 35967 - RNA, 1686 nt, synthetic construct; identical to SEQ ID NO: 35965
  misc_feature 1..1686: note = derived and/or modified sequence opt4 from anti-influenza_Chain
  source 1..1686: mol_type = other RNA

SEQ ID NO: 35968 - RNA, 1689 nt, synthetic construct
  misc_feature 1..1689: note = derived and/or modified sequence opt4 from anti-influenza_Chain
  source 1..1689: mol_type = other RNA
atggagaagatcgtgctgctgttcgccatcgtgagcctggtgaagagcgaccagatctgcatcggctaccacgccaacaacagcaccgagcaggtggacaccatcatggagaagaacgtgaccgtgacccacgcccaggacatcctggagaagaagcacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgtgaacgacctgtgctaccccggcgacttcaacgactacgaggagctgaagcacctgctgagcagaatcaaccacttcgagaagatccagatcatccccaagagcagctggagcagccacgaggccagcctgggcgtgagcagcgcctgcccctaccagggcaagaccagcttcttcagaaacgtggtgtggctgatcaagaagaacagcacctaccccaccatcaagagaagctacaacaacaccaaccaggaggacctgctggtgctgtggggcatccaccaccccaacgacgccgccgagcagaccaagctgtaccagaaccccaccacctacatcagcgtgggcaccagcaccctgaaccagagactggtgcccagaatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagaccagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagatcctgagcatctacagcaccgtggccagcagcctggccctggccatcatggtggccggcctgagcctgtggatgtgcagcaacggcagcctgcagtgcagaatctgc

SEQ ID NO: 35969 - RNA, 1689 nt, synthetic construct; identical to SEQ ID NO: 35968
  misc_feature 1..1689: note = derived and/or modified sequence opt4 from anti-influenza_Chain
  source 1..1689: mol_type = other RNA

SEQ ID NO: 35970 - RNA, 1692 nt, synthetic construct
  misc_feature 1..1692: note = derived and/or modified sequence opt4 from anti-influenza_Chain
  source 1..1692: mol_type = other RNA
atggagaagatcgtgctgctgttcgccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcagcctgaacggcgtgaagcccctgatcctgagagactgcagcgtggccggctggctgctgggcaaccccatgtgcgacgagttcctgaacgtgcccgagtggagctacatcgtggagaaggacagccccatcaacggcctgtgctaccccggcgacttcaacgactacgaggagctgaagcacctgctgagcagcaccaaccacttcgagaagatccagatcatccccagaagcagctggagcgaccacgacgccagcagcggcgtgagcagcgcctgcccctacaacggcagaagcagcttcttcagaaacgtggtgtggctgatcaagaagaacaacgcctaccccaccatcaagagaaactacaacaacaccaaccaggaggacctgctggtgctgtggggcatccaccaccccaacgacgccaccgagcagaccaagctgtaccagaaccccaccacctacgtgagcgtgggcaccagcaccctgaaccagagaagcgtgcccgagatcgccaccagacccaaggtgaacggccagagcggcagaatcgagttcttctggaccatcctgaagcccaacgacgccatcaacttcgagagcaacggcaacttcatcgcccccgagtacgcctacaagatcgccaagaagggcgacagcgccatcatgaagagcggcctggagtacggcaactgcaacaccaagtgccagacccccatgggcgccatcaacagcagcatgcccttccacaacatccaccccctgaccatcggcgagtgccccagatacgtgaagagcgacagactggtgctggccaccggcctgagaaacgtgccccagagagagaccagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcatcaccaacaaggtgaacagcatcatcgacaagatgaacacccagttcgaggccgtgggcaaggagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacgacgagtgcatggagagcgtgagaaacggcacctacgactacccccagtacagcgaggaggccagactgaacagagaggagatcagcggcgtgaagctggagagcatcggcacctaccagatcctgagcatctacagcaccgtggccagcagcctggccctggccatcatggtggccggcctgagcttctggatgtgcagcaacggcagcctgcagtgcagaatctgcatc

SEQ ID NO: 35971 - RNA, 1692 nt, synthetic construct; identical to SEQ ID NO: 35970
  misc_feature 1..1692: note = derived and/or modified sequence opt4 from anti-influenza_Chain
  source 1..1692: mol_type = other RNA

SEQ ID NO: 35972 - RNA, 1695 nt, synthetic construct
  misc_feature 1..1695: note = derived and/or modified sequence opt4 from anti-influenza_Chain
  source 1..1695: mol_type = other RNA
atggagaagatcgtgctgctgttcgccatcgtgagcctggtgaagagcgaccagatctgcatcggctaccacgccaacaacagcaccgagcaggtggacaccatcatggagaagaacgtgaccgtgacccacgcccaggacatcctggagaagaagcacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgtgaacgacctgtgctaccccggcgacttcaacgactacgaggagctgaagcacctgctgagcagaatcaaccacttcgagaagatccagatcatccccaagagcagctggagcagccacgaggccagcctgggcgtgagcagcgcctgcccctaccagggcaagagcagcttcttcagaaacgtggtgtggctgatcaagaagaacagcacctaccccaccatcaagagaagctacaacaacaccaaccaggaggacctgctggtgctgtggggcatccaccaccccaacgacgccgccgagcagaccaagctgtaccagaaccccaccacctacatcagcgtgggcaccagcaccctgaaccagagactggtgcccagaatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagatcctgagcatctacagcaccgtggccagcagcctggccctggccatcatggtggccggcctgagcctgtggatgtgcagcaacggcagcctgcagtgcaga

SEQ ID NO: 35973 - RNA, 1695 nt, synthetic construct
  misc_feature 1..1695: note = derived and/or modified sequence opt4 from anti-influenza_Chain
  source 1..1695: mol_type = other RNA
atggagaagatcgtgctgctgttcgccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgtgaacgacctgtgctaccccggcgacttcaacgactacgaggagctgaagcacctgctgagcagaatcaaccacttcgagaagatccagatcatccccaagagcagctggagcagccacgaggccagcctgggcgtgagcagcgcctgcccctaccagggcaagagcagcttcttcagaaacgtggtgtggctgatcaagaagaacagcacctaccccaccatcaagagaagctacaacaacaccaaccaggaggacctgctggtgctgtggggcatccaccaccccaacgacgccgccgagcagaccaagctgtaccagaaccccaccacctacatcagcgtgggcaccagcaccctgaaccagagactggtgcccagaatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagatcctgagcatctacagcaccgtggccagcagcctggccctggccatcatggtggccggcctgagcctgtggatgtgcagcaacggcagcctgcagtgcaga

SEQ ID NO: 35974 - RNA, 1695 nt, synthetic construct
  misc_feature 1..1695: note = derived and/or modified sequence opt4 from anti-influenza_Chain
  source 1..1695: mol_type = other RNA
atggagaagatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcaagagcagcttcttcagaaacgtggtgtggctgatcaagaagaacagcagctaccccaccatcaagagaagctacaacaacaccaaccaggaggacctgctggtgctgtggggcatccaccaccccaacgacgccgccgagcagaccagactgtaccagaaccccaccacctacatcagcgtgggcaccagcaccctgaaccagagactggtgcccaagatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcgccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagatcctgagcatctacagcaccgtggccagcagcctggccctggccatcatggtggccggcctgagcctgtggatgtgcagcaacggcagcctgcagtgcaga

SEQ ID NO: 35975 - RNA, 1695 nt, synthetic construct
  misc_feature 1..1695: note = derived and/or modified sequence opt4 from anti-influenza_Chain
  source 1..1695: mol_type = other RNA
atgagcgacagaagacagaacagaaagacccccgacgagcagagaaaggccaacgccctgatcatcaacgagaacatcgaggcctacatcgccatctgcaaggaggtgggcctgaacggcgacgagatgctgatcctggagaacggcatcgccatcgagaaggccatcagaatctgctgcgacggcaagtaccaggagaagagagagaagaaggccagagaggcccagagagccgacagcaacttcaacgccgacagcatcggcatcagactggtgaagagagccggcagcggcaccaacatcacctaccacgccgtggtggagctgaccagcagaagcagaatcgtgcagatcctgaagagccactggggcaacgagctgaacagagccaagatcgccggcaagagactgggcttcagcgccctgttcgccagcaacctggaggccatcatctaccagagaggcagaaacgccgccagaagaaacggcagcgccgagctgttcaccctgacccagggcgccggcatcgagaccagatacaagtggatcatggagaagcacatcggcatcggcgtgctgatcgccgacgccaagggcctgatcaacggcaagagagagggcaagagaggcgtggacgccaacgtgaagctgagagccggcaccaccggcagccccctggagagagccatgcagggcatcgagaagaaggccttccccggccccctgagagccctggccagaagagtggtgaaggccaactacaacgacgccagagaggccctgaacgtgatcgccgaggccagcctgctgctgaagccccagatcaccaacaagatgaccatgccctggtgcatgtggctggccgccagactgaccctgaaggacgagttcgccaacttctgcgcctacgccggcagaagagccttcgaggtgttcaacatcgccatggagaagatcggcatctgcagcttccagggcaccatcatgaacgacgacgagatcgagagcatcgaggacaaggcccaggtgctgatgatggcctgcttcggcctggcctacgaggacttcagcctggtgagcgccatggtgagccaccccctgaagctgagaaacagaatgaagatcggcaacttcagagtgggcgagaaggtgagcaccgtgctgagccccctgctgagattcaccagatgggccgagttcgcccagagattcgccctgcaggccaacaccagcagagagggcgcccagatcagcaacagcgccgtgttcgccgtggagagaaagatcaccaccgacgtgcagagagtggaggagctgctgaacaaggtgcaggcccacgaggacgagcccctgcagaccctgtacaagaaggtgagagagcagatcagcatcatcggcagaaacaagagcgagatcaaggagttcctgggcagcagcatgtacgacctgaacgaccaggagaagcagaaccccatcaacttcagaagcggcgcccaccccttcttcttcgagttcgaccccgactacaaccccatcagagtgaagagacccaagaagcccatcgccaagagaaacagcaacatcagcagactggaggaggagggcatggacgagaacagcgagatcggccaggccaagaagatgaagcccctggaccagctgaccagcaccagcagcaacatccccggcaagaac

SEQ ID NO: 35976 - RNA, 1695 nt, synthetic construct
  misc_feature 1..1695: note = derived and/or modified sequence opt4 from anti-influenza_Chain
  source 1..1695: mol_type = other RNA
atgaaggtgaagctgctggtgctgctgtgcaccttcaccgccacctacgccgacaccatctgcatcggctaccacgccaacaacagcaccgacaccgtggacaccgtgctggagaagaacgtgaccgtgacccacagcgtgaacctgctggagaacagccacaacggcaagctgtgcctgctgaagggcatcgcccccctgcagctgggcaactgcagcgtggccggctggatcctgggcaaccccgagtgcgagctgctgatcagcaaggagagctggagctacatcgtggagaagcccaaccccgagaacggcacctgctaccccggccacttcgccgactacgaggagctgagagagcagctgagcagcgtgagcagcttcgagagattcgagatcttccccaaggagagcagctggcccaaccacaccgtgaccggcgtgagcgccagctgcagccacaacggcgagagcagcttctacagaaacctgctgtggctgaccggcaagaacggcctgtaccccaacctgagcaagagctacgccaacaacaaggagaaggaggtgctggtgctgtggggcgtgcaccacccccccaacatcggcgaccagaaggccctgtaccacaccgagaacgcctacgtgagcgtggtgagcagccactacagcagaaagttcacccccgagatcgccaagagacccaaggtgagagaccaggagggcagaatcaactaccactggaccctgctggagcccggcgacaccatcatcttcgaggccaacggcaacctgatcgcccccagatacgccttcaccctgagcagaggcttcggcagcggcatcatcaacagcaacgcccccatggacaagtgcgacgccaagtgccagaccccccagggcgccatcaacagcagcctgcccttccagaacgtgcaccccgtgaccatcggcgagtgccccaagtacgtgagaagcgccaagctgagaatggtgaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacaaggtgaacagcgtgatcgagaagatgaacacccagttcaccgccgtgggcaaggagttcaacaagctggagagaagaatggagaacctgaacaagaaggtggacgacggcttcatcgacatctggacctacaacgccgagctgctggtgctgctggagaacgagagaaccctggacttccacgacagcaacgtgaagaacctgtacgagaaggtgaagagccagctgaagaacaacgccaaggagatcggcaacggctgcttcgagttctaccacaagtgcaacgacgagtgcatggagagcgtgaagaacggcacctacgactaccccaagtacagcgaggagagcaagctgaacagagagaagatcgacggcgtgaagctggagagcatgggcgtgtaccagatcctggccatctacagcaccgtggccagcagcctggtgctgctggtgagcctgggcgccatcagcttctggatgtgcagcaacggcagcctgcagtgcagaatctgcatc

SEQ ID NO: 35977 - RNA, 1695 nt, synthetic construct
  misc_feature 1..1695: note = derived and/or modified sequence opt4 from anti-influenza_Chain
  source 1..1695: mol_type = other RNA
atgaaggtgaagctgctggtgctgctgtgcaccttcaccgccacctacgccgacaccatctgcatcggctaccacgccaacaacagcaccgacaccgtggacaccgtgctggagaagaacgtgaccgtgacccacagcgtgaacctgctggagaacagccacaacggcaagctgtgcctgctgaagggcatcgcccccctgcagctgggcaactgcagcgtggccggctggatcctgggcaaccccgagtgcgagctgctgatcagcaaggagagctggagctacatcgtggagaagcccaaccccgagaacggcacctgctaccccggccacttcgccgactacgaggagctgagagagcagctgagcagcgtgagcagcttcgagagattcgagatcttccccaaggagagcagctggcccaaccacaccgtgaccggcgtgagcgccagctgcagccacaacggcgagagcagcttctacagaaacctgctgtggctgaccggcaagaacggcctgtaccccaacctgagcaagagctacgccaacaacaaggagaaggaggtgctggtgctgtggggcgtgcaccacccccccaacatcggcgaccagaagaccctgtaccacaccgagaacgcctacgtgagcgtggtgagcagccactacagcagaaagttcacccccgagatcgccaagagacccaaggtgagagaccaggagggcagaatcaactactactggaccctgctggagcccggcgacaccatcatcttcgaggccaacggcaacctgatcgcccccagatacgccttcgccctgagcagaggcttcggcagcggcatcatcaacagcaacgcccccatggacaagtgcgacgccaagtgccagaccccccagggcgccatcaacagcagcctgcccttccagaacgtgcaccccgtgaccatcggcgagtgccccaagtacgtgagaagcgccaagctgagaatggtgaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacaaggtgaacagcgtgatcgagaagatgaacacccagttcaccgccgtgggcaaggagttcaacaagctggagagaagaatggagaacctgaacaagaaggtggacgacggcttcatcgacatctggacctacaacgccgagctgctggtgctgctggagaacgagagaaccctggacttccacgacagcaacgtgaagaacctgtacgagaaggtgaagagccagctgaagaacaacgccaaggagatcggcaacggctgcttcgagttctaccacaagtgcaacgacgagtgcatggagagcgtgaagaacggcacctacgactaccccaagtacagcgaggagagcaagctgaacagagagaagatcgacggcgtgaagctggagagcatgggcgtgtaccagatcctggccatctacagcaccgtggccagcagcctggtgctgctggtgagcctgggcgccatcagcttctggatgtgcagcaacggcagcctgcagtgcagaatctgcatc

SEQ ID NO: 35978 - RNA, 1695 nt, synthetic construct
  misc_feature 1..1695: note = derived and/or modified sequence opt4 from anti-influenza_Chain
  source 1..1695: mol_type = other RNA
atgaaggtgaagctgctggtgctgctgtgcaccttcaccgccacctacgccgacaccatctgcatcggctaccacgccaacaacagcaccgacaccgtggacaccgtgctggagaagaacgtgaccgtgacccacagcgtgaacctgctggagaacagccacaacggcaagctgtgcctgctgaagggcatcgcccccctgcagctgggcaactgcagcgtggccggctggatcctgggcaaccccgagtgcgagctgctgatcagcaaggagagctggagctacatcgtggagaagcccaaccccgagaacggcacctgctaccccggccacttcgccgactacgaggagctgagagagcagctgagcagcgtgagcagcttcgagagattcgagatcttccccaaggagagcagctggcccaaccacaccgtgaccggcgtgagcgccagctgcagccacaacggcgagagcagcttctacagaaacctgctgtggctgaccggcaagaacggcctgtaccccaacctgagcaagagctacgccaacaacaaggagaaggaggtgctggtgctgtggggcgtgcaccacccccccgacatcggcgaccagaagaccctgtaccacaccgagaacgcctacgtgagcgtggtgagcagccactacagcagaaagttcacccccgagatcgccaagagacccaaggtgagagaccaggagggcagaatcaactactactggaccctgctggagcccggcgacaccatcatcttcgaggccaacggcaacctgatcgcccccagatacgccttcgccctgagcagaggcttcggcagcggcatcatcaacagcaacgcccccatggacaagtgcgacgccaagtgccagaccccccagggcgccatcaacagcagcctgcccttccagaacgtgcaccccgtgaccatcggcgagtgccccaagtacgtgagaagcgccaagctgagaatggtgaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacaaggtgaacagcgtgatcgagaagatgaacacccagttcaccgccgtgggcaaggagttcaacaagctggagagaagaatggagaacctgaacaagaaggtggacgacggcttcatcgacatctggacctacaacgccgagctgctggtgctgctggagaacgagagaaccctggacttccacgacagcaacgtgaagaacctgtacgagaaggtgaagagccagctgaagaacaacgccaaggagatcggcaacggctgcttcgagttctaccacaagtgcaacgacgagtgcatggagagcgtgaagaacggcacctacgactaccccaagtacagcgaggagagcaagctgaacagagagaagatcgacggcgtgaagctggagagcatgggcgtgtaccagatcctggccatctacagcaccgtggccagcagcctggtgctgctggtgagcctgggcgccatcagcttctggatgtgcagcaacggcagcctgcagtgcagaatctgcatc

SEQ ID NO: 35979 - RNA, 1695 nt, synthetic construct
  misc_feature 1..1695: note = derived and/or modified sequence opt4 from anti-influenza_Chain
  source 1..1695: mol_type = other RNA
atgaaggtgaagctgctggtgctgctgtgcaccttcaccgccacctacgccgacaccatctgcatcggctaccacgccaacaacagcaccgacaccgtggacaccgtgctggagaagaacgtgaccgtgacccacagcgtgaacctgctggagaacagccacaacggcaagctgtgcctgctgaagggcatcgcccccctgcagctgggcaactgcagcgtggccggctggatcctgggcaaccccgagtgcgagctgctgatcagcaaggagagctggagctacatcgtggagaagcccaaccccgagaacggcacctgctaccccggccacttcgccgactacgaggagctgagagagcagctgagcagcgtgagcagcttcgagagattcgagatcttccccaaggagagcagctggcccaaccacaccgtgaccggcgtgagcgccagctgcagccacaacggcgagagcagcttctacagaaacctgctgtggctgaccggcaagaacggcctgtaccccaacctgagcaagagctacgccaacaacaaggagaaggaggtgctggtgctgtggggcgtgcaccacccccccaacatcggcgaccagaaggccctgtaccacaccgagaacgcctacgtgagcgtggtgagcagccactacagcagaaagttcacccccgagatcgccaagagacccaaggtgagagaccaggagggcagaatcaactactactggaccctgctggagcccggcgacaccatcatcttcgaggccaacggcaacctgatcgcccccagatacgccttcgccctgagcagaggcttcggcagcggcatcatcaacagcaacgcccccatggacaagtgcgacgccaagtgccagaccccccagggcgccatcaacagcagcctgcccttccagaacgtgcaccccgtgaccatcggcgagtgccccaagtacgtgagaagcgccaagctgagaatggtgaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacaaggtgaacagcgtgatcgagaagatgaacacccagttcaccgccgtgggcaaggagttcaacaagctggagagaagaatggagaacctgaacaagaaggtggacgacggcttcatcgacatctggacctacaacgccgagctgctggtgctgctggagaacgagagaaccctggacttccacgacagcaacgtgaagaacctgtacgagaaggtgaagagccagctgaagaacaacgccaaggagatcggcaacggctgcttcgagttctaccacaagtgcaacgacgagtgcatggagagcgtgaagaacggcacctacgactaccccaagtacagcgaggagagcaagctgaacagagagaagatcgacggcgtgaagctggagagcatgggcgtgtaccagatcctggccatctacagcaccgtggccagcagcctggtgctgctggtgagcctgggcgccatcagcttctggatgtgcagcaacggcagcctgcagtgcagaatctgcatc

SEQ ID NO: 35980 - RNA, 1695 nt, synthetic construct
  misc_feature 1..1695: note = derived and/or modified sequence opt4 from anti-influenza_Chain
  source 1..1695: mol_type = other RNA
atgaaggccaagctgctggtgctgctgtgcaccttcaccgccacctacgccgacaccatctgcatcggctaccacgccaacaacagcaccgacaccgtggacaccgtgctggagaagaacgtgaccgtgacccacagcgtgaacctgctggaggacagccacaacggcaagctgtgcctgctgaagggcatcgcccccctgcagctgggcaactgcagcgtggccggctggatcctgggcaaccccgagtgcgagctgctgatcagcaaggagagctggagctacatcgtggagacccccaaccccgagaacggcacctgctaccccggctacttcgccgactacgaggagctgagagagcagctgagcagcgtgagcagcttcgagagattcgagatcttccccaaggagagcagctggcccaaccacaccgtgaccggcgtgagcgccagctgcagccacaacggcaagagcagcttctacagaaacctgctgtggctgaccggcaagaacggcctgtaccccaacctgagcaagagctacgtgaacaacaaggagaaggaggtgctggtgctgtggggcgtgcaccacccccccaacatcggcaaccagagagccctgtaccacaccgagaacgcctacgtgagcgtggtgagcagccactacagcagaagattcacccccgagatcgccaagagacccaaggtgagagaccaggagggcagaatcaactactactggaccctgctggagcccggcgacaccatcatcttcgaggccaacggcaacctgatcgccccctggtacgccttcgccctgagcagaggcttcggcagcggcatcatcaccagcaacgcccccatggacgagtgcgacgccaagtgccagaccccccagggcgccatcaacagcagcctgcccttccagaacgtgcaccccgtgaccatcggcgagtgccccaagtacgtgagaagcgccaagctgagaatggtgaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacaaggtgaacagcgtgatcgagaagatgaacacccagttcaccgccgtgggcaaggagttcaacaagctggagagaagaatggagaacctgaacaagaaggtggacgacggcttcctggacatctggacctacaacgccgagctgctggtgctgctggagaacgagagaaccctggacttccacgacagcaacgtgaagaacctgtacgagaaggtgaagagccagctgaagaacaacgccaaggagatcggcaacggctgcttcgagttctaccacaagtgcaacaacgagtgcatggagagcgtgaagaacggcacctacgactaccccaagtacagcgaggagagcaagctgaacagagagaagatcgacggcgtgaagctggagagcatgggcgtgtaccagatcctggccatctacagcaccgtggccagcagcctggtgctgctggtgagcctgggcgccatcagcttctggatgtgcagcaacggcagcctgcagtgcagaatctgcatc

SEQ ID NO: 35981 - RNA, 1695 nt, synthetic construct
  misc_feature 1..1695: note = derived and/or modified sequence opt4 from anti-influenza_Chain
  source 1..1695: mol_type = other RNA
atgaaggtgaagctgctggtgctgctgtgcaccttcaccgccacctacgccgacaccatctgcatcggctaccacgccaacaacagcaccgacaccgtggacaccgtgctggagaagaacgtgaccgtgacccacagcgtgaacctgctggaggacagccacaacggcaagctgtgcctgctgaagggcatcgcccccctgcagctgggcaactgcagcgtggccggctggatcctgggcaaccccgagtgcgagctgctgatcagcagagagagctggagctacatcgtggagaagcccaaccccgagaacggcacctgctaccccggccacttcgccgactacgaggagctgagagagcagctgagcagcgtgagcagcttcgagagattcgagatcttccccaaggagagcagctggcccaaccacaccaccaccggcgtgagcgccagctgcagccacaacggcgagagcagcttctacaagaacctgctgtggctgaccggcaagaacggcctgtaccccaacctgagcaagagctacgccaacaacaaggagaaggaggtgctggtgctgtggggcgtgcaccacccccccaacatcggcgaccagagagccctgtaccacaaggagaacgcctacgtgagcgtggtgagcagccactacagcagaaagttcacccccgagatcgccaagagacccaaggtgagagaccaggagggcagaatcaactactactggaccctgctggagcccggcgacaccatcatcttcgaggccaacggcaacctgatcgcccccagatacgccttcgccctgagcagaggcttcggcagcggcatcatcaacagcaacgcccccatggacgagtgcgacgccaagtgccagaccccccagggcgccatcaacagcagcctgcccttccagaacgtgcaccccgtgaccatcggcgagtgccccaagtacgtgagaagcgccaagctgagaatggtgaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacaaggtgaacagcgtgatcgagaagatgaacacccagttcaccgccgtgggcaaggagttcaacaagctggagagaagaatggagaacctgaacaagaaggtggacgacggcttcatcgacatctggacctacaacgccgagctgctggtgctgctggagaacgagagaaccctggacttccacgacagcaacgtgaagaacctgtacgagaaggtgaagagccagctgaagaacaacgccaaggagatcggcaacggctgcttcgagttctaccacaagtgcaacgacgagtgcatggagagcgtgaagaacggcacctacgactaccccaagtacagcgaggagagcaagctgaacagagagaagatcgacggcgtgaagctggagagcatgggcgtgtaccagatcctggccatctacagcaccgtggccagcagcctggtgctgctggtgagcctgggcgccatcagcttctggatgtgcagcaacggcagcctgcagtgcagaatctgcatc

SEQ ID NO: 35982 - RNA, 1677 nt, synthetic construct
  misc_feature 1..1677: note = derived and/or modified sequence opt4 from anti-influenza_Chain
  source 1..1677: mol_type = other RNA
gacaagatctgcatcggctaccagagcaccaacagcaccgagaccgtggacaccctgaccaagaccaacgtgcccgtgacccaggccaaggagctgctgcacaccgagcacaacggcatgctgtgcgccaccaacctgggccaccccctgatcctggacacctgcaccatcgagggcctgatctacggcaaccccagctgcgacctgctgctgggcggcagagagtggagctacatcgtggagagacccagcgccgtgaacggcatgtgctaccccggcaacgtggagaacctggaggagctgagactgctgttcagcagcgccagcagctaccagagagtgcagatcttccccgacaccatctggaacgtgacctacagcggcaccagcagcgcctgcagcaacagcttctacagaagcatgagatggctgacccagaaggacaacacctaccccgtgcaggacgcccagtacaccaacaacagaggcaagagcatcctgttcatgtggggcatcaaccacccccccaccgacaccgtgcagaccaacctgtacaccagaaccgacaccaccaccagcgtgaccaccgaggacatcaacagagccttcaagcccgtgatcggccccagacccctggtgaacggcctgcagggcagaatcgactactactggagcgtgctgaagcccggccagaccctgagagtgagaagcaacggcaacctgatcgccccctggtacggccacatcctgagcggcgagagccacggcagaatcctgaagagcgacctgaacagcggcaactgcgtggtgcagtgccagaccgagagaggcggcctgaacaccaccctgcccttccacaacgtgagcaagtacgccttcggcaactgccccaagtacgtgggcgtgaagagcctgaagctggccgtgggcatgagaaacgtgcccgccagaagcagcagaggcctgttcggcgccatcgccggcttcatcgagggcggctggcccggcctggtggccggctggtacggcttccagcacagcaacgaccagggcgtgggcatggccgccgacagagacagcacccagaaggccatcgacaagatcaccagcaaggtgaacaacatcgtggacaagatgaacaagcagtacgagatcatcgaccacgagttcagcgagatcgagaccagactgaacatgatcaacaacaagatcgacgaccagatccaggacatctgggcctacaacgccgagctgctggtgctgctggagaaccagaagaccctggacgagcacgacgccaacgtgaacaacctgtacaacaaggtgaagagagccctgggcagcaacgccatggaggacggcaagggctgcttcgagctgtaccacaagtgcgacgacagatgcatggagaccatcagaaacggcacctacaacagaggcaagtacaaggaggagagcagactggagagacagaagatcgagggcgtgaagctggagagcgagggcacctacaagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 35983 - RNA, 1677 nt, synthetic construct; identical to SEQ ID NO: 35982
  misc_feature 1..1677: note = derived and/or modified sequence opt4 from anti-influenza_Chain
  source 1..1677: mol_type = other RNA

SEQ ID NO: 35984 - RNA, 1695 nt, synthetic construct; identical to SEQ ID NO: 35975
  misc_feature 1..1695: note = derived and/or modified sequence opt4 from anti-influenza_Chain
  source 1..1695: mol_type = other RNA

SEQ ID NO: 35985 - RNA, 1695 nt, synthetic construct; identical to SEQ ID NO: 35972
  misc_feature 1..1695: note = derived and/or modified sequence opt4 from anti-influenza_Chain
  source 1..1695: mol_type = other RNA

SEQ ID NO: 35986 - RNA, 1695 nt, synthetic construct; identical to SEQ ID NO: 35973
  misc_feature 1..1695: note = derived and/or modified sequence opt4 from anti-influenza_Chain
  source 1..1695: mol_type = other RNA

SEQ ID NO: 35987 - RNA, 1695 nt, synthetic construct; identical to SEQ ID NO: 35974
  misc_feature 1..1695: note = derived and/or modified sequence opt4 from anti-influenza_Chain
  source 1..1695: mol_type = other RNA

SEQ ID NO: 35988 - RNA, 1695 nt, synthetic construct; identical to SEQ ID NO: 35976
  misc_feature 1..1695: note = derived and/or modified sequence opt4 from anti-influenza_Chain
  source 1..1695: mol_type = other RNA

SEQ ID NO: 35989 - RNA, 1695 nt, synthetic construct; identical to SEQ ID NO: 35977
  misc_feature 1..1695: note = derived and/or modified sequence opt4 from anti-influenza_Chain
  source 1..1695: mol_type = other RNA

SEQ ID NO: 35990 - RNA, 1695 nt, synthetic construct; identical to SEQ ID NO: 35978
  misc_feature 1..1695: note = derived and/or modified sequence opt4 from anti-influenza_Chain
  source 1..1695: mol_type = other RNA

SEQ ID NO: 35991 - RNA, 1695 nt, synthetic construct; identical to SEQ ID NO: 35979
  misc_feature 1..1695: note = derived and/or modified sequence opt4 from anti-influenza_Chain
  source 1..1695: mol_type = other RNA

SEQ ID NO: 35992 - RNA, 1695 nt, synthetic construct; identical to SEQ ID NO: 35980
  misc_feature 1..1695: note = derived and/or modified sequence opt4 from anti-influenza_Chain
  source 1..1695: mol_type = other RNA

SEQ ID NO: 35993 - RNA, 1695 nt, synthetic construct; identical to SEQ ID NO: 35981
  misc_feature 1..1695: note = derived and/or modified sequence opt4 from anti-influenza_Chain
  source 1..1695: mol_type = other RNA

SEQ ID NO: 35994 - RNA, 1698 nt, synthetic construct
  misc_feature 1..1698: note = derived and/or modified sequence opt4 from anti-influenza_Chain
  source 1..1698: mol_type = other RNA
atgaagaccatcatcgccctgagctacatcctgtgcctggtgttcgcccagaagctgcccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcggcatctgcgacagcccccaccagatcctggacggcgagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaacaacgagagcttcaactggaccggcgtgacccagaacggcaccagcagcgcctgcaagagaagaagcaacaacagcttcttcagcagactgaactggctgacccacctgaagttcaagtaccccgccctgaacgtgaccatgcccaacaacgagaagttcgacaagctgtacatctggggcgtgcaccaccccggcaccgacaacgaccagatcagcctgtacgcccaggccagcggcagaatcaccgtgagcaccaagagaagccagcagaccgtgatccccagcatcggcagcagacccagaatcagagacgtgcccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcaccggccaggccgccgacctgaagagcacccaggccgccatcaaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagagaaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcgtggagctgaagagcggctacaaggactggatcctgtggatcagcttcgccatcagctgcttcctgctgtgcgtggccctgctgggcttcatcatgtgggcctgccagaagggcaacatcagatgcaacatctgcatc

SEQ ID NO: 35995 - RNA, 1698 nt, synthetic construct
  misc_feature 1..1698: note = derived and/or modified sequence opt4 from anti-influenza_Chain
  source 1..1698: mol_type = other RNA
atgaagaccatcatcgccctgagctacatcctgtgcctggtgagcgcccagaagttccccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcgagatctgcgacagcccccaccagatcctggacggcgagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaacaacgagagcttcaactggaccggcgtgacccagaacggcaccagcagcgcctgcatcagaagaagcaacaacagcttcttcagcagactgaactggctgacccacctgaagttcaagtaccccgccctgaacgtgaccatgcccaacaacgaggagttcgacaagctgtacatctggggcgtgcaccaccccggcaccgacaacgaccagatcttcctgtacgcccaggccagcggcagaatcaccgtgagcaccaagagaagccagcagaccgtgatccccaacatcagaagcagacccagagtgagaaacatccccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcatcggccaggccgccgacctgaagagcacccaggccgccatcgaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagaagaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcgtggagctgaagagcggctacaaggactggatcctgtggatcagcttcgccatcagctgcttcctgctgtgcgtggccctgctgggcttcatcatgtgggcctgccagaagggcaacatcagatgcaacatctgcatc

SEQ ID NO: 35996 - RNA, 1698 nt, synthetic construct
  misc_feature 1..1698: note = derived and/or modified sequence opt4 from anti-influenza_Chain
  source 1..1698: mol_type = other RNA
atgaagaccatcatcgccctgagctacatcctgtgcctggtgttcgcccagaagctgcccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcgagatctgcgacagcccccaccagatcctggacggcgagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaagaacgagagcttcaactggaccggcgtgacccagaacggcaccagcagcgcctgcatcagaagaagcaacaacagcttcttcagcagactgaactggctgacccacctgaagttcaagtaccccgccctgaacgtgaccatgcccaacaaggagaagttcgacaagctgtacatctggggcgtgcaccaccccggcaccgacaacgaccagatcttcctgtacgcccaggccagcggcagaatcaccgtgagcaccaagagaagccagcagaccgtgatccccaacatcggcagcagactgagagtgagagacatccccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcaccggccaggccgccgacctgaagagcacccaggccgccatcgaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagaagaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcgtggagctgaagagcggctacaaggactggatcctgtggatcagcttcgccatcagctgcttcctgctgtgcgtggccctgctgggcttcatcatgtgggcctgccagaagggcaacatcagatgcaacatctgcatc

SEQ ID NO: 35997 - RNA, 1698 nt, synthetic construct
  misc_feature 1..1698: note = derived and/or modified sequence opt4 from anti-influenza_Chain
  source 1..1698: mol_type = other RNA
atgaagaccatcatcgccctgagctacatcctgtgcctggtgttcgcccagaagctgcccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcgagatctgcgacagcccccaccagatcctggacggcgagaactgcaccctgatcgacgccctgctgggcgacccccagtgcgacggcttccagaacaagaagtgggacctgttcgtggagagaagcaaggcctacagcaagtgctacccctacgacgtgcccgactacgccagcctgagaagcctggtggccagcagcggcaccctggagttcaacaacgagagcttcaactggaccggcgtgacccagaacggcaccagcagcgcctgcatcagaagaagcaacaacagcttcttcagcagactgaactggctgacccacctgaagttcaagtaccccgccctgaacgtgaccatgcccaacaacgagaagttcgacaagctgtacatctggggcgtgcaccaccccggcaccgacaacgaccagatcttcctgtacgcccaggccagcggcagaatcaccgtgagcaccaagagaagccagcagaccgtgatccccaacatcggcagcagacccagagtgagagacatccccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcatcggccaggccgccgacctgaagagcacccaggccgccatcgaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagaagaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcgtggagctgaagagcggctacaaggactggatcctgtggatcagcttcgccatcagctgcttcctgctgtgcgtggccctgctgggcttcatcatgtgggcctgccagaagggcaacatcagatgcaacatctgcatc

SEQ ID NO: 35998 - RNA, 1698 nt, synthetic construct
  misc_feature 1..1698: note = derived and/or modified sequence opt4 from anti-influenza_Chain
  source 1..1698: mol_type = other RNA
atgaagaccatcatcgccctgagctacatcctgtgcctggtgttcgcccagaagctgcccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcgagatctgcgacagcccccaccagatcctggacggcgagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaacaacgagagcttcaactggaccggcgtgacccagaacggcaccagcagcgcctgcatcagaagaagcaacaacagcttcttcagcagactgaactggctgacccacctgaagttcaagtaccccgccctgaacgtgaccatgcccaacaacgagaagttcgacaagctgtacatctggggcgtgcaccaccccggcaccgacaacgaccagatcttcctgtacgcccaggccagcggcagaatcaccgtgagcaccaagagaagccagcagaccgtgatccccaacatcggcagcagacccagagtgagaaacatccccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcatcggccaggccgccgacctgaagagcacccaggccgccatcgaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagaagaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcgtggagctgaagagcggctacaaggactggatcctgtggatcagcttcgccatcagctgcttcctgctgtgcgtggccctgctgggcttcatcatgtgggcctgccagaagggcaacatcagatgcaacatctgcatc

SEQ ID NO: 35999 - RNA, 1698 nt, synthetic construct
  misc_feature 1..1698: note = derived and/or modified sequence opt4 from anti-influenza_Chain
  source 1..1698: mol_type = other RNA
atgaagaccatcatcgccctgagctacatcctgtgcctggtgttcagccagaagctgcccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcggcatctgcgacagcccccaccagatcctggacggcgagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaacaacgagagcttcaactgggccggcgtgacccagaacggcaccagcagcgcctgcaagagaagaagcaacaagagcttcttcagcagactgaactggctgacccacctgaagtacaagtaccccgccctgaacgtgaccatgcccaacaacgagaagttcgacaagctgtacatctggggcgtgcaccaccccgtgaccgacagcgaccagatcagcctgtacgcccaggccagcggcagaatcaccgtgagcaccaagagaagccagcagaccgtgatccccaacatcggctacagacccagagtgagagacatcagcagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcaccggccaggccgccgacctgaagagcacccaggccgccatcaaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagagaaccaagaagcagctgagagagaacgccgaggacatgggcaacggctgcttcaagatctaccacaagtgcgacaacgcctgcatcgagagcatcagaaacggcacctacgaccacgacgtgtacagagacgaggccctgaacaacagattccagatcaagggcgtggagctgaagagcggctacaaggactggatcctgtggatcagcttcgccatcagctgcttcctgctgtgcgtggccctgctgggcttcatcatgtgggcctgccagaagggcaacatcagatgcaacatctgcatc

SEQ ID NO: 36000 - RNA, 1698 nt, synthetic construct
  misc_feature 1..1698: note = derived and/or modified sequence opt4 from anti-influenza_Chain
  source 1..1698: mol_type = other RNA
atgaagaccatcatcgccctgagctacatcctgtgcctggtgttcgcccagaagctgcccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcggcatctgcgacagcccccaccagatcctggacggcgagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaacgacgagagcttcaactggaccggcgtgacccagaacggcaccagcagcagctgcaagagaagaagcaacaacagcttcttcagcagactgaactggctgacccacctgaagttcaagtaccccgccctgaacgtgaccatgcccaacaacgagaagttcgacaagctgtacatctggggcgtgcaccaccccgtgaccgacaacgaccagatcttcctgtacgcccaggccagcggcagaatcaccgtgagcaccaagagaagccagcagaccgtgatccccaacatcggcagcagacccagaatcagaaacatccccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcatcggccaggccgccgacctgaagagcacccaggccgccatcaaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagagaaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcgtggagctgaagagcggctacaaggactggatcctgtggatcagcttcgccatcagctgcttcctgctgtgcgtggccctgctgggcttcatcatgtgggcctgccagaagggcaacatcagatgcaacatctgcatc

SEQ ID NO: 36001 - RNA, 1698 nt, synthetic construct
  misc_feature 1..1698: note = derived and/or modified sequence opt4 from anti-influenza_Chain
  source 1..1698: mol_type = other RNA
atggagaagatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccaccaacgacctgtgctaccccggcagcttcaacgactacgaggagctgaagcacctgctgagcagaatcaaccacttcgagaagatccagatcatccccaagagcagctggagcgaccacgaggccagcagcggcgtgagcagcgcctgcccctacctgggcagccccagcttcttcagaaacgtggtgtggctgatcaagaagaacagcacctaccccaccatcaagaagagctacaacaacaccaaccaggaggacctgctggtgctgtggggcatccaccaccccaacgacgccgccgagcagaccagactgtaccagaaccccaccacctacatcagcatcggcaccagcaccctgaaccagagactggtgcccaagatcgccaccagaagcaaggtgaacggccagagcggcagaatggagttcttctgggccatcctgaagcccaacgacgccatcaacttcgagagcaacggcaacttcatcgcccccgagtacgcctacaagatcgtgaagaagggcgacagcgccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagcagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcatcagaaacggcacctacaacccccagtacagcgaggaggccagactgaagagagaggagatcagcggcgtgaagctggagagcatcggcacctaccagatcctgagcatctacagcaccgtggccagcagcctggccctggccatcatgatcgccggcctgagcctgtggatgtgcagcaacggcagcctgcagtgcagaatctgcatc

SEQ ID NO: 36002 - RNA, 1698 nt, synthetic construct
  misc_feature 1..1698: note = derived and/or modified sequence opt4 from anti-influenza_Chain
  source 1..1698: mol_type = other RNA
atgaaggccatcctggtggtgctgctgtacaccttcgccaccgccaacgccgacaccctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagaccagcagcagcgacaacggcacctgctaccccggcgacttcatcgactacgaggagctgagagagcagctgagcagcgtgagcagcttcgagagattcgagatcttccccaagaccagcagctggcccaaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccaccccagcaccagcgccgaccagcagagcctgtaccagaacgccgacgcctacgtgttcgtgggcaccagcagatacagcaagaagttcaagcccgagatcgccatcagacccaaggtgagagaccaggagggcagaatgaactactactggaccctggtggagcccggcgacaagatcaccttcgaggccaccggcaacctggtggtgcccagatacgccttcgccatggagagaaacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacgtgcccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacgagatcaccaacaaggtgaacagcgtgatcgagaagatgaacacccagttcaccgccgtgggcaaggagttcaaccacctggagaagagaatcgagaacctgaacaagaaggtggacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgccatcagcttctggatgtgcagcaacggcagcctgcagtgcagaatctgcatc

SEQ ID NO: 36003 - RNA, 1698 nt, synthetic construct
  misc_feature 1..1698: note = derived and/or modified sequence opt4 from anti-influenza_Chain
  source 1..1698: mol_type = other RNA
atgaaggccatcctggtggtgctgctgtacaccttcgccaccgccaacgccgacaccctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagaccagcagcagcgacaacggcacctgctaccccggcgacttcatcgactacgaggagctgagagagcagctgagcagcgtgagcagcttcgagagattcgagatcttccccaagaccagcagctggcccaaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccacccccccaccagcgccgaccagcagagcctgtaccagaacgccgacgcctacgtgttcgtgggcagcagcagatacagcaagaagttcaagcccgagatcgccatcagacccaaggtgagagaccaggagggcagaatgaactactactggaccctggtggagcccggcgacaagatcaccttcgaggccaccggcaacctggtggtgcccagatacgccttcgccatggagagaaacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacgagatcaccaacaaggtgaacagcgtgatcgagaagatgaacacccagttcaccgccgtgggcaaggagttcaaccacctggagaagagaatcgagaacctgaacaagaaggtggacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagatcctggccatctacagcaccgtggccagcagcctggtgctggtggtgagcctgggcgccatcagcttctggatgtgcagcaacggcagcctgcagtgcagaatctgcatc

SEQ ID NO: 36004 - RNA, 1698 nt, synthetic construct; identical to SEQ ID NO: 36001
  misc_feature 1..1698: note = derived and/or modified sequence opt4 from anti-influenza_Chain
  source 1..1698: mol_type = other RNA

SEQ ID NO: 36005 - RNA, 1698 nt, synthetic construct; identical to SEQ ID NO: 35994
  misc_feature 1..1698: note = derived and/or modified sequence opt4 from anti-influenza_Chain
  source 1..1698: mol_type = other RNA

SEQ ID NO: 36006 - RNA, 1698 nt, synthetic construct; identical to SEQ ID NO: 36002
  misc_feature 1..1698: note = derived and/or modified sequence opt4 from anti-influenza_Chain
  source 1..1698: mol_type = other RNA

SEQ ID NO: 36007 - RNA, 1698 nt, synthetic construct; identical to SEQ ID NO: 36003
  misc_feature 1..1698: note = derived and/or modified sequence opt4 from anti-influenza_Chain
  source 1..1698: mol_type = other RNA

SEQ ID NO: 36008 - RNA, 1698 nt, synthetic construct; identical to SEQ ID NO: 35995
  misc_feature 1..1698: note = derived and/or modified sequence opt4 from anti-influenza_Chain
  source 1..1698: mol_type = other RNA

SEQ ID NO: 36009 - RNA, 1698 nt, synthetic construct; identical to SEQ ID NO: 35996
  misc_feature 1..1698: note = derived and/or modified sequence opt4 from anti-influenza_Chain
  source 1..1698: mol_type = other RNA

SEQ ID NO: 36010 - RNA, 1698 nt, synthetic construct; identical to SEQ ID NO: 35997
  misc_feature 1..1698: note = derived and/or modified sequence opt4 from anti-influenza_Chain
  source 1..1698: mol_type = other RNA

SEQ ID NO: 36011 - RNA, 1698 nt, synthetic construct; identical to SEQ ID NO: 35998
  misc_feature 1..1698: note = derived and/or modified sequence opt4 from anti-influenza_Chain
  source 1..1698: mol_type = other RNA

SEQ ID NO: 36012 - RNA, 1698 nt, synthetic construct; identical to SEQ ID NO: 35999
  misc_feature 1..1698: note = derived and/or modified sequence opt4 from anti-influenza_Chain
  source 1..1698: mol_type = other RNA

SEQ ID NO: 36013 - RNA, 1698 nt, synthetic construct; identical to SEQ ID NO: 36000
  misc_feature 1..1698: note = derived and/or modified sequence opt4 from anti-influenza_Chain
  source 1..1698: mol_type = other RNA

SEQ ID NO: 36014 - RNA, 1683 nt, synthetic construct
  misc_feature 1..1683: note = derived and/or modified sequence opt4 from anti-influenza_Chain
  source 1..1683: mol_type = other RNA
atggagaagatcgtgctgctgttcgccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgtgaacgacctgtgctaccccggcgacttcaacgactacgaggagctgaagcacctgctgagcagaatcaaccacttcgagaagatccagatcatccccaagagcagctggagcagccacgaggccagcctgggcgtgagcagcgcctgcccctaccagggcaagagcagcttcttcagaaacgtggtgtggctgatcaagaagaacagcacctaccccaccatcaagagaagctacaacaacaccaaccaggaggacctgctggtgctgtggggcatccaccaccccaacgacgccgccgagcagaccaagctgtaccagaaccccaccacctacatcagcgtgggcaccagcaccctgaaccagagactggtgcccagaatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagatccagcacagcggcggcagaagcagcctggagggccccagattcgagcagaagctgatcagcgaggaggacctgaacatgcacaccggc

SEQ ID NO: 36015 - RNA, 1683 nt, synthetic construct
  misc_feature 1..1683: note = derived and/or modified sequence opt4 from anti-influenza_Chain
  source 1..1683: mol_type = other RNA
atggagaagatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcaagagcagcttcttcagaaacgtggtgtggctgatcaagaagaacagcagctaccccaccatcaagagaagctacaacaacaccaaccaggaggacctgctggtgctgtggggcatccaccaccccaacgacgccgccgagcagaccagactgtaccagaaccccaccacctacatcagcgtgggcaccagcaccctgaaccagagactggtgcccaagatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcgccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagatccagcacagcggcggcagaagcagcctggagggccccagattcgagcagaagctgatcagcgaggaggacctgaacatgcacaccggc

SEQ ID NO: 36016 - RNA, 1701 nt, synthetic construct
  misc_feature 1..1701: note = derived and/or modified sequence opt4 from anti-influenza_Chain
  source 1..1701: mol_type = other RNA
atggagaagatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatcagcaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacaacgccgccgagcagaccaagctgtaccagaaccccaccacctacatcagcgtgggcaccagcaccctgaacctgagactggtgcccaagatcgccaccagaagcaaggtgaacggccagagcggcagaatggacttcttctggaccatcctgaagcccaacgacgccatcaacttcgagagcaacggcaacttcatcgcccccgagtacgcctacaagatcgtgaagaagggcgacagcgccatcatgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctgagagagagaagaagaaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcacctaccagatcctgagcatctacagcaccgtggccagcagcctggccctggccatcatggtggccggcctgagcctgtggatgtgcagcaacggcagcctgcagtgcagaatctgcatc

SEQ ID NO: 36017 - RNA, 1701 nt, synthetic construct
  misc_feature 1..1701: note = derived and/or modified sequence opt4 from anti-influenza_Chain
  source 1..1701: mol_type = other RNA
atggagaagatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagagcggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctgagagagagaagaagaaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcacctaccagatcctgagcatctacagcaccgtggccagcagcctggccctggccatcatggtggccggcctgagcctgtggatgtgcagcaacggcagcctgcagtgcagaatctgcatc

SEQ ID NO: 36018 - RNA, 1683 nt, synthetic construct
  misc_feature 1..1683: note = derived and/or modified sequence opt4 from anti-influenza_Chain
  source 1..1683: mol_type = other RNA
gacaagatctgcctgggccaccacgccgtgagcaacggcaccaaggtgaacaccctgaccgagagaggcgtggaggtggtgaacgccaccgagaccgtggagagaaccaacgtgcccagaatctgcagcaagggcaagagaaccgtggacctgggccagtgcggcctgctgggcaccatcaccggccccccccagtgcgaccagttcctggagttcagcgccgacctgatcatcgagagaagagagggcagcgacgtgtgctaccccggcaagttcgtgaacgaggaggccctgagacagatcctgagagagagcggcggcatcgacaaggagaccatgggcttcacctacagcggcatcagaaccaacggcaccaccagcgcctgcagaagaagcggcagcagcttctacgccgagatgaagtggctgctgagcaacaccgacaacgccgccttcccccagatgaccaagagctacaagaacaccagaaaggaccccgccctgatcatctggggcatccaccacagcggcagcaccaccgagcagaccaagctgtacggcagcggcaacaagctgatcaccgtgggcagcagcaactaccagcagagcttcgtgcccagccccggcgccagaccccaggtgaacggccagagcggcagaatcgacttccactggctgatcctgaaccccaacgacaccgtgaccttcagcttcaacggcgccttcatcgcccccgacagagccagcttcctgagaggcaagagcatgggcatccagagcgaggtgcaggtggacgccaactgcgagggcgactgctaccacagcggcggcaccatcatcagcaacctgcccttccagaacatcaacagcagagccgtgggcaagtgccccagatacgtgaagcaggagagcctgctgctggccaccggcatgaagaacgtgcccgagatccccaagagaagaagaagaggcctgttcggcgccatcgccggcttcatcgagaacggctgggagggcctgatcgacggctggtacggcttcagacaccagaacgcccagggcgagggcaccgccgccgactacaagagcacccagagcgccatcgaccagatcaccggcaagctgaacagactgatcgagaagaccaaccagcagttcgagctgatcgacaacgagttcaccgaggtggagagacagatcggcaacgtgatcaactggaccagagacagcatgaccgaggtgtggagctacaacgccgagctgctggtggccatggagaaccagcacaccatcgacctggccgacagcgagatgaacaagctgtacgagagagtgaagagacagctgagagagaacgccgaggaggacggcaccggctgcttcgagatcttccacaagtgcgacgacgactgcatggccagcatcagaaacaacacctacgaccacagcaagtacagagaggaggccatccagaacagaatccagatcgaccccgtgaagctgagcagcggctacaaggacagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36019 - RNA, 1701 nt, synthetic construct
  misc_feature 1..1701: note = derived and/or modified sequence opt4 from anti-influenza_Chain
  source 1..1701: mol_type = other RNA
atggagaagatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctgagagagagaagaagaaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcacctaccagatcctgagcatctacagcaccgtggccagcagcctggccctggccatcatggtggccggcctgagcctgtggatgtgcagcaacggcagcctgcagtgcagaatctgcatc

SEQ ID NO: 36020 - RNA, 1683 nt, synthetic construct; identical to SEQ ID NO: 36018
  misc_feature 1..1683: note = derived and/or modified sequence opt4 from anti-influenza_Chain
  source 1..1683: mol_type = other RNA

SEQ ID NO: 36021 - RNA, 1683 nt, synthetic construct; identical to SEQ ID NO: 36014
  misc_feature 1..1683: note = derived and/or modified sequence opt4 from anti-influenza_Chain
  source 1..1683: mol_type = other RNA

SEQ ID NO: 36022 - RNA, 1683 nt, synthetic construct; identical to SEQ ID NO: 36015
  misc_feature 1..1683: note = derived and/or modified sequence opt4 from anti-influenza_Chain
  source 1..1683: mol_type = other RNA

SEQ ID NO: 36023 - RNA, 1701 nt, synthetic construct; identical to SEQ ID NO: 36019
  misc_feature 1..1701: note = derived and/or modified sequence opt4 from anti-influenza_Chain
  source 1..1701: mol_type = other RNA

SEQ ID NO: 36024 - RNA, 1701 nt, synthetic construct; identical to SEQ ID NO: 36016
  misc_feature 1..1701: note = derived and/or modified sequence opt4 from anti-influenza_Chain
  source 1..1701: mol_type = other RNA

SEQ ID NO: 36025 - RNA, 1701 nt, synthetic construct; identical to SEQ ID NO: 36017
  misc_feature 1..1701: note = derived and/or modified sequence opt4 from anti-influenza_Chain
  source 1..1701: mol_type = other RNA

SEQ ID NO: 36026 - RNA, 1704 nt, synthetic construct
  misc_feature 1..1704: note = derived and/or modified sequence opt4 from anti-influenza_Chain
  source 1..1704: mol_type = other RNA
atggagaagatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcctgaacgtgcccgagtggagctacatcgtggagaagatcaaccccgccaacgacctgtgctaccccggcgacttcaacgactacgaggagctgaagcacctgctgagcagaatcaaccacttcgagaagatccagatcatccccaagagcagctggagcgactacgaggccagcagcggcgtgagcagcgcctgcccctaccagggcagaagcagcttcttcagaaacgtggtgtggctgatcaagaagaacaacgcctaccccaccatcaagagaagctacaacaacaccaaccaggaggacctgctggtgctgtggggcatccaccaccccaacgacgccgccgagcagatcagactgtaccagaaccccaccacctacatcagcatcggcaccagcaccctgaaccagagactggtgcccaagatcgccaccagaagcaaggtgaacggccagagcggcagaatggagttcttctggaccatcctgaagagcaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatcggcgccatcaacagcagcatgcccttccacaacatccaccccctgaccatcggcgagtgccccaagtacgtgaagagcaacagactggtgctggccaccggcctgagaaacagcccccagggcgagagaagaagaagaaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcaacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacagatgcgacaacgagtgcatggagagcgtgagaaacggcacctacgactacccccagtacagcgaggaggccagactgaagagagaggagatcagcggcgtgaagctggagagcatgggcatctaccagatcctgagcatctacagcaccgtggccagcagcctggccctggccatcatggtggccggcctgttcctgtggatgtgcagcaacggcagcctgcagtgcagaatctgcatc

SEQ ID NO: 36027 - RNA, 1704 nt, synthetic construct
  misc_feature 1..1704: note = derived and/or modified sequence opt4 from anti-influenza_Chain
  source 1..1704: mol_type = other RNA
atggagaagatcgtgctgctgctggccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccaccaacgacctgtgctaccccggcagcttcaacgactacgaggagctgaagcacctgctgagcagaatcaaccacttcgagaagatccagatcatccccaagagcagctggagcgaccacgaggccagcagcggcgtgagcagcgcctgcccctacctgggcagccccagcttcttcagaaacgtggtgtggctgatcaagaagaacagcacctaccccaccatcaagaagagctacaacaacaccaaccaggaggacctgctggtgctgtggggcatccaccaccccaacgacgccgccgagcagaccagactgtaccagaaccccaccacctacatcagcatcggcaccagcaccctgaaccagagactggtgcccaagatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcgccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagcagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcatcagaaacggcacctacaactacccccagtacagcgaggaggccagactgaagagagaggagatcagcggcgtgaagctggagagcatcggcacctaccagatcctgagcatctacagcaccgtggccagcagcctggccctggccatcatgatggccggcctgagcctgtggatgtgcagcaacggcagcctgcagtgcagaatctgcatc

SEQ ID NO: 36028 - RNA, 1704 nt, synthetic construct
  misc_feature 1..1704: note = derived and/or modified sequence opt4 from anti-influenza_Chain
  source 1..1704: mol_type = other RNA
atggagaagatcgtgctgctgttcgccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgtgaacgacctgtgctaccccggcgacttcaacgactacgaggagctgaagcacctgctgagcagaatcaaccacttcgagaagatccagatcatccccaagagcagctggagcagccacgaggccagcctgggcgtgagcagcgcctgcccctaccagggcaagagcagcttcttcagaaacgtggtgtggctgatcaagaagaacagcacctaccccaccatcaagagaagctacaacaacaccaaccaggaggacctgctggtgctgtggggcatccaccaccccaacgacgccgccgagcagaccaagctgtaccagaaccccaccacctacatcagcgtgggcaccagcaccctgaaccagagactggtgcccagaatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagatcctgagcatctacagcaccgtggccagcagcctggccctggccatcatggtggccggcctgagcctgtggatgtgcagcaacggcagcctgcagtgcagaatctgcatc

SEQ ID NO: 36029 - RNA, 1704 nt, synthetic construct; identical to SEQ ID NO: 36026
  misc_feature 1..1704: note = derived and/or modified sequence opt4 from anti-influenza_Chain
  source 1..1704: mol_type = other RNA

SEQ ID NO: 36030 - RNA, 1704 nt, synthetic construct; identical to SEQ ID NO: 36027
  misc_feature 1..1704: note = derived and/or modified sequence opt4 from anti-influenza_Chain
  source 1..1704: mol_type = other RNA

SEQ ID NO: 36031 - RNA, 1704 nt, synthetic construct; identical to SEQ ID NO: 36028
  misc_feature 1..1704: note = derived and/or modified sequence opt4 from anti-influenza_Chain
  source 1..1704: mol_type = other RNA

SEQ ID NO: 36032 - RNA, 1707 nt, synthetic construct
  misc_feature 1..1707: note = derived and/or modified sequence opt4 from anti-influenza_Chain
  source 1..1707: mol_type = other RNA
agcaagagcagaggctacaagatgaacacccagatcctggtgttcgccctggtggccagcatccccaccaacgccgacaagatctgcctgggccaccacgccgtgagcaacggcaccaaggtgaacaccctgaccgagagaggcgtggaggtggtgaacgccaccgagaccgtggagagaaccaacgtgcccagaatctgcagcaagggcaagagaaccgtggacctgggccagtgcggcctgctgggcaccatcaccggccccccccagtgcgaccagttcctggagttcagcgccgacctgatcatcgagagaagagagggcagcgacgtgtgctaccccggcaagttcgtgaacgaggaggccctgagacagatcctgagagagagcggcggcatcgacaaggagaccatgggcttcacctacagcggcatcagaaccaacggcaccaccagcgcctgcagaagaagcggcagcagcttctacgccgagatgaagtggctgctgagcaacaccgacaacgccgccttcccccagatgaccaagagctacaagaacaccagaaaggaccccgccctgatcatctggggcatccaccacagcggcagcaccaccgagcagaccaagctgtacggcagcggcaacaagctgatcaccgtgggcagcagcaactaccagcagagcttcgtgcccagccccggcgccagaccccaggtgaacggccagagcggcagaatcgacttccactggctgatcctgaaccccaacgacaccgtgaccttcagcttcaacggcgccttcatcgcccccgacagagccagcttcctgagaggcaagagcatgggcatccagagcgaggtgcaggtggacgccaactgcgagggcgactgctaccacagcggcggcaccatcatcagcaacctgcccttccagaacatcaacagcagagccgtgggcaagtgccccagatacgtgaagcaggagagcctgctgctggccaccggcatgaagaacgtgcccgagatccccaagagaagaagaagaggcctgttcggcgccatcgccggcttcatcgagaacggctgggagggcctgatcgacggctggtacggcttcagacaccagaacgcccagggcgagggcaccgccgccgactacaagagcacccagagcgccatcgaccagatcaccggcaagctgaacagactgatcgagaagaccaaccagcagttcgagctgatcgacaacgagttcaccgaggtggagagacagatcggcaacgtgatcaactggaccagagacagcatgaccgaggtgtggagctacaacgccgagctgctggtggccatggagaaccagcacaccatcgacctggccgacagcgagatgaacaagctgtacgagagagtgaagagacagctgagagagaacgccgaggaggacggcaccggctgcttcgagatcttccacaagtgcgacgacgactgcatggccagcatcagaaacaacacctacgaccacagcaagtacagagaggaggccatccagaacagaatccagatcgaccccgtgaagctgagcagcggctacaaggacgtgatcctgtggttcagcttcggcgccagctgcttcatcctgctggccatcgccatgggcctggtgttcatctgcgtgaagaacggcaacatgagatgcaccatctgcatc

SEQ ID NO: 36033 - RNA, 1707 nt, synthetic construct; identical to SEQ ID NO: 36032
  misc_feature 1..1707: note = derived and/or modified sequence opt4 from anti-influenza_Chain
  source 1..1707: mol_type = other RNA

SEQ ID NO: 36034 - RNA, 1692 nt, synthetic construct
  misc_feature 1..1692: note = derived and/or modified sequence opt4 from anti-influenza_Chain
  source 1..1692: mol_type = other RNA
gaccagatctgcatcggctaccacgccaacaacagcaccgagaaggtggacaccaacctggagagaaacgtgaccgtgacccacgccaaggacatcctggagaagacccacaacggcaagctgtgcaagctgaacggcatcccccccctggagctgggcgactgcagcatcgccggctggctgctgggcaaccccgagtgcgacagactgctgagcgtgcccgagtggagctacatcatggagaaggagaaccccagagacggcctgtgctaccccggcagcttcaacgactacgaggagctgaagcacctgctgagcagcgtgaagcacttcgagaaggtgaagatcctgcccaaggacagatggacccagcacaccaccaccggcggcagcagagcctgcgccgtgagcggcaaccccagcttcttcagaaacatggtgtggctgaccaaggagggcagcgactaccccgtggccaagggcagctacaacaacaccagcggcgagcagatgctgatcatctggggcgtgcaccaccccatcgacgagaccgagcagagaaccctgtaccagaacgtgggcacctacgtgagcgtgggcaccagcaccctgaacaagagaagcacccccgagatcgccaccagacccaaggtgaacggccagggcggcagaatggagttcagctggaccctgctggacatgtgggacaccatcaacttcgagagcaccggcaacctgatcgcccccgagtacggcttcaagatcagcaagagaggcagcagcggcatcatgaagaccgagggcaccctggagaactgcgagaccaagtgccagacccccctgggcgccatcaacaccaccctgcccttccacaacgtgcaccccctgaccatcggcgagtgccccaagtacgtgaagagcgagaagctggtgctggccaccggcctgagaaacgtgccccagatcgagagcagaggcctgttcggcgccatcgccggcttcatcgagggcggctggcagggcatggtggacggctggtacggctaccaccacagcaacgaccagggcagcggctacgccgccgacaaggagagcacccagaaggccttcgacggcatcaccaacaaggtgaacagcgtgatcgagaagatgaacacccagttcgaggccgtgggcaaggagttcggcaacctggagagaagactggagaacctgaacaagagaatggaggacggcttcctggacgtgtggacctacaacgccgagctgctggtgctgatggagaacgagagaaccctggacttccacgacagcaacgtgaagaacctgtacgacaaggtgagaatgcagctgagagacaacgtgaaggagctgggcaacggctgcttcgagttctaccacaagtgcgacgacgagtgcatgaacagcgtgaagaacggcacctacgactaccccaagtacgaggaggagagcaagctgaacagaaacgagatcaagggcgtgaagctgagcagcatgggcgtgtaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36035 - RNA, 1692 nt, synthetic construct
  misc_feature 1..1692: note = derived and/or modified sequence opt4 from anti-influenza_Chain
  source 1..1692: mol_type = other RNA
cagaagctgcccggcaacgacaacagcaccgccaccctgtgcctgggccaccacgccgtgcccaacggcaccatcgtgaagaccatcaccaacgaccagatcgaggtgaccaacgccaccgagctggtgcagagcagcagcaccggcggcatctgcgacagcccccaccagatcctggacggcgagaactgcaccctgatcgacgccctgctgggcgacccccagtgcgacggcttccagaacaagaagtgggacctgttcgtggagagaagcaaggcctacagcaactgctacccctacgacgtgcccgactacgccagcctgagaagcctggtggccagcagcggcaccctggagttcaacgacgagagcttcaactggaccggcgtgacccagaacggcaccagcagcagctgcaagagaagaagcaacaacagcttcttcagcagactgaactggctgacccagctgaagttcaagtaccccgccctgaacgtgaccatgcccaacaacgagaagttcgacaagctgtacatctggggcgtgcaccaccccgtgaccgacaacgaccagatcttcctgtacgcccaggccagcggcagaatcaccgtgagcaccaagagaagccagcagaccgtgatccccaacatcggcagcagacccagaatcagaaacatccccagcagaatcagcatctactggaccatcgtgaagcccggcgacatcctgctgatcaacagcaccggcaacctgatcgcccccagaggctacttcaagatcagaagcggcaagagcagcatcatgagaagcgacgcccccatcggcaagtgcaacagcgagtgcatcacccccaacggcagcatccccaacgacaagcccttccagaacgtgaacagaatcacctacggcgcctgccccagatacgtgaagcagaacaccctgaagctggccaccggcatgagaaacgtgcccgagaagcagaccagaggcatcttcggcgccatcgccggcttcatcgagaacggctgggagggcatggtggacggctggtacggcttcagacaccagaacagcgagggcatcggccaggccgccgacctgaagagcacccaggccgccatcaaccagatcaacggcaagctgaacagactgatcggcaagaccaacgagaagttccaccagatcgagaaggagttcagcgaggtggagggcagaatccaggacctggagaagtacgtggaggacaccaagatcgacctgtggagctacaacgccgagctgctggtggccctggagaaccagcacaccatcgacctgaccgacagcgagatgaacaagctgttcgagagaaccaagaagcagctgagagagaacgccgaggacatgggcaacggctgcttcaagatctaccacaagtgcgacaacgcctgcatcggcagcatcagaaacggcacctacgaccacgacgtgtacagagacgaggccctgaacaacagattccagatcaagggcgtggagctgaagagcggcagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36036 - RNA, 1692 nt, synthetic construct; identical to SEQ ID NO: 36034
  misc_feature 1..1692: note = derived and/or modified sequence opt4 from anti-influenza_Chain
  source 1..1692: mol_type = other RNA

SEQ ID NO: 36037 - RNA, 1692 nt, synthetic construct; identical to SEQ ID NO: 36035
  misc_feature 1..1692: note = derived and/or modified sequence opt4 from anti-influenza_Chain
  source 1..1692: mol_type = other RNA

SEQ ID NO: 36038 - RNA, 1695 nt, synthetic construct
  misc_feature 1..1695: note = derived and/or modified sequence opt4 from anti-influenza_Chain
  source 1..1695: mol_type = other RNA
gacaccatctgcatcggctaccacgccaacaacagcaccgacaccgtggacaccgtgctggagaagaacgtgaccgtgacccacagcgtgaacctgctggaggacagccacaacggcaagctgtgcctgctgaagggcatcgcccccctgcagctgggcaactgcagcgtggccggctggatcctgggcaaccccgagtgcgagctgctgatcagcagagagagctggagctacatcgtggagaagcccaaccccgagaacggcacctgctaccccggccacttcgccgactacgaggagctgagagagcagctgagcagcgtgagcagcttcgagagattcgagatcttccccaaggagagcagctggcccaaccacaccaccaccggcgtgagcgccagctgcagccacaacggcgagagcagcttctacaagaacctgctgtggctgaccggcaagaacggcctgtaccccaacctgagcaagagctacgccaacaacaaggagaaggaggtgctggtgctgtggggcgtgcaccacccccccaacatcggcgaccagagagccctgtaccacaaggagaacgcctacgtgagcgtggtgagcagccactacagcagaaagttcacccccgagatcgccaagagacccaaggtgagagaccaggagggcagaatcaactactactggaccctgctggagcccggcgacaccatcatcttcgaggccaacggcaacctgatcgcccccagatacgccttcgccctgagcagaggcttcggcagcggcatcatcaacagcaacgcccccatggacgagtgcgacgccaagtgccagaccccccagggcgccatcaacagcagcctgcccttccagaacgtgcaccccgtgaccatcggcgagtgccccaagtacgtgagaagcgccaagctgagaatggtgaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgaccagaagagcacccagaacgccatcaacggcatcaccaacaaggtgaacagcgtgatcgagaagatgaacacccagttcaccgccgtgggcaaggagttcaacaagctggagagaagaatggagaacctgaacaagaaggtggacgacggcttcatcgacatctggacctacaacgccgagctgctggtgctgctggagaacgagagaaccctggacttccacgacagcaacgtgaagaacctgtacgagaaggtgaagagccagctgaagaacaacgccaaggagatcggcaacggctgcttcgagttctaccacaagtgcaacgacgagtgcatggagagcgtgaagaacggcacctacgactaccccaagtacagcgaggagagcaagctgaacagagagaagatcgacggcgtgaagctggagagcatgggcgtgtaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36039 - RNA, 1695 nt, synthetic construct
  misc_feature 1..1695: note = derived and/or modified sequence opt4 from anti-influenza_Chain
  source 1..1695: mol_type = other RNA
cagaactacaccggcaaccccgtgatctgcctgggccaccacgccgtgagcaacggcaccatggtgaagaccctgaccgacgaccagatcgaggtggtgaccgcccaggagctggtggagagccagcacctgcccgagctgtgccccagccccctgagactggtggacggccagacctgcgacatcgtgaacggcgccctgggcagccccggctgcgaccacctgaacggcgccgagtgggacgtgttcatcgagagacccaccgccgtggacacctgctaccccttcgacgtgcccgactaccagagcctgagaagcatcctggccaacaacggcaagttcgagttcatcgccgaggagttccagtggaacaccgtgaagcagaacggcaagagcggcgcctgcaagagagccaacgtgaacgacttcttcaacagactgaactggctgaccaagagcgacggcaacgcctaccccctgcagaacctgaccaaggtgaacaacggcgactacgccagactgtacatctggggcgtgcaccaccccagcaccgacaccgagcagaccaacctgtacaagaacaaccccggcagagtgaccgtgagcacccagaccagccagaccagcgtggtgcccaacatcggcagcagaccctgggtgagaggcctgagcagcagaatcagcttctactggaccatcgtggagcccggcgacctgatcgtgttcaacaccatcggcaacctgatcgcccccagaggccactacaagctgaacagccagaagaagagcaccatcctgaacaccgccgtgcccatcggcagctgcgtgagcaagtgccacaccgacaagggcagcatcagcaccaccaagcccttccagaacatcagcagaatcagcatcggcgactgccccaagtacgtgaagcagggcagcctgaagctggccaccggcatgagaagcatcctggagaaggccaccagaggcctgttcggcgccatcgccggcttcatcgagaacggctggcagggcctgatcgacggctggtacggcttcagacaccagaacgccgagggcaccggcaccgccgccgacctgaagagcacccaggccgccatcgaccagatcaacggcaagctgaacagactgatcggcaagcccaacgagaagtaccaccagatcgagaaggagttcgagcaggtggagggcagaatccaggacctggagaagtacgtggaggacaccaagatcgacctgtggagctacaacgccgagctgctggtggccctggagaaccagcacaccatcgacgtgaccgacagcgagatgaacaagctgttcgagagagtgagacaccagctgagagagaacgccgaggacaagggcaacggctgcttcgagatcttccaccagtgcgacaacagctgcatcgagagcatcagaaacggcacctacgaccacgacatctacagagacgaggccatcaacaacagattccagatccagggcgtgaagctgatccagggctacaaggacagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36040 - RNA, 1695 nt, synthetic construct
  misc_feature 1..1695: note = derived and/or modified sequence opt4 from anti-influenza_Chain
  source 1..1695: mol_type = other RNA
gaccagatctgcatcggctaccacgccaacaacagcaccgagcaggtggacaccatcatggagaagaacgtgaccgtgacccacgcccaggacatcctggagaagacccacaacggcaagctgtgcaacctggacggcgtgaagcccctgatcctgaaggactgcagcgtggccggctggctgctgggcaaccccatgtgcgacgagttcctgaacgtgagcgagtggagctacatcgtggagaaggccagccccgccaacggcctgtgctaccccggcgacttcaacgactacgaggagctgaagcacctgctgagcagaatcaaccacctgaagaagatcaagatcatccccaagagctactggagcaaccacgaggccagcagcggcgtgagcgccgcctgcagctacctgggcgagcccagcttcttcagaaacgtggtgtggctgatcaagaagaacaacacctacccccccatcaaggtgaactacaccaacaccaaccaggaggacctgctggtgctgtggggcatccaccaccccaacgacgagaaggagcagatcagaatctaccagaaccccaacaccagcatcagcgtgggcaccagcaccctgaaccagagactggtgcccaagatcgccaccagacccaaggtgaacggccagagcggcagaatggagttcttctggaccatcctgaagcccaacgacagcatcaacttcgacagcaacggcaacttcatcgcccccgagtacgcctacaagatcgccaagaagggcgacagcgtgatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacgccccccagaccgagaccagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcatcaccaacaaggtgaacagcatcatcgacaagatgaacacccagttcgagatcgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgagaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgagcagagaggagatcagcggcgtgaagatggagagcatggtgacctaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36041 - RNA, 1695 nt, synthetic construct; identical to SEQ ID NO: 36038
  misc_feature 1..1695: note = derived and/or modified sequence opt4 from anti-influenza_Chain
  source 1..1695: mol_type = other RNA

SEQ ID NO: 36042 - RNA, 1695 nt, synthetic construct; identical to SEQ ID NO: 36039
  misc_feature 1..1695: note = derived and/or modified sequence opt4 from anti-influenza_Chain
  source 1..1695: mol_type = other RNA

SEQ ID NO: 36043 - RNA, 1695 nt, synthetic construct; identical to SEQ ID NO: 36040
  misc_feature 1..1695: note = derived and/or modified sequence opt4 from anti-influenza_Chain
  source 1..1695: mol_type = other RNA

SEQ ID NO: 36044 - RNA, 1698 nt, synthetic construct
  misc_feature 1..1698: note = derived and/or modified sequence opt4 from anti-influenza_Chain
  source 1..1698: mol_type = other RNA
gacaccctgtgcatcggctaccacgccaacaacagcaccgacaccgtggacaccgtgctggagaagaacgtgaccgtgacccacagcgtgaacctgctggaggacaagcacaacggcaagctgtgcaagctgagaggcgtggcccccctgcacctgggcaagtgcaacatcgccggctggatcctgggcaaccccgagtgcgagagcctgagcaccgccagcagctggagctacatcgtggagacccccagcagcgacaacggcacctgctaccccggcgacttcatcgactacgaggagctgagagagcagctgagcagcgtgagcagcttcgagagattcgagatcttccccaagaccagcagctggcccaaccacgacagcaacaagggcgtgaccgccgcctgcccccacgccggcgccaagagcttctacaagaacctgatctggctggtgaagaagggcaacagctaccccaagctgagcaagagctacatcaacgacaagggcaaggaggtgctggtgctgtggggcatccaccaccccagcaccagcgccgaccagcagagcctgtaccagaacgccgacacctacgtgttcgtgggcagcagcagatacagcaagaagttcaagcccgagatcgccatcagacccaaggtgagagaccaggagggcagaatgaactactactggaccctggtggagcccggcgacaagatcaccttcgaggccaccggcaacctggtggtgcccagatacgccttcgccatggagagaaacgccggcagcggcatcatcatcagcgacacccccgtgcacgactgcaacaccacctgccagacccccaagggcgccatcaacaccagcctgcccttccagaacatccaccccatcaccatcggcaagtgccccaagtacgtgaagagcaccaagctgagactggccaccggcctgagaaacatccccagcatccagagcagaggcctgttcggcgccatcgccggcttcatcgagggcggctggaccggcatggtggacggctggtacggctaccaccaccagaacgagcagggcagcggctacgccgccgacctgaagagcacccagaacgccatcgacgagatcaccaacaaggtgaacagcgtgatcgagaagatgaacacccagttcaccgccgtgggcaaggagttcaaccacctggagaagagaatcgagaacctgaacaagaaggtggacgacggcttcctggacatctggacctacaacgccgagctgctggtgctgctggagaacgagagaaccctggactaccacgacagcaacgtgaagaacctgtacgagaaggtgagaagccagctgaagaacaacgccaaggagatcggcaacggctgcttcgagttctaccacaagtgcgacaacacctgcatggagagcgtgaagaacggcacctacgactaccccaagtacagcgaggaggccaagctgaacagagaggagatcgacggcgtgaagctggagagcaccagaatctaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36045 - RNA, 1698 nt, synthetic construct
  misc_feature 1..1698: note = derived and/or modified sequence opt4 from anti-influenza_Chain
  source 1..1698: mol_type = other RNA
gacagaatctgcatcggctaccagagcaacaacagcaccgacaccgtgaacaccctgatcgagcagaaggtgcccgtgacccagaccatggagctggtggagaccgagaagcaccccgcctactgcaacaccgacctgggcgcccccctggagctgagagactgcaagatcgaggccgtgatctacggcaaccccaagtgcgacatccacctgaaggaccagggctggagctacatcgtggagagacccagcgcccccgagggcatgtgctaccccggcagcgtggagaacctggaggagctgagattcgtgttcagcagcgccgccagctacaagagaatcagactgttcgactacagcagatggaacgtgaccagcagcggcaccagcaaggcctgcaacgccagcaccggcggccagagcttctacagaagcatcaactggctgaccaagaagaagcccgacacctacgacttcaacgagggcacctacgtgaacaacgaggacggcgacatcatcttcctgtggggcatccaccacccccccgacaccaaggagcagaccaccctgtacaagaacgccaacaccctgagcagcgtgaccaccaacaccatcaacagaagcttccagcccaacatcggccccagacccctggtgagaggccagcagggcagaatggactactactggggcatcctgaagagaggcgagaccctgaagatcagaaccaacggcaacctgatcgcccccgagttcggctacctgctgaagggcgagagccacggcagaaccatccagaacgaggacatccccatcggcaactgctacaccaagtgccagacctacgccggcgccatcaacagcagcaagcccttccagaacgccagcagacactacatgggcgagtgccccaagtacgtgaagaaggccagcctgagactggccgtgggcctgagaaacacccccagcgtggagcccagaggcctgttcggcgccatcgccggcttcatcgagggcggctggagcggcatgatcgacggctggtacggcttccaccacagcaacagcgagggcaccggcatggccgccgaccagaagagcacccaggaggccatcgacaagatcaccaacaaggtgaacaacatcgtggacaagatgaacagagagttcgaggtggtgaaccacgagttcagcgaggtggagaagagaatcaacatgatcaacgacaagatcgacgaccagatcgaggacctgtgggcctacaacgccgagctgctggtgctgctggagaaccagaagaccctggacgagcacgacagcaacgtgaagaacctgttcgacgaggtgaagagaagactgagcgccaacgccatcgacgccggcaacggctgcttcgacatcctgcacaagtgcgacaacgagtgcatggagaccatcaagaacggcacctacgaccacaaggagtacgaggaggaggccaagctggagagaagcaagatcaacggcgtgaagctggaggagaacaccacctacaagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36046 - RNA, 1698 nt, synthetic construct; identical to SEQ ID NO: 36044
  misc_feature 1..1698: note = derived and/or modified sequence opt4 from anti-influenza_Chain
  source 1..1698: mol_type = other RNA

SEQ ID NO: 36047 - RNA, 1698 nt, synthetic construct; identical to SEQ ID NO: 36045
  misc_feature 1..1698: note = derived and/or modified sequence opt4 from anti-influenza_Chain
  source 1..1698: mol_type = other RNA

SEQ ID NO: 36048 - RNA, 1701 nt, synthetic construct
  misc_feature 1..1701: note = derived and/or modified sequence opt4 from anti-influenza_Chain
  source 1..1701: mol_type = other RNA
gacaagatctgcatcggctaccacgccaacaacagcaccacccaggtggacaccatcctggagaagaacgtgaccgtgacccacagcgtggagctgctggagaaccagaaggaggagagattctgcaagatcctgaacaaggcccccctggacctgagaggctgcaccatcgagggctggatcctgggcaacccccagtgcgacctgctgctgggcgaccagagctggagctacatcgtggagagacccaccgcccagaacggcatctgctaccccggcgccctgaacgaggtggaggagctgaaggccctgatcggcagcggcgagagagtggagagattcgagatgttccccaagagcacctggaccggcgtggacaccagcagcggcgtgaccaaggcctgcccctacaacagcggcagcagcttctacagaaacctgctgtggatcatcaagaccaagagcgccgcctaccccgtgatcaagggcacctacaacaacaccggcagccagcccatcctgtacttctggggcgtgcaccacccccccgacaccaacgagcagaacaccctgtacggcagcggcgacagatacgtgagaatgggcaccgagagcatgaacttcgccaagagccccgagatcgccgccagacccgccgtgaacggccagagaggcagaatcgactactactggagcgtgctgaagcccggcgagaccctgaacgtggagagcaacggcaacctgatcgccccctggtacgcctacaagttcgtgagcaccaacaacaagggcgccatcttcaagagcaacctgcccatcgagaactgcgacgccacctgccagaccatcgccggcgtgctgagaaccaacaagaccttccagaacgtgagccccctgtggatcggcgagtgccccaagtacgtgaagagcgagagcctgagactggccaccggcctgagaaacgtgccccagatcgagaccagaggcctgttcggcgccatcgccggcttcatcgagggcggctggaccggcatgatcgacggctggtacggctaccaccacgagaacagccagggcagcggctacgccgccgacaaggagagcacccagaaggccatcgacggcatcaccaacaaggtgaacagcatcatcgacaagatgaacacccagttcgaggccgtggaccacgagttcagcaacctggagagaagaatcgacaacctgaacaagagaatggaggacggcttcctggacgtgtggacctacaacgccgagctgctggtgctgctggagaacgagagaaccctggacctgcacgacgccaacgtgaagaacctgtacgagaaggtgaagagccagctgagagacaacgccaacgacctgggcaacggctgcttcgagttctggcacaagtgcgacaacgagtgcatcgagagcgtgaagaacggcacctacgactaccccaagtaccaggacgagagcaagctgaacagacaggagatcgagagcgtgaagctggacaacctgggcgtgtaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36049 - RNA, 1701 nt, synthetic construct; identical to SEQ ID NO: 36048
  misc_feature 1..1701: note = derived and/or modified sequence opt4 from anti-influenza_Chain
  source 1..1701: mol_type = other RNA

SEQ ID NO: 36050 - RNA, 1704 nt, synthetic construct
  misc_feature 1..1704: note = derived and/or modified sequence opt4 from anti-influenza_Chain
  source 1..1704: mol_type = other RNA
gaccacatctgcatcggctaccacgccaacaacagcaccgagcaggtggacaccatcatggagaagaacgtgaccgtgacccacgcccaggacatcctggagaagacccacaacggcaagctgtgcgacctgaacggcgtgaagcccctgatcctgaaggactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaaggacagctggagcgaccacgaggccagcctgggcgtgagcagcgcctgcccctaccagggcaacagcagcttcttcagaaacgtggtgtggctgatcaagaagggcaacgcctaccccaccatcaagaagagctacaacaacaccaaccaggaggacctgctggtgctgtggggcatccaccaccccaacgacgaggccgagcagaccagactgtaccagaaccccaccacctacatcagcatcggcaccagcaccctgaaccagagactggtgcccaagatcgccaccagaagcaaggtgaacggccagagcggcagaatcgacttcttctggaccatcctgaagcccaacgacgccatcaacttcgagagcaacggcaacttcatcgcccccgagtacgcctacaagatcgtgaagaagggcgacagcaccatcatgaagagcgaggtggagtacggcaactgcaacaccagatgccagacccccatgggcgccatcaacagcagcatgcccttccacaacatccaccccctgaccatcggcgagtgccccaagtacgtgaagagcaacaagctggtgctggccaccggcctgagaaacagcccccagagagagagaagaagaaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcacctaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36051 - RNA, 1704 nt, synthetic construct
  misc_feature 1..1704: note = derived and/or modified sequence opt4 from anti-influenza_Chain
  source 1..1704: mol_type = other RNA
gaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagagcggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctgagagagagaagaagaaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcacctaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36052 - RNA, 1704 nt, synthetic construct; identical to SEQ ID NO: 36050
  misc_feature 1..1704: note = derived and/or modified sequence opt4 from anti-influenza_Chain
  source 1..1704: mol_type = other RNA

SEQ ID NO: 36053 - RNA, 1704 nt, synthetic construct; identical to SEQ ID NO: 36051
  misc_feature 1..1704: note = derived and/or modified sequence opt4 from anti-influenza_Chain
  source 1..1704: mol_type = other RNA

SEQ ID NO: 36054 - RNA, 1707 nt, synthetic construct
  misc_feature 1..1707: note = derived and/or modified sequence opt4 from anti-influenza_Chain
  source 1..1707: mol_type = other RNA
gaccagatctgcatcggctaccacgccaacaacagcaccgagcaggtggacaccatcatggagaagaacgtgaccgtgacccacgcccaggacatcctggagaagaagcacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgtgaacgacctgtgctaccccggcgacttcaacgactacgaggagctgaagcacctgctgagcagaatcaaccacttcgagaagatccagatcatccccaagagcagctggagcagccacgaggccagcctgggcgtgagcagcgcctgcccctaccagggcaagagcagcttcttcagaaacgtggtgtggctgatcaagaagaacagcacctaccccaccatcaagagaagctacaacaacaccaaccaggaggacctgctggtgctgtggggcatccaccaccccaacgacgccgccgagcagaccaagctgtaccagaaccccaccacctacatcagcgtgggcaccagcaccctgaaccagagactggtgcccagaatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36055 - RNA, 1707 nt, synthetic construct
  misc_feature 1..1707: note = derived and/or modified sequence opt4 from anti-influenza_Chain
  source 1..1707: mol_type = other RNA
gaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccaccaacgacctgtgctaccccggcagcttcaacgactacgaggagctgaagcacctgctgagcagaatcaaccacttcgagaagatccagatcatccccaagagcagctggagcgaccacgaggccagcagcggcgtgagcagcgcctgcccctacctgggcagccccagcttcttcagaaacgtggtgtggctgatcaagaagaacagcacctaccccaccatcaagaagagctacaacaacaccaaccaggaggacctgctggtgctgtggggcatccaccaccccaacgacgccgccgagcagaccagactgtaccagaaccccaccacctacatcagcatcggcaccagcaccctgaaccagagactggtgcccaagatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcgccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagcagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcatcagaaacggcacctacaactacccccagtacagcgaggaggccagactgaagagagaggagatcagcggcgtgaagctggagagcatcggcacctaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36056 - RNA, 1707 nt, synthetic construct
  misc_feature 1..1707: note = derived and/or modified sequence opt4 from anti-influenza_Chain
  source 1..1707: mol_type = other RNA
gaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcctgaacgtgagcgagtggagctacatcgtggagaagatcaaccccgccaacgacctgtgctaccccggcaacttcaacaactacgaggagctgaagcacctgctgagcagaatcaacagattcgagaagatccagatcatccccaagagcagctggcccgaccacgaggccagcctgggcgtgagcagcgcctgcccctaccagggcggccccagcttctacagaaacgtggtgtggctgatcaagaagaacaacacctaccccaccatcaagaagagctaccacaacaccaaccaggaggacctgctggtgctgtggggcatccaccaccccaacgacgaggccgagcagaccagaatctacaagaaccccaccacctacatcagcgtgggcaccagcaccctgaaccagagactggtgcccaagatcgccaccagaagcaaggtgaacggccagagcggcagagtggagttcttctggaccatcctgaagagcaacgacaccatcaacttcgagagcaacggcaacttcatcgcccccgagaacgcctacaagatcgtgaagaagggcgacagcaccatcatgaagagcgagctggagtacggcaactgcaacaccaagtgccagacccccatcggcgccatcaacagcagcatgcccttccacaacatccaccccctgaccatcggcgagtgccccaagtacgtgaagagcaacagactggtgctggccaccggcctgagaaacagcccccagggcgagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacagatgcgacaacgagtgcatggagagcgtgagaaacggcacctacgactacccccagtacagcgaggaggccagactgaagagagaggagatcagcggcgtgaagctggagagcatcggcacctaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36057 - RNA, 1707 nt, synthetic construct; identical to SEQ ID NO: 36054
  misc_feature 1..1707: note = derived and/or modified sequence opt4 from anti-influenza_Chain
  source 1..1707: mol_type = other RNA

SEQ ID NO: 36058 - RNA, 1707 nt, synthetic construct; identical to SEQ ID NO: 36055
  misc_feature 1..1707: note = derived and/or modified sequence opt4 from anti-influenza_Chain
  source 1..1707: mol_type = other RNA

SEQ ID NO: 36059 - RNA, 1707 nt, synthetic construct; identical to SEQ ID NO: 36056
  misc_feature 1..1707: note = derived and/or modified sequence opt4 from anti-influenza_Chain
  source 1..1707: mol_type = other RNA

SEQ ID NO: 36060 - RNA, 1728 nt, synthetic construct
  misc_feature 1..1728: note = derived and/or modified sequence opt4 from anti-influenza_Chain
  source 1..1728: mol_type = other RNA
atctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgccaacgacctgtgctaccccggcaacttcaacgactacgaggagctgaagcacctgctgagcagaatcaaccacttcgagaagatccagatcatccccaagagcagctggagcgaccacgaggccagcagcggcgtgagcagcgcctgcccctaccagggcacccccagcttcttcagaaacgtggtgtggctgatcaagaagaacaacacctaccccaccatcaagagaagctacaacaacaccaaccaggaggacctgctgatcctgtggggcatccaccacagcaacgacgccgccgagcagaccaagctgtaccagaaccccaccacctacatcagcgtgggcaccagcaccctgaaccagagactggtgcccaagatcgccaccagaagcaaggtgaacggccagaacggcagaatggacttcttctggaccatcctgaagcccaacgacgccatcaacttcgagagcaacggcaacttcatcgcccccgagtacgcctacaagatcgtgaagaagggcgacagcgccatcgtgaagagcgaggtggagtacggcaactgcaacaccaagtgccagacccccatcggcgccatcaacagcagcatgcccttccacaacatccaccccctgaccatcggcgagtgccccaagtacgtgaagagcaacaagctggtgctggccaccggcctgagaaacagccccctgggctacatccccgaggcccccagagacggccaggcctacgtgagaaaggacggcgagtgggtgctgctgagcaccttcctgagaagcgacaagacccacacctgccccccctgccccgcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 36061 - RNA, 1728 nt, synthetic construct
  misc_feature 1..1728: note = derived and/or modified sequence opt4 from anti-influenza_Chain
  source 1..1728: mol_type = other RNA
atggtggtgaccagcaacgccgacagaatctgcaccggcatcaccagcagcaacagcccccacgtggtgaagaccgccacccagggcgaggtgaacgtgaccggcgtgatccccctgaccaccacccccaccaagagccacttcgccaacctgaagggcaccgagaccagaggcaagctgtgccccaagtgcctgaactgcaccgacctggacgtggccctgggcagacccaagtgcaccggcaacatccccagcgccagagtgagcatcctgcacgaggtgagacccgtgaccagcggctgcttccccatcatgcacgacagaaccaagatcagacagctgcccaacctgctgagaggctacgagcacatcagactgagcacccacaacgtgatcaacgccgagaacgcccccggcggcccctacaagatcggcaccagcggcagctgccccaacgtgaccaacggcaacggcttcttcgccaccatggcctgggccgtgcccaagaacgacaacaacaagaccgccaccaacagcctgaccatcgaggtgccctacatctgcaccgagggcgaggaccagatcaccgtgtggggcttccacagcgacaacgagacccagatggccaagctgtacggcgacagcaagccccagaagttcaccagcagcgccaacggcgtgaccacccactacgtgagccagatcggcggcttccccaaccagaccgaggacggcggcctgccccagagcggcagaatcgtggtggactacatggtgcagaagagcggcaagaccggcaccatcacctaccagagaggcatcctgctgccccagaaggtgtggtgcgccagcggcaagagcaaggtgatcaagggcagcctgcccctgatcggcgaggccgactgcctgcacgagaagtacggcggcctgaacaagagcaagccctactacaccggcgagcacgccaaggccatcggcaactgccccatctgggtgaagacccccctgaagctggccaacggcaccaagtacagaccccccgccaagctgctgaaggagagaggcttcttcggcgccatcgccggcttcctggagggcggctgggagggcatgatcgccggctggcacggctacaccagccacggcgcccacggcgtggccgtggccgccgacctgaagagcacccaggaggccatcaacaagatcaccaagaacctgaacagcctgagcgagctggaggtgaagaacctgcagagactgagcggcgccatggacgagctgcacaacgagatcctggagctggacgagaaggtggacgacctgagagccgacaccatcagcagccagatcgagctggccgtgctgctgagcaacgagggcatcatcaacagcgaggacgagcacctgctggccctggagagaaagctgaagaagatgctgggccccagcgccgtggagatcggcaacggctgcttcgagaccaagcacaagtgcaaccagacctgcctggacagaatcgccgccggcaccttcgacgccggcgagttcagcctgcccaccttcgacagcctgaacatcaccgccgccagcctgaacgacgacggcctggacaaccacaccatcctgctgtactacagcaccgccgccagcagcctggccgtgaccctgatgatcgccatcttcgtggtgtacatggtgagcagagacaacgtgagctgcttccacagc

SEQ ID NO: 36062 - RNA, 1728 nt, synthetic construct; identical to SEQ ID NO: 36061
  misc_feature 1..1728: note = derived and/or modified sequence opt4 from anti-influenza_Chain
  source 1..1728: mol_type = other RNA

SEQ ID NO: 36063 - RNA, 1728 nt, synthetic construct; identical to SEQ ID NO: 36060
  misc_feature 1..1728: note = derived and/or modified sequence opt4 from anti-influenza_Chain
  source 1..1728: mol_type = other RNA

SEQ ID NO: 36064 - RNA, 1731 nt, synthetic construct
  misc_feature 1..1731: note = derived and/or modified sequence opt4 from anti-influenza_Chain
  source 1..1731: mol_type = other RNA
gccaaggccggcgtgcagagcgtgaagatggagaagatcgtgctgctgttcgccatcgtgagcctggtgaagagcgaccagatctgcatcggctaccacgccaacaacagcaccgagcaggtggacaccatcatggagaagaacgtgaccgtgacccacgcccaggacatcctggagaagacccacaacggcaagctgtgcgacctggacggcgtgaagcccctgatcctgagagactgcagcgtggccggctggctgctgggcaaccccatgtgcgacgagttcatcaacgtgcccgagtggagctacatcgtggagaaggccaaccccgtgaacgacctgtgctaccccggcgacttcaacgactacgaggagctgaagcacctgctgagcagaatcaaccacttcgagaagatccagatcatccccaagagcagctggagcagccacgaggccagcctgggcgtgagcagcgcctgcccctaccagggcaagagcagcttcttcagaaacgtggtgtggctgatcaagaagaacagcacctaccccaccatcaagagaagctacaacaacaccaaccaggaggacctgctggtgctgtggggcatccaccaccccaacgacgccgccgagcagaccaagctgtaccagaaccccaccacctacatcagcgtgggcaccagcaccctgaaccagagactggtgcccagaatcgccaccagaagcaaggtgaacggccagagcggcagaatggagttcttctggaccatcctgaagcccaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacagcccccagagagagagaagaagaaagaagagaggcctgttcggcgccatcgccggcttcatcgagggcggctggcagggcatggtggacggctggtacggctaccaccacagcaacgagcagggcagcggctacgccgccgacaaggagagcacccagaaggccatcgacggcgtgaccaacaaggtgaacagcatcatcgacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgagaaacggcacctacgactacccccagtacagcgaggaggccagactgaagagagaggagatcagcggcgtgaagctggagagcatcggcatctaccagatcctgagcatctacagcaccgtggccagcagcctggccctggccctgatggtggccggcctgagcctgtggatgtgcagcaacggcagcctgcagtgcagaatctgcatc

SEQ ID NO: 36065 - RNA, 1731 nt, synthetic construct; identical to SEQ ID NO: 36064
  misc_feature 1..1731: note = derived and/or modified sequence opt4 from anti-influenza_Chain
  source 1..1731: mol_type = other RNA

SEQ ID NO: 36066 - RNA, 1737 nt, synthetic construct
  misc_feature 1..1737: note = derived and/or modified sequence opt4 from anti-influenza_Chain
  source 1..1737: mol_type = other RNA
atggtggtgaccagcaacgccgacagaatctgcaccggcatcaccagcagcaacagcccccacgtggtgaagaccgccacccagggcgaggtgaacgtgaccggcgtgatccccctgaccaccacccccaccaagagccacttcgccaacctgaagggcacccagaccagaggcaagctgtgccccaactgcctgaactgcaccgacctggacgtggccctgggcagacccaagtgcatgggcaccatccccagcgccaaggccagcatcctgcacgaggtgaagcccgtgaccagcggctgcttccccatcatgcacgacagaaccaagatcagacagctgcccaacctgctgagaggctacgagaacatcagactgagcgccagaaacgtgatcaacgccgagaccgcccccggcggcccctacatcgtgggcaccagcggcagctgccccaacgtgaccaacggcaagggcttcttcgccaccatggcctgggccgtgcccaagaacaagaacaagaccgccaccaaccccctgaccgtggaggtgccctacatctgcaccaagggcgaggaccagatcaccgtgtggggcttccacagcgacaacgaggcccagatggtgaccctgtacggcgacagcaagccccagaagttcaccagcagcgccaacggcgtgaccacccactacgtgagccagatcggcggcttccccaaccagaccgaggacgagggcctgcagcagagcggcagaatcgtggtggactacatggtgcagaagcccggcaagaccggcaccatcgtgtaccagagaggcgtgctgctgccccagaaggtgtggtgcgccagcggcagaagcaaggtgatcaagggcagcctgcccctgatcggcgaggccgactgcctgcacgagaagtacggcggcctgaacaagagcaagccctactacaccggcgagcacgccaaggccatcggcaactgccccatctgggtgaagacccccctgaagctggccaacggcaccaagtacagaccccccgccaagctgctgaaggagagaggcttcttcggcgccatcgccggcttcctggagggcggctgggagggcatgatcgccggctggcacggctacaccagccacggcgcccacggcgtggccgtggccgccgacctgaagagcacccaggaggccatcaacaagatcaccaagaacctgaacagcctgagcgagctggaggtgaagaacctgcagagactgagcggcgccatggacgagctgcacaacgagatcctggagctggacgagaaggtggacgacctgagagccgacaccatcagcagccagatcgagctggccgtgctgctgagcaacgagggcatcatcaacagcgaggacgagcacctgctggccctggagagaaagctgaagaagatgctgggccccagcgccgtggacatcggcaacggctgcttcgagaccaagcacaagtgcaaccagacctgcctggacagaatcgccgccggcaccttcaacgccggcgagttcagcctgcccaccttcgacagcctgaacatcaccgccgccagcctgaacgacgacggcctggacaaccacaccatcctgctgtactacagcaccgccgccagcagcctggccgtgaccctgatgatcgccatcttcatcgtgtacatggtgagcagagacaacgtgttcctgctgcacctgagcatcagaaag

SEQ ID NO: 36067 - RNA, 1737 nt, synthetic construct; identical to SEQ ID NO: 36066
  misc_feature 1..1737: note = derived and/or modified sequence opt4 from anti-influenza_Chain
  source 1..1737: mol_type = other RNA

SEQ ID NO: 36068 - RNA, 1731 nt, synthetic construct
  misc_feature 1..1731: note = derived and/or modified sequence opt4 from anti-influenza_Chain
  source 1..1731: mol_type = other RNA
atggagaccatcagcctgatcaccatcctgctggtggtgaccgccagcaacgccgacaagatctgcatcggccaccagagcaccaacagcaccgagaccgtggacaccctgaccgagaccaacgtgcccgtgacccacgccaaggagctgctgcacaccgagcacaacggcatgctgtgcgccaccagcctgggccaccccctgatcctggacacctgcaccatcgagggcctggtgtacggcaaccccagctgcgacctgctgctgggcggcagagagtggagctacatcgtggagagaagcagcgccgtgaacggcacctgctaccccggcaacgtggagaacctggaggagctgagaaccctgttcagcagcgccagcagctaccagagaatccagatcttccccgacaccacctggaacgtgacctacaccggcaccagcagagcctgcagcggcagcttctacagaagcatgagatggctgacccagaagagcggcttctaccccgtgcaggacgcccagtacaccaacaacagaggcaagagcatcctgttcgtgtggggcatccaccacccccccacctacaccgagcagaccaacctgtacatcagaaacgacaccaccaccagcgtgaccaccgaggacctgaacagaaccttcaagcccgtgatcggccccagacccctggtgaacggcctgcagggcagaatcgactactactggagcgtgctgaagcccggccagaccctgagagtgagaagcaacggcaacctgatcgccccctggtacggccacgtgctgagcggcggcagccacggcagaatcctgaagaccgacctgaagggcggcaactgcgtggtgcagtgccagaccgagaagggcggcctgaacagcaccctgcccttccacaacatcagcaagtacgccttcggcacctgccccaagtacgtgagagtgaacagcctgaagctggccgtgggcctgagaaacgtgcccgccagaagcagcagaggcctgttcggcgccatcgccggcttcatcgagggcggctggcccggcctggtggccggctggtacggcttccagcacagcaacgaccagggcgtgggcatggccgccgacagagacagcacccagaaggccatcgacaagatcaccagcaaggtgaacaacatcgtggacaagatgaacaagcagtacgagatcatcgaccacgagttcagcgaggtggagaccagactgaacatgatcaacaacaagatcgacgaccagatccaggacgtgtgggcctacaacgccgagctgctggtgctgctggagaaccagaagaccctggacgagcacgacgccaacgtgaacaacctgtacaacaaggtgaagagagccctgggcagcaacgccatggaggacggcaagggctgcttcgagctgtaccacaagtgcgacgaccagtgcatggagaccatcagaaacggcacctacaacagaagaaagtacagagaggagagcagactggagagacagaagatcgagggcgtgaagctggagagcgagggcacctacaagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36069 - RNA, 1731 nt, synthetic construct; identical to SEQ ID NO: 36068
  misc_feature 1..1731: note = derived and/or modified sequence opt4 from anti-influenza_Chain
  source 1..1731: mol_type = other RNA

SEQ ID NO: 36070 - RNA, 1752 nt, synthetic construct
  misc_feature 1..1752: note = derived and/or modified sequence opt4 from anti-influenza_Chain
  source 1..1752: mol_type = other RNA
atgaaggccatcatcgtgctgctgatggtggtgaccagcaacgccgacagaatctgcaccggcatcaccagcagcaacagcccccacgtggtgaagaccgccacccagggcgaggtgaacgtgaccggcgtgatccccctgaccaccacccccaccaagagccacttcgccaacctgaagggcacccagaccagaggcaagctgtgccccaactgcttcaactgcaccgacctggacgtggccctgggcagacccaagtgcatgggcaacacccccagcgccaaggtgagcatcctgcacgaggtgaagcccgccaccagcggctgcttccccatcatgcacgacagaaccaagatcagacagctgcccaacctgctgagaggctacgagaacatcagactgagcaccagcaacgtgatcaacaccgagaccgcccccggcggcccctacaaggtgggcaccagcggcagctgccccaacgtggccaacggcaacggcttcttcaacaccatggcctgggtgatccccaaggacaacaacaagaccgccatcaaccccgtgaccgtggaggtgccctacatctgcagcgagggcgaggaccagatcaccgtgtggggcttccacagcgacgacaagacccagatggagagactgtacggcgacagcaacccccagaagttcaccagcagcgccaacggcgtgaccacccactacgtgagccagatcggcggcttccccaaccagaccgaggacgagggcctgaagcagagcggcagaatcgtggtggactacatggtgcagaagcccggcaagaccggcaccatcgtgtaccagagaggcatcctgctgccccagaaggtgtggtgcgccagcggcagaagcaaggtgatcaagggcagcctgcccctgatcggcgaggccgactgcctgcacgagaagtacggcggcctgaacaagagcaagccctactacaccggcgagcacgccaaggccatcggcaactgccccatctgggtgaagacccccctgaagctggccaacggcaccaagtacagaccccccgccaagctgctgaaggagagaggcttcttcggcgccatcgccggcttcctggagggcggctgggagggcatgatcgccggctggcacggctacaccagccacggcgcccacggcgtggccgtggccgccgacctgaagagcacccaggaggccatcaacaagatcaccaagaacctgaactacctgagcgagctggaggtgaagaacctgcagagactgagcggcgccatgaacgagctgcacgacgagatcctggagctggacgagaaggtggacgacctgagagccgacaccatcagcagccagatcgagctggccgtgctgctgagcaacgagggcatcatcaacagcgaggacgagcacctgctggccctggagagaaagctgaagaagatgctgggccccagcgccgtggagatcggcaacggctgcttcgagaccaagcacaagtgcaaccagacctgcctggacagaatcgccgccggcaccttcaacgccggcgacttcagcctgcccaccttcgacagcctgaacatcaccgccgccagcctgaacgacgacggcctggacaaccacaccatcctgctgtactacagcaccgccgccagcagcctggccgtgaccctgatgatcgccatcttcatcgtgtacatggtgagcagagacaacgtgagctgcagcatctgcctg

SEQ ID NO: 36071 - RNA, 1752 nt, synthetic construct
  misc_feature 1..1752: note = derived and/or modified sequence opt4 from anti-influenza_Chain
  source 1..1752: mol_type = other RNA
atgaaggccatcatcgtgctgctgatggtggtgaccagcaacgccgacagaatctgcaccggcatcaccagcagcaacagcccccacgtggtgaagaccgccacccagggcgaggtgaacgtgaccggcgtgatccccctgaccaccacccccaccaagagctacttcgccaacctgaagggcaccaagaccagaggcaagctgtgccccgactgcctgaactgcaccgacctggacgtggccctgggcagacccatgtgcgtgggcaccacccccagcgccaaggccagcatcctgcacgaggtgagacccgtgaccagcggctgcttccccatcatgcacgacagaaccaagatcagacagctggccaacctgctgagaggctacgagaacatcagactgagcacccagaacgtgatcgacgccgagaaggcccccggcggcccctacagactgggcaccagcggcagctgccccaacgccaccagcaagagcggcttcttcgccaccatggcctgggccgtgcccaaggacaacaacaagaacgccaccaaccccctgaccgtggaggtgccctacatctgcaccgagggcgaggaccagatcaccgtgtggggcttccacagcgacgacaagacccagatgaagaacctgtacggcgacagcaacccccagaagttcaccagcagcgccaacggcgtgaccacccactacgtgagccagatcggcggcttccccgaccagaccgaggacggcggcctgccccagagcggcagaatcgtggtggactacatgatgcagaagcccggcaagaccggcaccatcgtgtaccagagaggcgtgctgctgccccagaaggtgtggtgcgccagcggcagaagcaaggtgatcaagggcagcctgcccctgatcggcgaggccgactgcctgcacgagaagtacggcggcctgaacaagagcaagccctactacaccggcgagcacgccaaggccatcggcaactgccccatctgggtgaagacccccctgaagctggccaacggcaccaagtacagaccccccgccaagctgctgaaggagagaggcttcttcggcgccatcgccggcttcctggagggcggctgggagggcatgatcgccggctggcacggctacaccagccacggcgcccacggcgtggccgtggccgccgacctgaagagcacccaggaggccatcaacaagatcaccaagaacctgaacagcctgagcgagctggaggtgaagaacctgcagagactgagcggcgccatggacgagctgcacaacgagatcctggagctggacgagaaggtggacgacctgagagccgacaccatcagcagccagatcgagctggccgtgctgctgagcaacgagggcatcatcaacagcgaggacgagcacctgctggccctggagagaaagctgaagaagatgctgggccccagcgccgtggacatcggcaacggctgcttcgagaccaagcacaagtgcaaccagacctgcctggacagaatcgccgccggcaccttcaacgccggcgagttcagcctgcccaccttcgacagcctgaacatcaccgccgccagcctgaacgacgacggcctggacaaccacaccatcctgctgtactacagcaccgccgccagcagcctggccgtgaccctgatgctggccatcttcatcgtgtacatggtgagcagagacaacgtgagctgcagcatctgcctg

SEQ ID NO: 36072 - RNA, 1752 nt, synthetic construct
  misc_feature 1..1752: note = derived and/or modified sequence opt4 from anti-influenza_Chain
  source 1..1752: mol_type = other RNA
atgaaggccatcatcgtgctgctgatggtggtgaccagcaacgccgacagaatctgcaccggcatcaccagcagcaacagcccccacgtggtgaagaccgccacccagggcgaggtgaacgtgaccggcgtgatccccctgaccaccacccccaccaagagctacttcgccaacctgaagggcaccagaaccagaggcaagctgtgccccgactgcctgaactgcaccgacctggacgtggccctgggcagacccatgtgcgtgggcaccacccccagcgccaaggccagcatcctgcacgaggtgaagcccgtgaccagcggctgcttccccatcatgcacgacagaaccaagatcagacagctgcccaacctgctgagaggctacgagaacatcagactgagcacccagaacgtgatcgacgccgagaaggcccccggcggcccctacagactgggcaccagcggcagctgccccaacgccaccagcaagagcggcttcttcgccaccatggcctgggccgtgcccaaggacaacaacaagaacgccaccaaccccctgaccgtggaggtgccctacatctgcaccgagggcgaggaccagatcaccgtgtggggcttccacagcgacgacaagacccagatgaagaacctgtacggcgacagcaacccccagaagttcaccagcagcgccaacggcgtgaccacccactacgtgagccagatcggcagcttccccgaccagaccgaggacggcggcctgccccagagcggcagaatcgtggtggactacatgatgcagaagcccggcaagaccggcaccatcgtgtaccagagaggcgtgctgctgccccagaaggtgtggtgcgccagcggcagaagcaaggtgatcaagggcagcctgcccctgatcggcgaggccgactgcctgcacgagaagtacggcggcctgaacaagagcaagccctactacaccggcgagcacgccaaggccatcggcaactgccccatctgggtgaagacccccctgaagctggccaacggcaccaagtacagaccccccgccaagctgctgaaggagagaggcttcttcggcgccatcgccggcttcctggagggcggctgggagggcatgatcgccggctggcacggctacaccagccacggcgcccacggcgtggccgtggccgccgacctgaagagcacccaggaggccatcaacaagatcaccaagaacctgaacagcctgagcgagctggaggtgaagaacctgcagagactgagcggcgccatggacgagctgcacaacgagatcctggagctggacgagaaggtggacgacctgagagccgacaccatcagcagccagatcgagctggccgtgctgctgagcaacgagggcatcatcaacagcgaggacgagcacctgctggccctggagagaaagctgaagaagatgctgggccccagcgccgtggagatcggcaacggctgcttcgagaccaagcacaagtgcaaccagacctgcctggacagaatcgccgccggcaccttcaacgccggcgagttcagcctgcccaccttcgacagcctgaacatcaccgccgccagcctgaacgacgacggcctggacaaccacaccatcctgctgtactacagcaccgccgccagcagcctggccgtgaccctgatgctggccatcttcatcgtgtacatggtgagcagagacaacgtgagctgcagcatctgcctg

SEQ ID NO: 36073 - RNA, 1752 nt, synthetic construct; identical to SEQ ID NO: 36070
  misc_feature 1..1752: note = derived and/or modified sequence opt4 from anti-influenza_Chain
  source 1..1752: mol_type = other RNA

SEQ ID NO: 36074 - RNA, 1752 nt, synthetic construct; identical to SEQ ID NO: 36071
  misc_feature 1..1752: note = derived and/or modified sequence opt4 from anti-influenza_Chain
  source 1..1752: mol_type = other RNA

SEQ ID NO: 36075 - RNA, 1752 nt, synthetic construct; identical to SEQ ID NO: 36072
  misc_feature 1..1752: note = derived and/or modified sequence opt4 from anti-influenza_Chain
  source 1..1752: mol_type = other RNA

SEQ ID NO: 36076 - RNA, 1758 nt, synthetic construct
  misc_feature 1..1758: note = derived and/or modified sequence opt4 from anti-influenza_Chain
  source 1..1758: mol_type = other RNA
atgaaggccatcatcgtgctgctgatggtggtgaccagcaacgccgacagaatcatctgcaccggcatcaccagcagcaacagcccccacgtggtgaagaccgccacccagggcgaggtgaacgtgaccggcgtgatccccctgaccaccacccccaccaagagccacttcgccaacctgaagggcaccgagaccagaggcaagctgtgccccaagtgcctgaactgcaccgacctggacgtggccctgggcagacccaagtgcaccggcaacatccccagcgccagagtgagcatcctgcacgaggtgagacccgtgaccagcggctgcttccccatcatgcacgacagaaccaagatcagacagctgcccaacctgctgagaggctacgagcacatcagactgagcacccacaacgtgatcaacgccgagaacgcccccggcggcccctacaagatcggcaccagcggcagctgccccaacgtgaccaacggcaacggcttcttcgccaccatggcctgggccgtgcccaagaacgacaacaacaagaccgccaccaacagcctgaccatcgaggtgccctacatctgcaccgagggcgaggaccagatcaccgtgtggggcttccacagcgacaacgagacccagatggccaagctgtacggcgacagcaagccccagaagttcaccagcagcgccaacggcgtgaccacccactacgtgagccagatcggcggcttccccaaccagaccgaggacggcggcctgccccagagcggcagaatcgtggtggactacatggtgcagaagagcggcaagaccggcaccatcacctaccagagaggcatcctgctgccccagaaggtgtggtgcgccagcggcagaagcaaggtgatcaagggcagcctgcccctgatcggcgaggccgactgcctgcacgagaagtacggcggcctgaacaagagcaagccctactacaccggcgagcacgccaaggccatcggcaactgccccatctgggtgaagacccccctgaagctggccaacggcaccaagtacagaccccccgccaagctgctgaaggagagaggcttcttcggcgccatcgccggcttcctggagggcggctgggagggcatgatcgccggctggcacggctacaccagccacggcgcccacggcgtggccgtggccgccgacctgaagagcacccaggaggccatcaacaagatcaccaagaacctgaacagcctgagcgagctggaggtgaagaacctgcagagactgagcggcgccatggacgagctgcacaacgagatcctggagctggacgagaaggtggacgacctgagagccgacaccatcagcagccagatcgagctggccgtgctgctgagcaacgagggcatcatcaacagcgaggacgagcacctgctggccctggagagaaagctgaagaagatgctgggccccagcgccgtggagatcggcaacggctgcttcgagaccaagcacaagtgcaaccagacctgcctggacagaatcgccgccggcaccttcgacgccggcgagttcagcctgcccaccttcgacagcctgaacatcaccgccgccagcctgaacgacgacggcctggacaaccacaccatcctgctgtactacagcaccgccgccagcagcctggccgtgaccctgatgatcgccatcttcgtggtgtacatggtgagcagagacaacgtgagctgcagcatctgcctg

SEQ ID NO: 36077 - RNA, 1758 nt, synthetic construct; identical to SEQ ID NO: 36076
  misc_feature 1..1758: note = derived and/or modified sequence opt4 from anti-influenza_Chain
  source 1..1758: mol_type = other RNA

SEQ ID NO: 36078 - RNA, 1749 nt, synthetic construct
  misc_feature 1..1749: note = derived and/or modified sequence opt4 from anti-influenza_Chain
  source 1..1749: mol_type = other RNA
atggaggccagactgctggtgctgctgtgcgccttcgccgccaccaacgccgacaccatctgcatcggctaccacgccaacaacagcaccgacaccgtggacaccgtgctggagaagaacgtgaccgtgacccacagcgtgaacctgctggaggacagccacaacggcaagctgtgcaagctgaagggcatcgcccccctgcagctgggcaagtgcaacatcgccggctggctgctgggcaaccccgagtgcgacctgctgctgaccgccagcagctggagctacatcgtggagaccagcaacagcgagaacggcacctgctaccccggcgacttcatcgactacgaggagctgagagagcagctgagcagcgtgagcagcttcgagaagttcgagatcttccccaagaccagcagctggcccaaccacgagaccaccaagggcgtgaccgccgcctgcagctacgccggcgccagcagcttctacagaaacctgctgtggctgaccaagaagggcagcagctaccccaagctgagcaagagctacgtgaacaacaagggcaaggaggtgctggtgctgtggggcgtgcaccacccccccaccggcaccgaccagcagagcctgtaccagaacgccgacgcctacgtgagcgtgggcagcagcaagtacaacagaagattcacccccgagatcgccgccagacccaaggtgagagaccaggccggcagaatgaactactactggaccctgctggagcccggcgacaccatcaccttcgaggccaccggcaacctgatcgccccctggtacgccttcgccctgaacagaggcagcggcagcggcatcatcaccagcgacgcccccgtgcacgactgcaacaccaagtgccagaccccccacggcgccatcaacagcagcctgcccttccagaacatccaccccgtgaccatcggcgagtgccccaagtacgtgagaagcaccaagctgagaatggccaccggcctgagaaacatccccagcatccagagcagaggcctgttcggcgccatcgccggcttcatcgagggcggctggaccggcatgatcgacggctggtacggctaccaccaccagaacgagcagggcagcggctacgccgccgaccagaagagcacccagaacgccatcgacggcatcaccaacaaggtgaacagcgtgatcgagaagatgaacacccagttcaccgccgtgggcaaggagttcaacaacctggagagaagaatcgagaacctgaacaagaaggtggacgacggcttcctggacatctggacctacaacgccgagctgctggtgctgctggagaacgagagaaccctggacttccacgacagcaacgtgagaaacctgtacgagaaggtgaagagccagctgaagaacaacgccaaggagatcggcaacggctgcttcgagttctaccacaagtgcgacgacgcctgcatggagagcgtgagaaacggcacctacgactaccccaagtacagcgaggagagcaagctgaacagagaggagatcgacggcgtgaagctggagagcatgggcgtgtaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36079 - RNA, 1749 nt, synthetic construct; identical to SEQ ID NO: 36078
  misc_feature 1..1749: note = derived and/or modified sequence opt4 from anti-influenza_Chain
  source 1..1749: mol_type = other RNA

SEQ ID NO: 36080 - RNA, 1755 nt, synthetic construct
  misc_feature 1..1755: note = derived and/or modified sequence opt4 from anti-influenza_Chain
  source 1..1755: mol_type = other RNA
atggagagaaccgtgctgctgctggccaccgtgagcctggtgaagagcgaccagatctgcatcggctaccacgccaacaacagcaccgagcaggtggacaccatcatggagaagaacgtgaccgtgacccacgcccaggacatcctggagagaacccacaacggcaagctgtgcgacctgaacggcgtgaagcccctgatcctgagagactgcagcgtggccggctggctgctgggcaaccccatgtgcgacgagttcatcaacgtgcccgagtggagctacatcgtggagaaggccagccccgccaacgacctgtgctaccccggcaacttcaacgactacgaggagctgaagcacctgctgagcagaatcaaccacttcgagaagatccagatcatccccaagagcagctggagcaaccacgacgccagcagcggcgtgagcagcgcctgcccctacctgggcagaagcagcttcttcagaaacgtggtgtggctgatcaagaagaacagcgcctaccccaccatcaagagaagctacaacaacaccaaccaggaggacctgctggtgctgtggggcgtgcaccaccccaacgacgccgccgagcagaccaagctgtaccagaaccccaccacctacatcagcgtgggcaccagcaccctgaaccagagactggtgcccgagatcgccaccagacccaaggtgaacggccagagcggcagaatggagttcttctggaccatcctgaagcccaacgacgccatcaacttcgagagcaacggcaacttcatcgcccccgagtacgcctacaagatcgtgaagaagggcgacagcaccatcatgaagagcgagctggagtacggcaactgcaacaccaagtgccagacccccatgggcgccatcaacagcagcatgcccttccacaacatccaccccctgaccatcggcgagtgccccaagtacgtgaagagcaacagactggtgctggccaccggcctgagaaacaccccccagagagagagaagaagaaagaagagaggcctgttcggcgccatcgccggcttcatcgagggcggctggcagggcatggtggacggctggtacggctaccaccacagcaacgagcagggcagctgctacagcgccgacaaggagagcacccagaaggccatcgacggcgtgaccaacaaggtgaacagcatcatcaacaagatgaacacccagttcgaggccgtgggcagagagttcaacaacctggagagaagaatcgagaacctgaacaagaagatggaggacggcttcctggacgtgtggacctacaacgccgagctgctggtgctgatggagaacgagagaaccctggacttccacgacagcaacgtgaagaacctgtacgacaaggtgagactgcagctgagagacaacgccaaggagctgggcaacggctgcttcgagttctaccacaagtgcgacaacgagtgcatggagagcgtgaagaacggcacctacgactacccccagtacagcgaggaggccagactgaacagagaggagatcagcggcgtgaagctggagagcatgggcacctaccagagcggcagactggtgcccagaggcagccccggcagcggctacatccccgaggcccccagagacggccaggcctacgtgagaaaggacggcgagtgggtgctgctgagcaccttcctgggcaagcccatccccaaccccctgctgggcctggacagcaccggc

SEQ ID NO: 36081 - RNA, 1755 nt, synthetic construct; identical to SEQ ID NO: 36080
  misc_feature 1..1755: note = derived and/or modified sequence opt4 from anti-influenza_Chain
  source 1..1755: mol_type = other RNA

SEQ ID NO: 36082 - RNA, 1947 nt, synthetic construct
  misc_feature 1..1947: note = derived and/or modified sequence opt4 from anti-influenza_Chain
  source 1..1947: mol_type = other RNA
atgggcgacaagatcaacttcatcttcggcatccacaaccaccagcccctgggcaacttcggctgggtgttcgaggaggcctacgagaagtgctactggcccttcctggagaccctggaggagtaccccaacatgaaggtggccatccacaccagcggccccctgatcgagtggctgcaggacaacagacccgagtacatcgacctgctgagaagcctggtgaagagaggccaggtggagatcgtggtggccggcttctacgagcccgtgctggccagcatccccaaggaggacagaatcgagcagatcagactgatgaaggagtgggccaagagcatcggcttcgacgccagaggcgtgtggctgaccgagagagtgtggcagcccgagctggtgaagaccctgaaggagagcggcatcgactacgtgatcgtggacgactaccacttcatgagcgccggcctgagcaaggaggagctgtactggccctactacaccgaggacggcggcgaggtgatcgccgtgttccccatcgacgagaagctgagatacctgatccccttcagacccgtggacaaggtgctggagtacctgcacagcctgatcgacggcgacgagagcaaggtggccgtgttccacgacgacggcgagaagttcggcatctggcccggcacctacgagtgggtgtacgagaagggctggctgagagagttcttcgacagaatcagcagcgacgagaagatcaacctgatgctgtacaccgagtacctggagaagtacaagcccagaggcctggtgtacctgcccatcgccagctacttcgagatgagcgagtggagcctgcccgccaagcaggccagactgttcgtggagttcgtgaacgagctgaaggtgaagggcatcttcgagaagtacagagtgttcgtgagaggcggcatctggaagaacttcttctacaagtaccccgagagcaactacatgcacaagagaatgctgatggtgagcaagctggtgagaaacaaccccgaggccagaaagtacctgctgagagcccagtgcaacgacgcctactggcacggcctgttcggcggcgtgtacctgccccacctgagaagagccatctggaacaacctgatcaaggccaacagctacgtgagcctgggcaaggtgatcagagacatcgactacgacggcttcgaggaggtgctgatcgagaacgacaacttctacgccgtgttcaagcccagctacggcggcagcctggtggagttcagcagcaagaacagactggtgaactacgtggacgtgctggccagaagatgggagcactaccacggctacgtggagagccagttcgacggcgtggccagcatccacgagctggagaagaagatccccgacgagatcagaaaggaggtggcctacgacaagtacagaagattcatgctgcaggaccacgtggtgcccctgggcaccaccctggaggacttcatgttcagcagacagcaggagatcggcgagttccccagagtgccctacagctacgagctgctggacggcggcatcagactgaagagagagcacctgggcatcgaggtggagaagaccgtgaagctggtgaacgacggcttcgaggtggagtacatcgtgaacaacaagaccggcaaccccgtgctgttcgccgtggagctgaacgtggccgtgcagagcatcatggagagccccggcgtgctgagaggcaaggagatcgtggtggacgacaagtacgccgtgggcaagttcgccctgaagttcgaggacgagatggaggtgtggaagtaccccgtgaagaccctgagccagagcgagagcggctgggacctgatccagcagggcgtgagctacatcgtgcccatcagactggaggacaagatcagattcaagctgaagttcgaggaggccagcggc

SEQ ID NO: 36083 - RNA, 1947 nt, synthetic construct
  misc_feature 1..1947: note = derived and/or modified sequence opt4 from anti-influenza_Chain
  source 1..1947: mol_type = other RNA
atgagcagaatgaccctgaagagcagcatgaagaagagagtgctgagcctgctgatcgccgtggtgttcctgagcctgaccggcgtgttccccagcggcctgatcgagaccaaggtgagcgccgccaagatcaccgagaactaccagttcgacagcagaatcagactgaacagcatcggcttcatccccaaccacagcaagaaggccaccatcgccgccaactgcagcaccttctacgtggtgaaggaggacggcaccatcgtgtacaccggcaccgccaccagcatgttcgacaacgacaccaaggagaccgtgtacatcgccgacttcagcagcgtgaacgaggagggcacctactacctggccgtgcccggcgtgggcaagagcgtgaacttcaagatcgccatgaacgtgtacgaggacgccttcaagaccgccatgctgggcatgtacctgctgagatgcggcaccagcgtgagcgccacctacaacggcatccactacagccacggcccctgccacaccaacgacgcctacctggactacatcaacggccagcacaccaagaaggacagcaccaagggctggcacgacgccggcgactacaacaagtacgtggtgaacgccggcatcaccgtgggcagcatgttcctggcctgggagcacttcaaggaccagctggagcccgtggccctggagatccccgagaagaacaacagcatccccgacttcctggacgagctgaagtacgagatcgactggatcctgaccatgcagtaccccgacggcagcggcagagtggcccacaaggtgagcaccagaaacttcggcggcttcatcatgcccgagaacgagcacgacgagagattcttcgtgccctggagcagcgccgccaccgccgacttcgtggccatgaccgccatggccgccagaatcttcagaccctacgacccccagtacgccgagaagtgcatcaacgccgccaaggtgagctacgagttcctgaagaacaaccccgccaacgtgttcgccaaccagagcggcttcagcaccggcgagtacgccaccgtgagcgacgccgacgacagactgtgggccgccgccgagatgtgggagaccctgggcgacgaggagtacctgagagacttcgagaacagagccgcccagttcagcaagaagatcgaggccgacttcgactgggacaacgtggccaacctgggcatgttcacctacctgctgagcgagagacccggcaagaaccccgccctggtgcagagcatcaaggacagcctgctgagcaccgccgacagcatcgtgagaaccagccagaaccacggctacggcagaaccctgggcaccacctactactggggctgcaacggcaccgtggtgagacagaccatgatcctgcaggtggccaacaagatcagccccaacaacgactacgtgaacgccgccctggacgccatcagccacgtgttcggcagaaactactacaacagaagctacgtgaccggcctgggcatcaacccccccatgaacccccacgacagaagaagcggcgccgacggcatctgggagccctggcccggctacctggtgggcggcggctggcccggccccaaggactgggtggacatccaggacagctaccagaccaacgagatcgccatcaactggaacgccgccctgatctacgccctggccggcttcgtgaactacaacagcccccagaacgaggtgctgtacggcgacgtgaacgacgacggcaaggtgaacagcaccgacctgaccctgctgaagagatacgtgctgaaggccgtgagcaccctgcccagcagcaaggccgagaagaacgccgacgtgaacagagacggcagagtgaacagcagcgacgtgaccatcctgagcagatacctgatcagagtgatcgagaagctgcccatc

SEQ ID NO: 36084 - RNA, 1947 nt, synthetic construct; identical to SEQ ID NO: 36082
  misc_feature 1..1947: note = derived and/or modified sequence opt4 from anti-influenza_Chain
  source 1..1947: mol_type = other RNA

SEQ ID NO: 36085 - RNA, 1947 nt, synthetic construct; identical to SEQ ID NO: 36083
  misc_feature 1..1947: note = derived and/or modified sequence opt4 from anti-influenza_Chain
  source 1..1947: mol_type = other RNA

SEQ ID NO: 36086 - RNA, 2046 nt, synthetic construct
  misc_feature 1..2046: note = derived and/or modified sequence opt4 from anti-influenza_Chain
  source 1..2046: mol_type = other RNA
atgaagcccagccacttcaccgagaagagattcatgaagaaggtgctgggcctgttcctggtggtggtgatgctggccagcgtgggcgtgctgcccaccagcaaggtgcaggccgccggcaccaccgtgaccagcatggagtacttcagccccgccgacggccccgtgatcagcaagagcggcgtgggcaaggccagctacggcttcgtgatgcccaagttcaacggcggcagcgccacctggaacgacgtgtacagcgacgtgggcgtgaacgtgaaggtgggcaacaactgggtggacatcgaccaggccggcggctacatctacaaccagaactggggccactggagcgacggcggcttcaacggctactggttcaccctgagcgccaccaccgagatccagctgtacagcaaggccaacggcgtgaagctggagtaccagctggtgttccagaacatcaacaagaccaccatcaccgccatgaaccccacccagggcccccagatcaccgccagcttcaccggcggcgccggcttcacctaccccaccttcaacaacgacagcgccgtgacctacgaggccgtggccgacgacctgaaggtgtacgtgaagcccgtgaacagcagcagctggatcgacatcgacaacaacgccgccagcggctggatctacgaccacaacttcggccagttcaccgacggcggcggcggctactggttcaacgtgaccgagagcatcaacgtgaagctggagagcaagaccagcagcgccaacctggtgtacaccatcaccttcaacgagcccaccagaaacagctacgtgatcaccccctacgagggcaccaccttcaccgccgacgccaacggcagcatcggcatccccctgcccaagatcgacggcggcgcccccatcgccaaggagctgggcaacttcgtgtaccagatcaacatcaacggccagtgggtggacctgagcaacagcagccagagcaagttcgcctacagcgccaacggctacaacaacatgagcgacgccaaccagtggggctactgggccgactacatctacggcctgtggttccagcccatccaggagaacatgcagatcagaatcggctaccccctgaacggccaggccggcggcaacatcggcaacaacttcgtgaactacaccttcatcggcaaccccaacgcccccagacccgacgtgagcgaccaggaggacatcagcatcggcacccccaccgaccccgccatcgccggcatgaacctgatctggcaggacgagttcaacggcaccaccctggacaccagcaagtggaactacgagaccggctactacctgaacaacgaccccgccacctggggctggggcaacgccgagctgcagcactacaccaacagcacccagaacgtgtacgtgcaggacggcaagctgaacatcaaggccatgaacgacagcaagagcttcccccaggaccccaacagatacgcccagtacagcagcggcaagatcaacaccaaggacaagctgagcctgaagtacggcagagtggacttcagagccaagctgcccaccggcgacggcgtgtggcccgccctgtggatgctgcccaaggacagcgtgtacggcacctgggccgccagcggcgagatcgacgtgatggaggccagaggcagactgcccggcagcgtgagcggcaccatccacttcggcggccagtggcccgtgaaccagagcagcggcggcgactaccacttccccgagggccagaccttcgccaacgactaccacgtgtacagcgtggtgtgggaggaggacaacatcaagtggtacgtggacggcaagttcttctacaaggtgaccaaccagcagtggtacagcaccgccgcccccaacaaccccaacgcccccttcgacgagcccttctacctgatcatgaacctggccgtgggcggcaacttcgacggcggcagaacccccaacgccagcgacatccccgccaccatgcaggtggactacgtgagagtgtacaaggagcag

SEQ ID NO: 36087 - RNA, 2046 nt, synthetic construct; identical to SEQ ID NO: 36086
  misc_feature 1..2046: note = derived and/or modified sequence opt4 from anti-influenza_Chain
  source 1..2046: mol_type = other RNA

SEQ ID NO: 36088 - RNA, 2058 nt, synthetic construct
  misc_feature 1..2058: note = derived and/or modified sequence opt4 from anti-influenza_Chain
  source 1..2058: mol_type = other RNA
atgaccaagagcatctacttcagcctgggcatccacaaccaccagcccgtgggcaacttcgacttcgtgatcgagagagcctacgagatgagctacaagcccctgatcaacttcttcttcaagcaccccgacttccccatcaacgtgcacttcagcggcttcctgctgctgtggctggagaagaaccaccccgagtacttcgagaagctgaagatcatggccgagagaggccagatcgagttcgtgagcggcggcttctacgagcccatcctgcccatcatccccgacaaggacaaggtgcagcagatcaagaagctgaacaagtacatctacgacaagttcggccagacccccaagggcatgtggctggccgagagagtgtgggagccccacctggtgaagtacatcgccgaggccggcatcgagtacgtggtggtggacgacgcccacttcttcagcgtgggcctgaaggaggaggacctgttcggctactacctgatggaggagcagggctacaagctggccgtgttccccatcagcatgaagctgagatacctgatccccttcgccgaccccgaggagaccatcacctacctggacaagttcgccagcgaggacaagagcaagatcgccctgctgttcgacgacggcgagaagttcggcctgtggcccgacacctacagaaccgtgtacgaggagggctggctggagaccttcgtgagcaagatcaaggagaacttcctgctggtgacccccgtgaacctgtacacctacatgcagagagtgaagcccaagggcagaatctacctgcccaccgccagctacagagagatgatggagtgggtgctgttccccgaggcccagaaggagctggaggagctggtggagaagctgaagaccgagaacctgtgggacaagttcagcccctacgtgaagggcggcttctggagaaacttcctggccaagtacgacgagagcaaccacatgcagaagaagatgctgtacgtgtggaagaaggtgcaggacagccccaacgaggaggtgaaggagaaggccatggaggaggtgttccagggccaggccaacgacgcctactggcacggcatcttcggcggcctgtacctgccccacctgagaaccgccatctacgagcacctgatcaaggccgagaactacctggagaacagcgagatcagattcaacatcttcgacttcgactgcgacggcaacgacgagatcatcgtggagagccccttcttcaacctgtacctgagccccaaccacggcggcagcgtgctggagtgggacttcaagaccaaggccttcaacctgaccaacgtgctgaccagaagaaaggaggcctaccacagcaagctgagctacgtgaccagcgaggcccagggcaagagcatccacgagagatggaccgccaaggaggagggcctggagaacatcctgttctacgacaaccacagaagagtgagcttcaccgagaagatcttcgagagcgagcccgtgctggaggacctgtggaaggacagcagcagactggaggtggacagcttctacgagaactacgactacgagatcaacaaggacgagaacaagatcagagtgctgttcagcggcgtgttcagaggcttcgagctgtgcaagagctacatcctgtacaaggacaagagcttcgtggacgtggtgtacgagatcaagaacgtgagcgagacccccatcagcctgaacttcggctgggagatcaacctgaacttcctggcccccaaccaccccgactactacttcctgatcggcgaccagaagtaccccctgagcagcttcggcatcgagaaggtgaacaactggaagatcttcagcggcatcggcatcgagctggagtgcgtgctggacgtggaggccagcctgtacagataccccatcgagaccgtgagcctgagcgaggagggcttcgagagagtgtaccagggcagcgccctgatccacttctacaaggtggacctgcccgtgggcagcacctggagaaccaccatcagattctgggtgaag

SEQ ID NO: 36089 - RNA, 2058 nt, synthetic construct; identical to SEQ ID NO: 36088
  misc_feature 1..2058: note = derived and/or modified sequence opt4 from anti-influenza_Chain
  source 1..2058: mol_type = other RNA

SEQ ID NO: 36090 - RNA, 2115 nt, synthetic construct
  misc_feature 1..2115: note = derived and/or modified sequence opt4 from anti-influenza_Chain
  source 1..2115: mol_type = other RNA
atgcccaccaacctgttcttcaacgcccaccacagccccgtgggcgccttcgccagcttcaccctgggcttccccggcaagagcggcggcctggacctggagctggccagaccccccagacagaacgtgctgatcggcgtggagagcctgcacgagagcggcctgtaccacgtgctgcccttcctggagaccgccgaggaggacgagagcaagagatacgacatcgagaaccccgaccccaacccccagaagcccaacatcctgatccccttcgccaaggaggagatccagagagagttccacgtggccaccgacacctggaaggccggcgacctgaccttcaccatctacagccccgtgaaggccgtgcccaaccccgagaccgccgacgaggaggagctgaagctggccctggtgcccgccgtgatcgtggagatgaccatcgacaacaccaacggcaccagagccagaagagccttcttcggcttcgagggcaccgacccctacaccagcatgagaagaatcgacgacacctgcccccagctgagaggcgtgggccagggcagaatcctgagcatcgtgagcaaggacgagggcgtgagaagcgccctgcacttcagcatggaggacatcctgaccgcccagctggaggagaactggaccttcggcctgggcaaggtgggcgccctgatcgtggacgtgcccgccggcgagaagaagacctaccagttcgccgtgtgcttctacagaggcggctacgtgaccgccggcatggacgccagctacttctacaccagattcttccagaacatcgaggaggtgggcctgtacgccctggagcaggccgaggtgctgaaggagcagagcttcagaagcaacaagctgatcgagaaggagtggctgagcgacgaccagaccttcatgatggcccacgccatcagaagctactacggcaacacccagctgctggagcacgagggcaagcccatctgggtggtgaacgagggcgagtacagaatgatgaacaccttcgacctgaccgtggaccagctgttcttcgagctgaagctgaacccctggaccgtgaagaacgtgctggacctgtacgtggagagatacagctacgaggacagagtgagattccccggcgaggagaccgagtaccccagcggcatcagcttcacccacgacatgggcgtggccaacaccttcagcagaccccactacagcagctacgagctgtacggcatcagcggctgcttcagccacatgacccacgagcagctggtgaactgggtgctgtgcgccgccgtgtacatcgagcagaccaaggactgggcctggagagacaagagactggccatcctggagcagtgcctggagagcatggtgagaagagaccaccccgaccccgagcagagaaacggcgtgatgggcctggacagcaccagaaccatgggcggcgccgagatcaccacctacgacagcctggacgtgagcctgggccaggccagaaacaacctgtacctggccggcaagtgctgggccgcctacgtggccctggagaagctgttcagagacgtgggcaaggaggagctggccgccctggccggcgagcaggccgagaagtgcgccgccaccatcgtgagccacgtgaccgacgacggctacatccccgccatcatgggcgagggcaacgacagcaagatcatccccgccatcgagggcctggtgttcccctacttcaccaactgccacgaggccctggacgagaacggcagattcggcgcctacatccaggccctgagaaaccacctgcagtacgtgctgagagagggcatctgcctgttccccgacggcggctggaagatcagcagcaccagcaacaacagctggctgagcaagatctacctgtgccagttcatcgccagacacatcctgggctgggagtgggacgagcagggcaagagagccgacgccgcccacgtggcctggctgacccaccccaccctgagcatctggagctggagcgaccagatcatcgccggcgagatcaccggcagcaagtactaccccagaggcgtgaccagcatcctgtggctggaggagggcgag

SEQ ID NO: 36091 - RNA, 2115 nt, synthetic construct; identical to SEQ ID NO: 36090
  misc_feature 1..2115: note = derived and/or modified sequence opt4 from anti-influenza_Chain
  source 1..2115: mol_type = other RNA

SEQ ID NO: 36092 - RNA, 2148 nt, synthetic construct
  misc_feature 1..2148: note = derived and/or modified sequence opt4 from anti-influenza_Chain
  source 1..2148: mol_type = other RNA
atggaggacttcgtgagacagtgcttcaaccccatgatcgtggagctggccgagaaggccatgaaggagtacggcgaggacctgaagatcgagaccaacaagttcgccgccatctgcacccacctggaggtgtgcttcatgtacagcgacttccacttcatcaacgagcagggcgagagcatcatcgtggagcccgaggaccccaacgccctgctgaagcacagattcgagatcatcgagggcagagacagaaccatggcctggaccgtggtgaacagcatctgcaacaccaccggcgccgagaagcccaagttcctgcccgacctgtacgactacaaggagaacagattcatcgagatcggcgtgaccagaagagaggtgcacatctactacctggagaaggccaacaagatcaagagcgagaagacccacatccacatcttcagcttcaccggcgaggagatggccaccaaggccgactacaccctggacgaggagagcagagccagaatcaagaccagactgttcaccatcagacaggagatggccagcagaggcctgtgggacagcttcagacagagcgagagaggcgaggagaccatcgaggagagattcgagatcaccggcaccatgagaagactggccgaccagagcctgccccccaacttcagctgcctggagaacttcagagcctacgtggacggcttcgagcccaacggctacatcgagggcaagctgagccagatgagcaaggaggtgaacgccagaatcgagcccttcctgagaaccacccccagacccatcagactgcccgacggccccccctgcttccagagaagcaagttcctgctgatggacagcctgaagctgagcatcgaggaccccagccacgagggcgagggcatccccctgtacgacgccatcaagtgcatgagaaccttcttcggctggaaggagcccagcgtggtgaagccccacggcaagggcatcaaccccaactacctgctgagctggaagcaggtgctggccgagctgcaggacatcgagagcgaggagaagatccccagaaccaagaacatgaagaagaccagccagctgaagtgggccctgggcgagaacatggcccccgagaaggtggacttcgacgactgcaaggacatcagcgacctgaagcagtacgacagcgacgagcccgagctgagaagcctgagcagctggatccagaacgagttcaacaaggcctgcgagctgaccgacagcatctggatcgagctggacgagatcggcgaggacgtggcccccatcgagcacatcgccagcatgagaagaaactacttcaccgccgaggtgagccactgcagagccaccgagtacatcatgaagggcgtgtacatcaacaccgccctgctgaacgccagctgcgccgccatggacgacttccagctgatccccatgatcagcaagtgcagaaccaaggagggcagaagaaagaccaacctgtacggcttcatcatcaagggcagaagccacctgagaaacgacaccgacgtggtgaacttcgtgagcatggagttcagcctgaccgaccccagactggagccccacaagtgggagaagtactgcgtgctggagatcggcgacatgctgctgagaagcgccatcggccaggtgagcagacccatgttcctgtacgtgagaaccaacggcaccagcaagatcaagatgaagtggggcatggagatgagaagatgcctgctgcagagcctgcagcagatcgagagcatgatcgaggccgagagcagcgtgaaggagaaggacatgaccaaggagttcttcgagaacagaagcgagacctggcccatcggcgagagccccaagggcgtggaggagggcagcatcggcaaggtgtgcagaaccctgctggccaagagcgtgttcaacagcctgtacgccagcccccagctggagggcttcagcgccgagagcagaaagctgctgctgatcgtgcaggccctgagagacaacctggagcccggcaccttcgacctgggcggcctgtacgaggccatcgaggagtgcctgatcaacgacccctgggtgctgctgaacgccagctggttcaacagcttcctgacccacgccctgaga

SEQ ID NO: 36093 - RNA, 2148 nt, synthetic construct; identical to SEQ ID NO: 36092
  misc_feature 1..2148: note = derived and/or modified sequence opt4 from anti-influenza_Chain
  source 1..2148: mol_type = other RNA

SEQ ID NO: 36094 - RNA, 2256 nt, synthetic construct
  misc_feature 1..2256: note = derived and/or modified sequence opt4 from anti-influenza_Chain
  source 1..2256: mol_type = other RNA
atgaacatcaacccctacttcctgttcatcgacgtgcccatccaggccgccatcagcaccaccttcccctacaccggcgtgcccccctacagccacggcaccggcaccggctacaccatcgacaccgtgatcagaacccacgagtacagcaacaagggcaagcagtacatcagcgacgtgaccggctgcgtgatggtggaccccaccaacggccccctgcccgaggacaacgagcccagcgcctacgcccagctggactgcgtgctggaggccctggacagaatggacgaggagcaccccggcctgttccaggccggcagccagaacgccatggaggccctgatggtgaccaccgtggacaagctgacccagggcagacagaccttcgactggaccgtgtgcagaaaccagcccgccgccaccgccctgaacaccaccatcaccagcttcagactgaacgacctgaacggcgccgacaagggcggcctggtgcccttctgccaggacatcatcgacagcctggacaagcccgagatgatcttcttcaccgtgaagaacatcaagaagaagctgcccgccaagaacagaaagggcttcctgatcaagagaatccccatgaaggtgaaggacagaatcaccagagtggagtacatcaagagagccctgagcctgaacaccatgaccaaggacgccgagagaggcaagctgaagagaagagccatcgccaccgccggcatccagatcagaggcttcgtgctggtggtggagaacctggccaagaacatctgcgagaacctggagcagagcggcctgcccgtgggcggcaacgagaagaaggccaagctgagcaacgccgtggccaagatgctgagcaactgcccccccggcggcatcagcatgaccgtgaccggcgacaacaccaagtggaacgagtgcctgaaccccagaatcttcctggccatgaccgagagaatcaccagagacagccccatctggttcagagacttctgcagcatcgcccccgtgctgttcagcaacaagatcgccagactgggcaagggcttcatgatcaccagcaagaccaagagactgaaggcccagatcccctgccccgacctgttcaacatccccctggagagatacaacgaggagaccagagccaagctgaagaagctgaagcccttcttcaacgaggagggcaccgccagcctgagccccggcatgatgatgggcatgttcaacatgctgagcaccgtgctgggcgtggccgccctgggcatcaagaacatcggcaacaaggagtacctgtgggacggcctgcagagcagcgacgacttcgccctgttcgtgaacgccaaggacgaggagacctgcatggagggcatcaacgacttctacagaacctgcaagctgctgggcatcaacatgagcaagaagaagagctactgcaacgagaccggcatgttcgagttcaccagcatgttctacagagacggcttcgtgagcaacttcgccatggagctgcccagcttcggcgtggccggcgtgaacgagagcgccgacatggccatcggcatgaccatcatcaagaacaacatgatcaacaacggcatgggccccgccaccgcccagaccgccatccagctgttcatcgccgactacagatacacctacaagtgccacagaggcgacagcaaggtggagggcaagagaatgaagatcatcaaggagctgtgggagaacaccaagggcagagacggcctgctggtggccgacggcggccccaacctgtacaacctgagaaacctgcacatccccgagatcatcctgaagtacaacatcatggaccccgagtacaagggcagactgctgcacccccagaaccccttcgtgggccacctgagcatcgagggcatcaaggaggccgacatcacccccgcccacggccccatcaagaagatggactacgacgccgtgagcggcacccacagctggagaaccaagagaaacagaagcatcctgaacaccgaccagagaaacatgatcctggaggagcagtgctacgccaagtgctgcaacctgttcgaggcctgcttcaacagcgccagctacagaaagcccgtgggccagcacagcatgctggaggccatggcccacagactgagaatggacgccagactggactacgagagcggcagaatgagcaaggaggacttcgagaaggccatggcccacctgggcgagatcggctacatg

SEQ ID NO: 36095 - RNA, 2256 nt, synthetic construct; identical to SEQ ID NO: 36094
  misc_feature 1..2256: note = derived and/or modified sequence opt4 from anti-influenza_Chain
  source 1..2256: mol_type = other RNA

SEQ ID NO: 36096 - RNA, 2265 nt, synthetic construct
  misc_feature 1..2265: note = derived and/or modified sequence opt4 from anti-influenza_Chain
  source 1..2265: mol_type = other RNA
atggccgtggacatcaagaagatcatcaagcagatgaccctggaggagaaggccggcctgtgcagcggcctggacttctggcacaccaagcccgtggagagactgggcatccccagcatcatgatgaccgacggcccccacggcctgagaaagcagagagaggacgccgagatcgccgacatcaacaacagcgtgcccgccacctgcttccccagcgccgccggcctggcctgcagctgggacagagagctggtggagagagtgggcgccgccctgggcgaggagtgccaggccgagaacgtgagcatcctgctgggccccggcgccaacatcaagagaagccccctgtgcggcagaaacttcgagtacttcagcgaggacccctacctgagcagcgagctggccgccagccacatcaagggcgtgcagagccagggcgtgggcgcctgcctgaagcacttcgccgccaacaaccaggagcacagaagaatgaccgtggacaccatcgtggacgagagaaccctgagagagatctacttcgccagcttcgagaacgccgtgaagaaggccagaccctgggtggtgatgtgcgcctacaacaagctgaacggcgagtactgcagcgagaacagatacctgctgaccgaggtgctgaagaacgagtggatgcacgacggcttcgtggtgagcgactggggcgccgtgaacgacagagtgagcggcctggacgccggcctggacctggagatgcccaccagccacggcatcaccgacaagaagatcgtggaggccgtgaagagcggcaagctgagcgagaacatcctgaacagagccgtggagagaatcctgaaggtgatcttcatggccctggagaacaagaaggagaacgcccagtacgacaaggacgcccaccacagactggccagacaggccgccgccgagagcatggtgctgctgaagaacgaggacgacgtgctgcccctgaagaagagcggcaccatcgccctgatcggcgccttcgtgaagaagcccagataccagggcagcggcagcagccacatcacccccaccagactggacgacatctacgaggagatcaagaaggccggcggcgacaaggtgaacctggtgtacagcgagggctacagactggagaacgacggcatcgacgaggagctgatcaacgaggccaagaaggccgccagcagcagcgacgtggccgtggtgttcgccggcctgcccgacgagtacgagagcgagggcttcgacagaacccacatgagcatccccgagaaccagaacagactgatcgaggccgtggccgaggtgcagagcaacatcgtggtggtgctgctgaacggcagccccgtggagatgccctggatcgacaaggtgaagagcgtgctggaggcctacctgggcggccaggccctgggcggcgccctggccgacgtgctgttcggcgaggtgaaccccagcggcaagctggccgagaccttccccgtgaagctgagccacaaccccagctacctgaacttccccggcgaggacgacagagtggagtacaaggagggcctgttcgtgggctacagatactacgacaccaagggcatcgagcccctgttccccttcggccacggcctgagctacaccaagttcgagtacagcgacatcagcgtggacaagaaggacgtgagcgacaacagcatcatcaacgtgagcgtgaaggtgaagaacgtgggcaagatggccggcaaggagatcgtgcagctgtacgtgaaggacgtgaagagcagcgtgagaagacccgagaaggagctgaagggcttcgagaaggtgttcctgaaccccggcgaggagaagaccgtgaccttcaccctggacaagagagccttcgcctactacaacacccagatcaaggactggcacgtggagagcggcgagttcctgatcctgatcggcagaagcagcagagacatcgtgctgaaggagagcgtgagagtgaacagcaccgtgaagatcagaaagagattcaccgtgaacagcgccgtggaggacgtgatgagcgacagcagcgccgccgccgtgctgggccccgtgctgaaggagatcaccgacgccctgcagatcgacatggacaacgcccacgacatgatggccgccaacatcaagaacatgcccctgagaagcctggtgggctacagccagggcagactgagcgaggagatgctggaggagctggtggacaagatcaacaacgtggag

SEQ ID NO: 36097 - RNA, 2265 nt, synthetic construct; identical to SEQ ID NO: 36096
  misc_feature 1..2265: note = derived and/or modified sequence opt4 from anti-influenza_Chain
  source 1..2265: mol_type = other RNA

SEQ ID NO: 36098 - RNA, 2277 nt, synthetic construct
  misc_feature 1..2277: note = derived and/or modified sequence opt4 from anti-influenza_Chain
  source 1..2277: mol_type = other RNA
atggagagaatcaaggagctgagaaacctgatgagccagagcagaaccagagagatcctgaccaagaccaccgtggaccacatggccatcatcaagaagtacaccagcggcagacaggagaagaaccccgccctgagaatgaagtggatgatggccatgaagtaccccatcaccgccgacaagagaatcaccgagatgatccccgagagaaacgagcagggccagaccctgtggagcaagatgaacgacgccggcagcgacagagtgatggtgagccccctggccgtgacctggtggaacagaaacggccccatgaccaacaccgtgcactaccccaagatctacaagacctacttcgagagagtggagagactgaagcacggcaccttcggccccgtgcacttcagaaaccaggtgaagatcagaagaagagtggacatcaaccccggccacgccgacctgagcgccaaggaggcccaggacgtgatcatggaggtggtgttccccaacgaggtgggcgccagaatcctgaccagcgagagccagctgaccatcaccaaggagaagaaggaggagctgcaggactgcaagatcagccccctgatggtggcctacatgctggagagagagctggtgagaaagaccagattcctgcccgtggccggcggcaccagcagcgtgtacatcgaggtgctgcacctgacccagggcacctgctgggagcagatgtacacccccggcggcgaggtgaagaacgacgacgtggaccagagcctgatcatcgccgccagaaacatcgtgagaagagccgccgtgagcgccgaccccctggccagcctgctggagatgtgccacagcacccagatcggcggcatcagaatggtggacatcctgaagcagaaccccaccgaggagcaggccgtgggcatctgcaaggccgccatgggcctgagaatcagcagcagcttcagcttcggcggcttcaccttcaagagaaccagcggcagcagcgtgaagagagaggaggaggtgctgaccggcaacctgcagaccctgaagatcagagtgcacgagggctacgaggagttcaccatggtgggcagaagagccaccgccatcctgagaaaggccaccagaagactgatccagctgatcgtgagcggcagagacgagcagagcatcgccgaggccatcatcgtggccatggtgttcagccaggaggactgcatgatcaaggccgtgagaggcgacctgaacttcgtgaacagagccaaccagagactgaaccccatgcaccagctgctgagacacttccagaaggacgccaaggtgctgttccagaactggggcgtggagcccatcgacaacgtgatgggcatgatcggcatcctgcccgacatgacccccagcatcgagatgagcatgagaggcgtgagaatcagcaagatgggcgtggacgagtacagcagcaccgagagagtggtggtgagcatcgacagattcctgagagtgagagaccagagaggcaacgtgctgctgagccccgaggaggtgagcgagacccagggcaccgagaagctgaccatcacctacagcagcagcatgatgtgggagatcaacggccccgagagcgtgctggtgaacacctaccagtggatcatcagaaactgggagaccgtgaagatccagtggagccagaaccccaccatgctgtacaacaagatggagttcgagcccttccagagcctggtgcccaaggccatcagaggccagtacagcggcttcgtgagaaccctgttccagcagatgagagacgtgctgggcaccttcgacaccgcccagatcatcaagctgctgcccttcgccgccgccccccccaagcagagcagaatgcagttcagcagcttcaccgtgaacgtgagaggcagcggcatgagaatcctggtgagaggcaacagccccgtgttcaactacaacaaggccaccaagagactgaccgtgctgggcaaggacgccggcaccctgaccgaggaccccgacgagggcaccgccggcgtggagagcgccgtgctgagaggcttcctgatcctgggcaaggaggacagaagatacggccccgccctgagcatcaacgagctgagcaacctggccaagggcgagaaggccaacgtgctgatcggccagggcgacgtggtgctggtgatgaagagaaagagagacagcagcatcctgaccgacagccagaccgccaccaagagaatcagaatggccatcaac

SEQ ID NO: 36099 - RNA, 2277 nt, synthetic construct; identical to SEQ ID NO: 36098
  misc_feature 1..2277: note = derived and/or modified sequence opt4 from anti-influenza_Chain
  source 1..2277: mol_type = other RNA

SEQ ID NO: 36100 - RNA, 2472 nt, synthetic construct
  misc_feature 1..2472: note = derived and/or modified sequence opt4 from anti-influenza_Chain
  source 1..2472: mol_type = other RNA
atgatgctgagaaagaagaccaagcagctgatcagcagcatcctgatcctggtgctgctgctgagcctgttccccgccgccctggccgccgagggcaacaccagagaggacaacttcaagcacctgctgggcaacgacaacgtgaagagacccagcgaggccggcgccctgcagctgcaggaggtggacggccagatgaccctggtggaccagcacggcgagaagatccagctgagaggcatgagcacccacggcctgcagtggttccccgagatcctgaacgacaacgcctacaaggccctgagcaacgactgggacagcaacatgatcagactggccatgtacgtgggcgagaacggctacgccaccaaccccgagctgatcaagcagagagtgatcgacggcatcgagctggccatcgagaacgacatgtacgtgatcgtggactggcacgtgcacgcccccggcgaccccagagaccccgtgtacgccggcgccaaggacttcttcagagagatcgccgccctgtaccccaacaacccccacatcatctacgagctggccaacgagcccagcagcaacaacaacggcggcgccggcatccccaacaacgaggagggctggaaggccgtgaaggagtacgccgaccccatcgtggagatgctgagaaagagcggcaacgccgacgacaacatcatcatcgtgggcagccccaactggagccagagacccgacctggccgccgacaaccccatcgacgaccaccacaccatgtacaccgtgcacttctacaccggcagccacgccgccagcaccgagagctaccccagcgagacccccaacagcgagagaggcaacgtgatgagcaacaccagatacgccctggagaacggcgtggccgtgttcgccaccgagtggggcaccagccaggccagcggcgacggcggcccctacttcgacgaggccgacgtgtggatcgagttcctgaacgagaacaacatcagctgggccaactggagcctgaccaacaagaacgaggtgagcggcgccttcacccccttcgagctgggcaagagcaacgccaccaacctggaccccggccccgaccacgtgtgggcccccgaggagctgagcctgagcggcgagtacgtgagagccagaatcaagggcgtgaactacgagcccatcgacagaaccaagtacaccaaggtgctgtgggacttcaacgacggcaccaagcagggcttcggcgtgaacagcgacagccccaacaaggagctgatcgccgtggacaacgagaacaacaccctgaaggtgagcggcctggacgtgagcaacgacgtgagcgacggcaacttctgggccaacgccagactgagcgccaacggctggggcaagagcgtggacatcctgggcgccgagaagctgaccatggacgtgatcgtggacgagcccaccaccgtggccatcgccgccatcccccagagcagcaagagcggctgggccaaccccgagagagccgtgagagtgaacgccgaggacttcgtgcagcagaccgacggcaagtacaaggccggcctgaccatcaccggcgaggacgcccccaacctgaagaacatcgccttccacgaggaggacaacaacatgaacaacatcatcctgttcgtgggcaccgacgccgccgacgtgatctacctggacaacatcaaggtgatcggcaccgaggtggagatccccgtggtgcacgaccccaagggcgaggccgtgctgcccagcgtgttcgaggacggcaccagacagggctgggactgggccggcgagagcggcgtgaagaccgccctgaccatcgaggaggccaacggcagcaacgccctgagctgggagttcggctaccccgaggtgaagcccagcgacaactgggccaccgcccccagactggacttctggaagagcgacctggtgagaggcgagaacgactacgtggccttcgacttctacctggaccccgtgagagccaccgagggcgccatgaacatcaacctggtgttccagccccccaccaacggctactgggtgcaggcccccaagacctacaccatcaacttcgacgagctggaggaggccaaccaggtgaacggcctgtaccactacgaggtgaagatcaacgtgagagacatcaccaacatccaggacgacaccctgctgagaaacatgatgatcatcttcgccgacgtggagagcgacttcgccggcagagtgttcgtggacaacgtgagattcgagggcgccgccaccaccgagcccgtggagcccgagcccgtggaccccggcgaggagaccccccccgtggacgagaaggaggccaagaaggagcagaaggaggccgagaaggaggagaaggaggccgtgaaggaggagaagaaggaggccaaggaggagaagaaggccgtgaagaacgaggccaagaagaag

SEQ ID NO: 36101 - RNA, 2472 nt, synthetic construct; identical to SEQ ID NO: 36100
  misc_feature 1..2472: note = derived and/or modified sequence opt4 from anti-influenza_Chain
  source 1..2472: mol_type = other RNA

SEQ ID NO: 36102 - RNA, 3063 nt, synthetic construct
  misc_feature 1..3063: note = derived and/or modified sequence opt4 from anti-influenza_Chain
  source 1..3063: mol_type = other RNA
atggccggcccccacagaagcagagccgccggccccccccccttcgccgtggacgagcacgtggccctggagatggtggccttcagaggcgaggtgttcgccggccacggcctgctggccgaccagagactgatcgcccacaccggcagacccgccctgaacgcccagagaatcacccagcagaagcagagagaccagtgcagaggccagagacacagacaccaccagggcggcagaaacctgagaaaggcccacagaaccttccacgagcaccagagcacccaggaccaggcccacgacgccccccacggccagcaggccaagaccggccacgagggcctgggccacgagcacgcccaggcccagcaccagcagggccagagcaacgtggtggacagacaggacggcgagcccgtggaggcccagcaccagaaggacggcgcccagagagccggcaacgcccccgccggcagagtggagctggagcagcagcccgtggaggcccagcaccagcagcaggagggcgacgtgagaatcggcaagagaagacagaacgccttcgccccccccgccctggaccacgtgcacggcggccccggcagactgcagagacacggcctggccgtggagagacacgtgcccgccgtgcagcagcaccagcagagagtgcagagaggcagacagcagatcgaccacgtgctgggccacggcctgcccggcagacagagactggccttcagagacggccccagaagacccgtgggcgtggccagccccgtgctgggccagagaccctgccccggccacagaatcgtgcagaacctgttcagacacggcatcgacccctgcagagtgggcagatgcagaagaagccccagcgagctgcacggcatgggctgcgccgacgtgagagccagaggccacggcagacacatgagaggccagagagacgagcaccccggcagaggcagaccctgcgccagaagaagacacgtggacgacgacagagacagaaccccccaggagaagctgtacgacgtggccagaggcctggacgagcccgccagaagagtgcacttcgacgacgaggccgacagaagcgtgttcagaggcctggcccagcccgcccccgacgagcccgagggcagaagaagagacagactggtgctgcagagacagagcgtgaaccacagaagaggcagactgagcagacacagacagcagcaccagccccagcagcagagaccccacggcaaccaggccttcctgggcaagtacgagaagagaagaagaaagcccaccgcctgcctgaagagcctgagaagattccccgacaaggacgcccccgtgctgtacttcgtgaaccagctggagaagaccaagagaagaatgaccctgctgctggtgtggctgatcttcaccggcgtggccggcgagatcagactggaggccgaggacggcgagctgctgggcgtggccgtggacagcaccctgaccggctacagcggcagaggctacgtgaccggcttcgacgcccccgaggacagcgtgagattcagcttcgaggcccccagaggcgtgtacagagtggtgttcggcgtgagcttcagcagcagattcgccagctacgccctgagagtggacgactggcaccagaccggcagcctgatcaagagaggcggcggcttcttcgaggccagcatcggcgagatctggctggacgagggcgcccacaccatggccttccagctgatgaacggcgccctggactacgtgagactggagcccgtgagctacggcccccccgccagaccccccgcccagctgagcgacagccaggccaccgccagcgcccaggccctgttcgccttcctgctgagcgagtacggcagacacatcctggccggccagcagcagaacccctacagaagagacttcgacgccatcaactacgtgagaaacgtgaccggcaaggagcccgccctggtgagcttcgacctgatcgactacagccccaccagagaggcccacggcgtggtgcactaccagacccccgaggactggatcgcctgggccggcagagacggcatcgtgagcctgatgtggcactggaacgcccccaccgacctgatcgaggaccccagccaggactgctactggtggtacggcttctacaccagatgcaccaccttcgacgtggccgccgccctggccgacaccagcagcgagagatacagactgctgctgagagacatcgacgtgatcgccgcccagctgcagaagttccagcaggccgacatccccgtgctgtggagacccctgcacgaggccgccggcggctggttctggtggggcgccaagggccccgagcccttcaagcagctgtggagactgctgtacgagagactggtgcaccaccacggcctgcacaacctgatctgggtgtacacccacgagcccggcgccgccgagtggtaccccggcgacgcctacgtggacatcgtgggcagagacgtgtacgccgacgaccccgacgccctgatgagaagcgactggaacgagctgcagaccctgttcggcggcagaaagctggtggccctgaccgagaccggcaccctgcccgacgtggaggtgatcaccgactacggcatctggtggagctggttcagcatctggaccgaccccttcctgagagacgtggaccccgacagactgaccagagtgtaccacagcgagagagtgctgaccagagacgagctgcccgactggagaagctacgtgctgcacgccaccaccgtgcagcccgccggcgacctggccctggccgtgtaccccaaccccggcgccggcagactgcacgtggaggtgggcctgcccgtggccgcccccgtggtggtggaggtgttcaacctgctgggccagagagtgttccagtaccaggccggcatgcagcccgccggcctgtggagaagagccttcgagctggccctggcccccggcgtgtacctggtgcaggtgagagccggcaacctggtggccagaagaagatgggtgagcgtgaga

SEQ ID NO: 36103 - RNA, 3063 nt, synthetic construct; identical to SEQ ID NO: 36102
  misc_feature 1..3063: note = derived and/or modified sequence opt4 from anti-influenza_Chain
  source 1..3063: mol_type = other RNA

SEQ ID NO: 36104 - RNA, 3165 nt, synthetic construct
  misc_feature 1..3165: note = derived and/or modified sequence opt4 from anti-influenza_Chain
  source 1..3165: mol_type = other RNA
atgagaaagaagagaagaggcttcctgaacgccagcaccgccgtgctggtgggcatcctggccggcttcctgggcgtggtgctggccgccaccggcgccctgggcttcgccgtgagagagagcctgctgctgaagcagttcctgttcctgagcttcgagggcaacaccgacggcgccagccccttcggcaaggacgtggtggtgaccgccagccaggacgtggccgccgacggcgagtacagcctgaaggtggagaacagaaccagcgtgtgggacggcgtggagatcgacctgaccggcaaggtgaacaccggcaccgactacctgctgagcttccacgtgtaccagaccagcgacagcccccagctgttcagcgtgctggccagaaccgaggacgagaagggcgagagatacaagatcctggccgacaaggtggtggtgcccaactactggaaggagatcctggtgcccttcagccccaccttcgagggcacccccgccaagttcagcctgatcatcaccagccccaagaagaccgacttcgtgttctacgtggacaacgtgcaggtgctgacccccaaggaggccggccccaaggtggtgtacgagaccagcttcgagaagggcatcggcgactggcagcccagaggcagcgacgtgaagatcagcatcagccccaaggtggcccacagcggcaagaagagcctgttcgtgagcaacagacagaagggctggcacggcgcccagatcagcctgaagggcatcctgaagaccggcaagacctacgccttcgaggcctgggtgtaccaggagagcggccaggaccagaccatcatcatgaccatgcagagaaagtacagcagcgacagcagcaccaagtacgagtggatcaaggccgccaccgtgcccagcggccagtgggtgcagctgagcggcacctacaccatccccgccggcgtgaccgtggaggacctgaccctgtacttcgagagccagaaccccaccctggagttctacgtggacgacgtgaaggtggtggacaccaccagcgccgagatcaagctggagatgaaccccgaggaggagatccccgccctgaaggacgtgctgaaggactacttcagagtgggcgtggccctgcccagcaaggtgttcatcaaccagaaggacatcgccctgatcagcaagcacagcaacagcagcaccgccgagaacgagatgaagcccgacagcctgctggccggcatcgagaacggcaagctgaagttcagattcgagaccgccgacaagtacatcgagttcgcccagcagaacggcatggtggtgagaggccacaccctggtgtggcacaaccagacccccgagtggttcttcaaggacgagaacggcaacctgctgagcaaggaggagatgaccgagagactgagagagtacatccacaccgtggtgggccacttcaagggcaaggtgtacgcctgggacgtggtgaacgaggccgtggaccccaaccagcccgacggcctgagaagaagcacctggtaccagatcatgggccccgactacatcgagctggccttcaagttcgccagagaggccgaccccaacgccaagctgttctacaacgactacaacaccttcgagcccaagaagagagacatcatctacaacctggtgaagagcctgaaggagaagggcctgatcgacggcatcggcatgcagtgccacatcagcctggccaccgacatcagacagatcgaggaggccatcaagaagttcagcaccatccccggcatcgagatccacatcaccgagctggacatcagcgtgtacagagacagcaccagcaactacagcgaggcccccagaaccgccctgatcgagcaggcccacaagatggcccagctgttcaagatcttcaagaagtacagcaacgtgatcaccaacgtgaccttctggggcctgaaggacgactacagctggagagccaccagaagaaacgactggcccctgatcttcgacaaggactaccaggccaagctggcctactgggccatcgtggcccccgaggtgctgccccccctgcccaaggagagcaagatcagcgagggcgaggccgtggtggtgggcatgatggacgacagctacatgatgagcaagcccatcgagatctacgacgaggagggcaacgtgaaggccaccatcagagccatctggaaggacagcaccatctacgtgtacggcgaggtgcaggacgccaccaagaagcccgccgaggacggcgtggccatcttcatcaaccccaacaacgagagaaccccctacctgcagcccgacgacacctacgtggtgctgtggaccaactggaagagcgaggtgaacagagaggacgtggaggtgaagaagttcgtgggccccggcttcagaagatacagcttcgagatgagcatcaccatccccggcgtggagttcaagaaggacagctacatcggcttcgacgtggccgtgatcgacgacggcaagtggtacagctggagcgacaccaccaacagccagaagaccaacaccatgaactacggcaccctgaagctggagggcgtgatggtggccaccgccaagtacggcacccccgtgatcgacggcgagatcgacgacatctggaacaccaccgaggagatcgagaccaagagcgtggccatgggcagcctggagaagaacgccaccgccaaggtgagagtgctgtgggacgaggagaacctgtacgtgctggccatcgtgaaggaccccgtgctgaacaaggacaacagcaacccctgggagcaggacagcgtggagatcttcatcgacgagaacaaccacaagaccggctactacgaggacgacgacgcccagttcagagtgaactacatgaacgagcagagcttcggcaccggcgccagcgccgccagattcaagaccgccgtgaagctgatcgagggcggctacatcgtggaggccgccatcaagtggaagaccatcaagcccagccccaacaccgtgatcggcttcaacgtgcaggtgaacgacgccaacgagaagggccagagagtgggcatcatcagctggagcgaccccaccaacaacagctggagagaccccagcaagttcggcaacctgagactgatcaag

SEQ ID NO: 36105 - RNA, 3165 nt, synthetic construct; identical to SEQ ID NO: 36104
  misc_feature 1..3165: note = derived and/or modified sequence opt4 from anti-influenza_Chain
  source 1..3165: mol_type = other RNA

SEQ ID NO: 36106 - RNA, 3177 nt, synthetic construct
  misc_feature 1..3177: note = derived and/or modified sequence opt4 from anti-influenza_Chain
  source 1..3177: mol_type = other RNA
atgcaggtgagaaagagaagaggcctgctggacgtgagcaccgccgtgctggtgggcatcctggccggcttcctgggcgtggtgctggccgccagcggcgtgctgagcttcggcaaggaggccagcagcaagggcgacagcagcctggagaccgtgctggccctgagcttcgagggcaccaccgagggcgtggtgcccttcggcaaggacgtggtgctgaccgccagccaggacgtggccgccgacggcgagtacagcctgaaggtggagaacagaaccagcccctgggacggcgtggagatcgacctgaccggcaaggtgaagagcggcgccgactacctgctgagcttccaggtgtaccagagcagcgacgccccccagctgttcaacgtggtggccagaaccgaggacgagaagggcgagagatacgacgtgatcctggacaaggtggtggtgagcgaccactggaaggagatcctggtgcccttcagccccaccttcgagggcacccccgccaagtacagcctgatcatcgtggccagcaagaacaccaacttcaacttctacctggacaaggtgcaggtgctggcccccaaggagagcggccccaaggtgatctacgagaccagcttcgagaacggcgtgggcgactggcagcccagaggcgacgtgaacatcgaggccagcagcgaggtggcccacagcggcaagagcagcctgttcatcagcaacagacagaagggctggcagggcgcccagatcaacctgaagggcatcctgaagaccggcaagacctacgccttcgaggcctgggtgtaccagaacagcggccaggaccagaccatcatcatgaccatgcagagaaagtacagcagcgacgccagcacccagtacgagtggatcaagagcgccaccgtgcccagcggccagtgggtgcagctgagcggcacctacaccatccccgccggcgtgaccgtggaggacctgaccctgtacttcgagagccagaaccccaccctggagttctacgtggacgacgtgaagatcgtggacaccaccagcgccgagatcaagatcgagatggagcccgagaaggagatccccgccctgaaggaggtgctgaaggactacttcaaggtgggcgtggccctgcccagcaaggtgttcctgaaccccaaggacatcgagctgatcaccaagcacttcaacagcatcaccgccgagaacgagatgaagcccgagagcctgctggccggcatcgagaacggcaagctgaagttcagattcgagaccgccgacaagtacatccagttcgtggaggagaacggcatggtgatcagaggccacaccctggtgtggcacaaccagacccccgactggttcttcaaggacgagaacggcaacctgctgagcaaggaggccatgaccgagagactgaaggagtacatccacaccgtggtgggccacttcaagggcaaggtgtacgcctgggacgtggtgaacgaggccgtggaccccaaccagcccgacggcctgagaagaagcacctggtaccagatcatgggccccgactacatcgagctggccttcaagttcgccagagaggccgaccccgacgccaagctgttctacaacgactacaacaccttcgagcccagaaagagagacatcatctacaacctggtgaaggacctgaaggagaagggcctgatcgacggcatcggcatgcagtgccacatcagcctggccaccgacatcaagcagatcgaggaggccatcaagaagttcagcaccatccccggcatcgagatccacatcaccgagctggacatgagcgtgtacagagacagcagcagcaactaccccgaggcccccagaaccgccctgatcgagcaggcccacaagatgatgcagctgttcgagatcttcaagaagtacagcaacgtgatcaccaacgtgaccttctggggcctgaaggacgactacagctggagagccaccagaagaaacgactggcccctgatcttcgacaaggaccaccaggccaagctggcctactgggccatcgtggcccccgaggtgctgccccccctgcccaaggagagcagaatcagcgagggcgaggccgtggtggtgggcatgatggacgacagctacctgatgagcaagcccatcgagatcctggacgaggagggcaacgtgaaggccaccatcagagccgtgtggaaggacagcaccatctacatctacggcgaggtgcaggacaagaccaagaagcccgccgaggacggcgtggccatcttcatcaaccccaacaacgagagaaccccctacctgcagcccgacgacacctacgccgtgctgtggaccaactggaagaccgaggtgaacagagaggacgtgcaggtgaagaagttcgtgggccccggcttcagaagatacagcttcgagatgagcatcaccatccccggcgtggagttcaagaaggacagctacatcggcttcgacgccgccgtgatcgacgacggcaagtggtacagctggagcgacaccaccaacagccagaagaccaacaccatgaactacggcaccctgaagctggagggcatcatggtggccaccgccaagtacggcacccccgtgatcgacggcgagatcgacgagatctggaacaccaccgaggagatcgagaccaaggccgtggccatgggcagcctggacaagaacgccaccgccaaggtgagagtgctgtgggacgagaactacctgtacgtgctggccatcgtgaaggaccccgtgctgaacaaggacaacagcaacccctgggagcaggacagcgtggagatcttcatcgacgagaacaaccacaagaccggctactacgaggacgacgacgcccagttcagagtgaactacatgaacgagcagaccttcggcaccggcggcagccccgccagattcaagaccgccgtgaagctgatcgagggcggctacatcgtggaggccgccatcaagtggaagaccatcaagcccacccccaacaccgtgatcggcttcaacatccaggtgaacgacgccaacgagaagggccagagagtgggcatcatcagctggagcgaccccaccaacaacagctggagagaccccagcaagttcggcaacctgagactgatcaag

SEQ ID NO: 36107 - RNA, 3177 nt, synthetic construct; identical to SEQ ID NO: 36106
  misc_feature 1..3177: note = derived and/or modified sequence opt4 from anti-influenza_Chain
  source 1..3177: mol_type = other RNA

SEQ ID NO: 36108 - RNA, 318 nt, synthetic construct
  misc_feature 1..318: note = derived and/or modified sequence opt4 from anti-OX40_LightChain
  source 1..318: mol_type = other RNA
gagatcgtggtgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccaccttcggccagggcaccaaggtggagatcaag

SEQ ID NO: 36109 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccagggcatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctacccccccaccttcggcggcggcaccaaggtggagatcaag

SEQ ID NO: 36110 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccagcagggccacaccctgccccccaccttcggccagggcaccaaggtggagatcaag

SEQ ID NO: 36111 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaagaccgtgaagctgctgatctactacaccagcagactgagaagcggcgtgcccagcagattcagcggcagcggcagcggcaccgacttcaccctgaccatcagcagcctgcagcccgaggacttcgccacctactactgccagcagggccacaccctgccccccaccttcggccagggcaccaaggtggagatcaag

SEQ ID NO: 36112 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaagaccgtgaagctgctgatctactacaccagcagactgagaagcggcgtgcccagcagattcagcggcagcggcagcggcaaggactacaccctgaccatcagcagcctgcagcccgaggacttcgccacctacttctgccagcagggccacaccctgccccccaccttcggccagggcaccaaggtggagatcaag

SEQ ID NO: 36113 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccagcagggccacaccctgcccgccaccttcggccagggcaccaaggtggagatcaag

SEQ ID NO: 36114 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccagcagggccacaccgccccccccaccttcggccagggcaccaaggtggagatcaag

SEQ ID NO: 36115 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccagcagggcgccaccctgccccccaccttcggccagggcaccaaggtggagatcaag

SEQ ID NO: 36116 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccagcagggccacgccctgccccccaccttcggccagggcaccaaggtggagatcaag

SEQ ID NO: 36117 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccagcaggcccacaccctgccccccaccttcggccagggcaccaaggtggagatcaag

SEQ ID NO: 36118 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccagcagggccacaccctggcccccaccttcggccagggcaccaaggtggagatcaag

SEQ ID NO: 36119 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcagactgagaagcggcgtgcccagcagattcagcggcagcggcagcggcaccgacttcaccctgaccatcagcagcctgcagcccgaggacttcgccacctactactgccaggccggccacaccctgccccccaccttcggccagggcaccaaggtggagatcaag

SEQ ID NO: 36120 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggcccccaagctgctgatctactacaccagcaagctgcacagcggcgtgcccagcagattcagcggcagcggcagcggcaccgactacaccctgaccatcagcagcctgcagcccgaggacttcgccacctactactgccagcagggcagcgccctgccctggaccttcggccagggcaccaaggtggagatcaag

SEQ ID NO: 36121 - RNA, 321 nt, synthetic construct
  misc_feature 1..321: note = derived and/or modified sequence opt4 from anti-OX40_LightChain
  source 1..321: mol_type = other RNA
gacatccagatgacccagagccccagcagcctgagcgccagcgtgggcgacagagtgaccatcacctgcagagccagccaggacatcagcaactacctgaactggtaccagcagaagcccggcaaggccgtgaagctgctgatctactacaccagcaagctgcacagcggcgtgcccagcagattcagcggcagcggcagcagaaccgactacaccctgaccatcagcagcctgcagcccgaggacttcgccacctactactgccagcagggcagcgccctgccctggaccttcggccagggcaccaaggtggagatcaag

SEQ ID NO: 36122 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacagcagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36123 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacagcagctacaaccagaagttcagagagagagtgaccatcaccgtggacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36124 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacagcagctacaaccagaagttcagagagagagtgaccctgaccgtggacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36125 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacgcctacatgagctgggtgagacaggcccccggccagggcctggagtggatcggcgacatgtaccccgacaacggcgacagcagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36126 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgagagctacatgagctgggtgagacaggcccccggccagggcctggagtggatcggcgacatgtaccccgacaacggcgacagcagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36127 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacgccgacagcagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36128 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacgccgacgccagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36129 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacgccagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36130 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacagcggcgacagcagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36131 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcagcagcagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36132 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacgcctacatgagctgggtgagacaggcccccggccagggcctggagtggatcggcgacatgtaccccgacaacgccgacgccagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgtgtggggccagggcaccctggtgaccgtgagcagc

SEQ ID NO: 36133 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacagcagctacaaccagaagttcagagagagagtgaccatcaccagagacaccagcaccagcaccgcctacctggagctgagcagcctgagaagcgaggacaccgccgtgtactactgcgtgctggcccccagatggtacttcagcgcctggggccagggcaccctggtgaccgtgagcagc

SEQ ID NO: 36134 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacagcagctacaaccagaagttcagagagagagtgaccatcaccagagacaccagcaccagcaccgcctacctggagctgagcagcctgagaagcgaggacaccgccgtgtactactgcgtgctggcccccagatggtacttcgccgtgtggggccagggcaccctggtgaccgtgagcagc

SEQ ID NO: 36135 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacagcagctacaaccagaagttcagagagagagtgaccatcaccagagacaccagcaccagcaccgcctacctggagctgagcagcctgagaagcgaggacaccgccgtgtactactgcgccctggcccccagatggtacttcagcgtgtggggccagggcaccctggtgaccgtgagcagc

SEQ ID NO: 36136 - RNA, 351 nt, synthetic construct
  misc_feature 1..351: note = derived and/or modified sequence opt4 from anti-OX40_HeavyChain
  source 1..351: mol_type = other RNA
gaggtgcagctggtgcagagcggcgccgaggtgaagaagcccggcgccagcgtgaaggtgagctgcaaggccagcggctacaccttcaccgacagctacatgagctgggtgagacaggcccccggccagggcctggagtggatcggcgacatgtaccccgacaacggcgacagcagctacaaccagaagttcagagagagagtgaccatcaccagagacaccagcaccagcaccgcctacctggagctgagcagcctgagaagcgaggacaccgccgtgtactactgcgtggccgcccccagatggtacttcagcgtgtggggccagggcaccctggtgaccgtgagcagc

SEQ ID NO: 36137 - RNA, 354 nt, synthetic construct
  misc_feature 1..354: note = derived and/or modified sequence opt4 from anti-OX40_HeavyChain
  source 1..354: mol_type = other RNA
gaggtgcagctggtggagagcggcggcggcctggtgcagcccggcggcagcctgagactgagctgcgccgccagcggcttcaccttcagcagctacagcatgaactgggtgagacaggcccccggcaagggcctggagtgggtgagctacatcagcagcagcagcagcaccatcgactacgccgacagcgtgaagggcagattcaccatcagcagagacaacgccaagaacagcctgtacctgcagatgaacagcctgagagacgaggacaccgccgtgtactactgcgccagagagagcggctggtacctgttcgactactggggccagggcaccctggtgaccgtgagcagc

SEQ ID NO: 36138 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagacagcaccccggcaagggcctggagtggatcggctacatcagctacaacggcatcacctaccacaaccccagcctgaagagcagaatcaccatcaaccccgacaccagcaagaaccagttcagcctgcagctgaacagcgtgacccccgaggacaccgccgtgtactactgcgccagatacagatacgactacgacggcggccacgccatggactactggggccagggcaccctggtgaccgtgagcagc

SEQ ID NO: 36139 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtggatcggctacatcagctacaacggcatcacctaccacaaccccagcctgaagagcagaatcaccatcaacagagacaccagcaagaaccagttcagcctgcagctgaacagcgtgacccccgaggacaccgccgtgtactactgcgccagatacagatacgactacgacggcggccacgccatggactactggggccagggcaccctggtgaccgtgagcagc

SEQ ID NO: 36140 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcgacagcttcagcagcggctactggaactggatcagaaagcaccccggcaagggcctggagtacatgggctacatcagctacaacggcatcacctaccacaaccccagcctgaagagcagaatcaccatcaacagagacaccagcaagaaccagtacagcctgcagctgaacagcgtgacccccgaggacaccgccgtgtacttctgcgccagatacagatacgactacgacggcggccacgccatggactactggggccagggcaccctggtgaccgtgagcagc

SEQ ID NO: 36141 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcgacagcttcagcagcggctactggaactggatcagaaagcaccccggcaagggcctggagtacatcggctacatcagctacaacggcatcacctaccacaaccccagcctgaagagcagaatcaccatcaacagagacaccagcaagaaccagtacagcctgcagctgaacagcgtgacccccgaggacaccgccgtgtacttctgcgccagatacagatacgactacgacggcggccacgccatggactactggggccagggcaccctggtgaccgtgagcagc

SEQ ID NO: 36142 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcgacagcttcagcagcggctactggaactggatcagaaagcaccccggcaagggcctggagtacatcggctacatcagctacaacggcatcacctaccacaaccccagcctgaagagcagaatcaccatcaacagagacaccagcaagaaccagttcagcctgcagctgaacagcgtgacccccgaggacaccgccgtgtacttctgcgccagatacagatacgactacgacggcggccacgccatggactactggggccagggcaccctggtgaccgtgagcagc

SEQ ID NO: 36143 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcgacagcttcagcagcggctactggaactggatcagaaagcaccccggcaagggcctggagtacatcggctacatcagctacaacggcatcacctaccacaaccccagcctgaagagcagaatcaccatcaacagagacaccagcaagaaccagtacagcctgcagctgaacagcgtgacccccgaggacaccgccgtgtactactgcgccagatacagatacgactacgacggcggccacgccatggactactggggccagggcaccctggtgaccgtgagcagc

SEQ ID NO: 36144 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcgacagcttcagcagcggctactggaactggatcagaaagcaccccggcaagggcctggagtacatcggctacatcagctacaacggcatcacctaccacaaccccagcctgaagagcagaatcaccatcaacagagacaccagcaagaaccagttcagcctgcagctgaacagcgtgacccccgaggacaccgccgtgtactactgcgccagatacagatacgactacgacggcggccacgccatggactactggggccagggcaccctggtgaccgtgagcagc

SEQ ID NO: 36145 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacggcatcacctaccacaaccccagcctgaagagcagaatcaccatcaaccccgacaccagcaagaaccagtacagcctgcagctgaacagcgtgacccccgaggacaccgccgtgtacttctgcgccagatacagatacgactacgacggcggccacgccatggactactggggccagggcaccctggtgaccgtgagcagc

SEQ ID NO: 36146 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacggcatcacctaccacaaccccagcctgaagagcagaatcaccatcaacagagacaccagcaagaaccagtacagcctgcagctgaacagcgtgacccccgaggacaccgccgtgtacttctgcgccagatacagatacgactacgacggcggccacgccatggactactggggccagggcaccctggtgaccgtgagcagc

SEQ ID NO: 36147 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacggcatcacctaccacaaccccagcctgaagagcagaatcaccatcaacagagacaccagcaagaaccagtacagcctgcagctgaacagcgtgacccccgaggacaccgccgtgtactactgcgccagatacagatacgactacgacggcggccacgccatggactactggggccagggcaccctggtgaccgtgagcagc

SEQ ID NO: 36148 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacggcatcacctaccacaaccccagcctgaagagcagaatcaccatcaaccccgacaccagcaagaaccagtacagcctgcagctgaacagcgtgacccccgaggacaccgccgtgtactactgcgccagatacagatacgactacgacggcggccacgccatggactactggggccagggcaccctggtgaccgtgagcagc

SEQ ID NO: 36149 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacgccatcacctaccacaaccccagcctgaagagcagaatcaccatcaacagagacaccagcaagaaccagtacagcctgcagctgaacagcgtgacccccgaggacaccgccgtgtactactgcgccagatacaagtacgactacgacgccggccacgccatggactactggggccagggcaccctggtgaccgtgagcagc

SEQ ID NO: 36150 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacgccatcacctaccacaaccccagcctgaagagcagaatcaccatcaacagagacaccagcaagaaccagtacagcctgcagctgaacagcgtgacccccgaggacaccgccgtgtactactgcgccagatacagatacgactacgacggcggccacgccatggactactggggccagggcaccctggtgaccgtgagcagc

SEQ ID NO: 36151 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacggcatcacctaccacaaccccagcctgaagagcagaatcaccatcaacagagacaccagcaagaaccagtacagcctgcagctgaacagcgtgacccccgaggacaccgccgtgtactactgcgccagatacaagtacgactacgacggcggccacgccatggactactggggccagggcaccctggtgaccgtgagcagc

SEQ ID NO: 36152 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacagcggcatcacctaccacaaccccagcctgaagagcagaatcaccatcaacagagacaccagcaagaaccagtacagcctgcagctgaacagcgtgacccccgaggacaccgccgtgtactactgcgccagatacagatacgactacgacggcggccacgccatggactactggggccagggcaccctggtgaccgtgagcagc

SEQ ID NO: 36153 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacagcggcatcacctaccacaaccccagcctgaagagcagaatcaccatcaacagagacaccagcaagaaccagtacagcctgcagctgaacagcgtgacccccgaggacaccgccgtgtactactgcgccagatacaagtacgactacgacggcggccacgccatggactactggggccagggcaccctggtgaccgtgagcagc

SEQ ID NO: 36154 - RNA, 363 nt, synthetic construct
  misc_feature 1..363: note = derived and/or modified sequence opt4 from anti-OX40_HeavyChain
  source 1..363: mol_type = other RNA
gaggtgcagctgcaggagagcggccccagcctggtgaagcccagccagaccctgagcctgacctgcagcgtgaccggcgacagcttcaccagcggctactggaactggatcagaaagttccccggcaacagactggagtacatgggctacatcagctacaacgccatcacctaccacaaccccagcctgaagagcagaatcagcatcaccagagacaccagcaagaaccactactacctgcagctgaacagcgtgaccaccgaggacaccgccacctacttctgcgccagatacagatacgactacgacggcggccacgccatggactactggggccagggcaccctggtgaccgtgagcagc

SEQ ID NO: 36155 - RNA, 363 nt, synthetic construct
  misc_feature 1..363: note = derived and/or modified sequence opt4 from anti-OX40_HeavyChain
  source 1..363: mol_type = other RNA
caggtgcagctgcaggagagcggccccggcctggtgaagcccagccagaccctgagcctgacctgcgccgtgtacggcggcagcttcagcagcggctactggaactggatcagaaagcaccccggcaagggcctggagtacatcggctacatcagctacaacgccatcacctaccacaaccccagcctgaagagcagaatcaccatcaacagagacaccagcaagaaccagtacagcctgcagctgaacagcgtgacccccgaggacaccgccgtgtactactgcgccagatacaagtacgactacgacggcggccacgccatggactactggggccagggcaccctggtgaccgtgagcagc

SEQ ID NO: 36156 - RNA, 372 nt, synthetic construct
  misc_feature 1..372: note = derived and/or modified sequence opt4 from anti-OX40_HeavyChain
  source 1..372: mol_type = other RNA
gaggtgcagctggtggagagcggcggcggcctggtgcagcccggcagaagcctgagactgagctgcgccgccagcggcttcaccttcgacgactacgccatgcactgggtgagacaggcccccggcaagggcctggagtgggtgagcggcatcagctggaacagcggcagcatcggctacgccgacagcgtgaagggcagattcaccatcagcagagacaacgccaagaacagcctgtacctgcagatgaacagcctgagagccgaggacaccgccctgtactactgcgccaaggaccagagcaccgccgactactacttctactacggcatggacgtgtggggccagggcaccaccgtgaccgtgagcagc

SEQ ID NO: 36157 - RNA, 381 nt, synthetic construct
  misc_feature 1..381: note = derived and/or modified sequence opt4 from anti-OX40_LightChain
  source 1..381: mol_type = other RNA
atggagacccccgcccagctgctgttcctgctgctgctgtggctgcccgacaccaccggcgagatcgtgctgacccagagccccggcaccctgagcctgagccccggcgagagagccatcctgagctgcagagccagccagagcgtgagcagcagcttcctggcctggtaccagcagaagcccggccaggcccccagactgctgatctacggcgccttcagcagagccaccggcatccccgacagattcagcggcagcggcagcggcaccgacttcaccctgaccatcagcagactggagcccgaggacttcgccgtgtactactgccagcagtacgacagcagcagaaccttcggccagggcaccaaggtggagatcaag

SEQ ID NO: 36158 - RNA, 381 nt, synthetic construct
  misc_feature 1..381: note = derived and/or modified sequence opt4 from anti-OX40_LightChain
  source 1..381: mol_type = other RNA
atggaggcccccgcccagctgctgttcctgctgctgctgtggctgcccgacaccaccggcgagatcgtgctgacccagagccccgccaccctgagcctgagccccggcgagagagccaccctgagctgcagagccagccagggcgtgagcagctacctggcctggtaccagcagaagcccggccaggcccccagactgctgatctacgacgccagcaacagagccaccggcatccccgccagattcagcggcagcggccccggcaccgacttcaccctgaccatcagcagcctggagcccgaggacttcgccgtgtactactgccagcagagaagcaactggcaccccaccttcggccagggcaccaaggtggagatcaag

SEQ ID NO: 36159 - RNA, 381 nt, synthetic construct
  misc_feature 1..381: note = derived and/or modified sequence opt4 from anti-OX40_LightChain
  source 1..381: mol_type = other RNA
atggaggcccccgcccagctgctgttcctgctgctgctgtggctgcccgacaccaccggcgagatcgtgctgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccatcaccttcggccagggcaccagactggagatcaag

SEQ ID NO: 36160 - RNA, 387 nt, synthetic construct
  misc_feature 1..387: note = derived and/or modified sequence opt4 from anti-OX40_LightChain
  source 1..387: mol_type = other RNA
atggagacccccgcccagctgctgttcctgctgctgctgtggctgcccgacaccaccggcgagatcgtgctgacccagagccccggcaccctgagcctgagccccggcgagagagccaccctgagctgcagagccagccagagcgtgagcagcagctacctggcctggtaccagcagaagcccggccaggcccccagactgctgatctacggcgccagcagcagagccaccggcatccccgacagattcagcggcagcggcagcggcaccgacttcaccctgaccatcagcagactggagcccgaggacttcgccgtgtactactgccagcagtacgacagcagcctgaccttcggcggcggcaccaaggtggagatcaagagaacc

SEQ ID NO: 36161 - RNA, 390 nt, synthetic construct
  misc_feature 1..390: note = derived and/or modified sequence opt4 from anti-OX40_LightChain
  source 1..390: mol_type = other RNA
atggacatgagagtgctggcccagctgctgggcctgctgctgctgtgcttccccggcgccagatgcgacatccagatgacccagagccccagcagcctgagcgccagcgtgggcaacagagtgaccatcacctgcagagccagccaggacatcagcagctggctggcctggtaccagcagaagcccgagaaggcccccaagagcctgatctacgccgccagcagcctgcagagcggcgtgcccagcagattcagcggcagcggcagcggcaccgacttcaccctgaccatcagcagcctgcagcccgaggacttcgccacctactactgccagcagtacaacagctaccccctgaccttcggccagggcaccagactggagatcaagaga

SEQ ID NO: 36162 - RNA, 408 nt, synthetic construct
  misc_feature 1..408: note = derived and/or modified sequence opt4 from anti-OX40_HeavyChain
  source 1..408: mol_type = other RNA
atggacaccctgtgcagcaccctgctgctgctgaccatccccagctgggtgctgagccagatcaccctgaaggagagcggccccaccctggtgaagcccacccagaccctgaccctgagctgcaccttcagcggcttcagcctgagcaccagcggcgtgggcgtgggctggatcagacagccccccggcaaggccctggagtggctggccctgatccactgggacgacgccgagagatacagccccagcctgaagagcagactgaccatcaccaaggacaccagcaagaaccaggtggtgctgaccatgaccaacatggacctggtggacaccgccacctactactgcgcccacaccagaggcgccttcgacatctggggccagggcaccatggtgaccgtgagcagc

SEQ ID NO: 36163 - RNA, 408 nt, synthetic construct
  misc_feature 1..408: note = derived and/or modified sequence opt4 from anti-OX40_HeavyChain
  source 1..408: mol_type = other RNA
atggacaccctgtgcagcaccctgctgctgctgaccatccccagctgggtgctgagccagatcaccctgaaggagagcggccccaccctggtgaagcccacccagaccctgaccctgacctgcaccttcagcggcttcagcctgagcaccagcggcgtgggcgtgggctggatcagacagccccccggcaaggccctggagtggctggccctgatctactgggacgaccacagcccctacagccccagcctgaagagcagactgaccatcaccaaggacaccagcaagaaccaggtggtgctgaccatgaccaacatggaccccgtggacaccgccacctactactgcgccagaaccagaggcgccttcgacatctggggccagggcaccatggtgaccgtgagcagc

SEQ ID NO: 36164 - RNA, 420 nt, synthetic construct
  misc_feature 1..420: note = derived and/or modified sequence opt4 from anti-OX40_HeavyChain
  source 1..420: mol_type = other RNA
atggagtggggcccctgctgggtgttcctggtggtgatcctggagggcgtgcagtgcggcgtgcagctggtggagagcggcggcggcctggtgcagcccggcggcagcctgagactgagctgcgccgccagcggcttcaccttcagcagctacagcatgaactgggtgagacaggcccccggcaagggcctggagtgggtgagctacatcagcagcagcagcagcaccatctactacgccgacagcgtgaagggcagattcaccatcagcagagacaacgccaagaacagcctgtacctgcagatgaacagcctgagagacgaggacaccgccgtgtactactgcgccagaggcgtgtaccacaacggctggagcttcttcgactactggggccagggcaccctgctgaccgtgagcagc

SEQ ID NO: 36165 - RNA, 423 nt, synthetic construct
  misc_feature 1..423: note = derived and/or modified sequence opt4 from anti-OX40_HeavyChain
  source 1..423: mol_type = other RNA
atggacaccctgtgcagcaccctgctgctgctgaccatccccagctgggtgctgagccagatcaccctgaaggagagcggccccaccctggtgaagcccaagcagaccctgaccctgacctgcaccttcagcggcttcagcctgagcaccagcggcatgggcgtgggctggatcagacagccccccggcaaggccctggagtggctggccgtgatctactgggacgaccaccagctgtacagccccagcctgaagagcagactgaccatcaccaaggacaccagcaagaaccaggtggtgctgaccatgaccaacatggaccccgtggacaccgccacctactactgcgcccacagaagaggcgccttccagcactggggccagggcaccctggtgaccgtgagcagcgccagcaccaagggc

SEQ ID NO: 36166 - RNA, 462 nt, synthetic construct
  misc_feature 1..462: note = derived and/or modified sequence opt4 from anti-OX40_HeavyChain
  source 1..462: mol_type = other RNA
atgaccatgatcacccccagcctggtgcccagcagcgaccccctggtgaccgccgccagcgtgctggagttcgccctgctgatcagactgaccatcggccaggccgtggtgagcacccagagcaccggcggcggcctggtgcagcccggcagaagcctgagactgagctgcgccgccagcggcttcaccctggacgactacggcatgcactgggtgagacaggcccccggcaagggcctggagtgggtgagcggcatcagctggaacagcgacagcatcggctacgtggacagcgtgaagggcagattcaccatcagcagagacaacgccaagaacagcctgtacctgcagatgaacagcctgagagtggaggacaccgccctgtactactgcgtgaaggacatcagcggctggtacagcttcgactactggggccagggcaccctggtgaccgtgagcagc

SEQ ID NO: 36167 - RNA, 639 nt, synthetic construct
  misc_feature 1..639: note = derived and/or modified sequence opt4 from anti-OX40_LightChain
  source 1..639: mol_type = other RNA
gagatcgtggtgacccagagccccgccaccctgagcctgagccccggcgagagagccaccctgagctgcagagccagccagagcgtgagcagctacctggcctggtaccagcagaagcccggccaggcccccagactgctgatctacgacgccagcaacagagccaccggcatccccgccagattcagcggcagcggcagcggcaccgacttcaccctgaccatcagcagcctggagcccgaggacttcgccgtgtactactgccagcagagaagcaactggcccaccttcggccagggcaccaaggtggagatcaagagaaccgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacagaggcgagtgc

SEQ ID NO: 36168 - RNA, 1350 nt, synthetic construct
  misc_feature 1..1350: note = derived and/or modified sequence opt4 from anti-OX40_HeavyChain
  source 1..1350: mol_type = other RNA
gaggtgcagctggtggagagcggcggcggcctggtgcagcccggcagaagcctgagactgagctgcgccgccagcggcttcaccttcgacgactacgccatgcactgggtgagacaggcccccggcaagggcctggagtgggtgagcggcatcagctggaacagcggcagcatcggctacgccgacagcgtgaagggcagattcaccatcagcagagacaacgccaagaacagcctgtacctgcagatgaacagcctgagagccgaggacaccgccctgtactactgcgccaaggaccagagcaccgccgactactacttctactacggcatggacgtgtggggccagggcaccaccgtgaccgtgagcagcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtggagagaaagtgctgcgtggagtgccccccctgccccgccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaagggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggcaag

SEQ ID NO: 36169 - RNA, 21 nt, synthetic construct
  misc_feature 1..21: note = derived and/or modified sequence opt4 from anti-HIV_VRC01_VRC02_NIH45-46_LightChain_CDR
  source 1..21: mol_type = other RNA
tgccagcagtacgagttcttc

SEQ ID NO: 36170 - RNA, 42 nt, synthetic construct
  misc_feature 1..42: note = derived and/or modified sequence opt4 from anti-HIV_VRC01_HeavyChain_CDR
  source 1..42: mol_type = other RNA
accagaggcaagaactgcgactacaactgggacttcgagcac

SEQ ID NO: 36171 - RNA, 21 nt, synthetic construct
  misc_feature 1..21: note = derived and/or modified sequence opt4 from anti-HIV_3BNC60_LightChain_CDR
  source 1..21: mol_type = other RNA
tgccaggtgtacgagttcatc

SEQ ID NO: 36172 - RNA, 36 nt, synthetic construct
  misc_feature 1..36: note = derived and/or modified sequence opt4 from anti-HIV_3BNC60_HeavyChain_CDR
  source 1..36: mol_type = other RNA
gccagacagagaagcgacttctgggacttcgacgtg

SEQ ID NO: 36173 - RNA, 36 nt, synthetic construct
  misc_feature 1..36: note = derived and/or modified sequence opt4 from anti-HIV_5H/I1-BMV-D5_HeavyChain_CDR
  source 1..36: mol_type = other RNA
gccagagacaaccccaccctgctgggcagcgactac

SEQ ID NO: 36174 - RNA, 33 nt, synthetic construct; identical to SEQ ID NO: 13248
  misc_feature 1..33: note = derived and/or modified sequence opt4 from anti-HIV_8ANC195_LightChain_CDR
  source 1..33: mol_type = other RNA

SEQ ID NO: 36175 - RNA, 33 nt, synthetic construct
  misc_feature 1..33: note = derived and/or modified sequence opt4 from anti-HIV_CH01_CH02_CH03_LightChain_CDR
  source 1..33: mol_type = other RNA
tgccagcagtacggcggcagcccctacaccttc

SEQ ID NO: 36176 - RNA, 78 nt, synthetic construct
  misc_feature 1..78: note = derived and/or modified sequence opt4 from anti-HIV_CH01_HeavyChain_CDR
  source 1..78: mol_type = other RNA
gccagaggcaccgactacaccatcgacgacgccggcatccactaccagggcagcggcaccttctggtacttcgacctg

SEQ ID NO: 36177 - RNA, 78 nt, synthetic construct
  misc_feature 1..78: note = derived and/or modified sequence opt4 from anti-HIV_CH02_HeavyChain_CDR
  source 1..78: mol_type = other RNA
gccagaggcaccgactacaccatcgacgaccagggcagattctaccagggcagcggcaccttctggtacttcgacttc

SEQ ID NO: 36178 - RNA, 78 nt, synthetic construct
  misc_feature 1..78: note = derived and/or modified sequence opt4 from anti-HIV_CH03_HeavyChain_CDR
  source 1..78: mol_type = other RNA
gccagaggcaccgactacaccatcgacgaccagggcatcttctacaagggcagcggcaccttctggtacttcgacctg

SEQ ID NO: 36179 - RNA, 33 nt, synthetic construct
  misc_feature 1..33: note = derived and/or modified sequence opt4 from anti-HIV_CH04_LightChain_CDR
  source 1..33: mol_type = other RNA
tgccagcagtacggcagaagcccctacaccttc

SEQ ID NO: 36180 - RNA, 78 nt, synthetic construct
  misc_feature 1..78: note = derived and/or modified sequence opt4 from anti-HIV_CH04_HeavyChain_CDR
  source 1..78: mol_type = other RNA
gccagaggcaccgactacaccatcgacgaccagggcatcagataccagggcagcggcaccttctggtacttcgacgtg

SEQ ID NO: 36181 - RNA, 54 nt, synthetic construct
  misc_feature 1..54: note = derived and/or modified sequence opt4 from anti-HIV_NIH45-46_HeavyChain_CDR
  source 1..54: mol_type = other RNA
accagaggcaagtactgcaccgccagagactactacaactgggacttcgagcac

SEQ ID NO: 36182 - RNA, 90 nt, synthetic construct
  misc_feature 1..90: note = derived and/or modified sequence opt4 from anti-HIV_PG16_HeavyChain_CDR
  source 1..90: mol_type = other RNA
gccagagaggccggcggccccatctggcacgacgacgtgaagtactacgacttcaacgacggctactacaactaccactacatggacgtg

SEQ ID NO: 36183 - RNA, 36 nt, synthetic construct
  misc_feature 1..36: note = derived and/or modified sequence opt4 from anti-HIV_PGT122_LightChain_CDR
  source 1..36: mol_type = other RNA
cacatctgggacagcagaagacccaccaactgggtg

SEQ ID NO: 36184 - RNA, 72 nt, synthetic construct
  misc_feature 1..72: note = derived and/or modified sequence opt4 from anti-HIV_PGT122_HeavyChain_CDR
  source 1..72: mol_type = other RNA
accaagcacggcagaagaatctacggcgtggtggccttcaaggagtggttcacctacttctacatggacgtg

SEQ ID NO: 36185 - RNA, 36 nt, synthetic construct
  misc_feature 1..36: note = derived and/or modified sequence opt4 from anti-HIV_PGT123_LightChain_CDR
  source 1..36: mol_type = other RNA
cacatctacgacgccagaggcggcaccaactgggtg

SEQ ID NO: 36186 - RNA, 72 nt, synthetic construct
  misc_feature 1..72: note = derived and/or modified sequence opt4 from anti-HIV_PGT123_HeavyChain_CDR
  source 1..72: mol_type = other RNA
gccctgcacggcaagagaatctacggcatcgtggccctgggcgagctgttcacctacttctacatggacgtg

SEQ ID NO: 36187 - RNA, 30 nt, synthetic construct
  misc_feature 1..30: note = derived and/or modified sequence opt4 from anti-HIV_PGT125_PGT128_LightChain_CDR
  source 1..30: mol_type = other RNA
ggcagcctggtgggcaactgggacgtgatc

SEQ ID NO: 36188 - RNA, 57 nt, synthetic construct
  misc_feature 1..57: note = derived and/or modified sequence opt4 from anti-HIV_PGT125_HeavyChain_CDR
  source 1..57: mol_type = other RNA
ttcgacggcgaggtgctggtgtacaaccactggcccaagcccgcctgggtggacctg

SEQ ID NO: 36189 - RNA, 30 nt, synthetic construct
  misc_feature 1..30: note = derived and/or modified sequence opt4 from anti-HIV_PGT126_PGT127_LightChain_CDR
  source 1..30: mol_type = other RNA
agcagcctggtgggcaactgggacgtgatc

SEQ ID NO: 36190 - RNA, 57 nt, synthetic construct
  misc_feature 1..57: note = derived and/or modified sequence opt4 from anti-HIV_PGT126_HeavyChain_CDR
  source 1..57: mol_type = other RNA
ttcgacggcgaggtgctggtgtaccacgactggcccaagcccgcctgggtggacctg

SEQ ID NO: 36191 - RNA, 57 nt, synthetic construct
  misc_feature 1..57: note = derived and/or modified sequence opt4 from anti-HIV_PGT127_HeavyChain_CDR
  source 1..57: mol_type = other RNA
ttcggcggcgaggtgctggtgtacagagactggcccaagcccgcctgggtggacctg

SEQ ID NO: 36192 - RNA, 57 nt, synthetic construct
  misc_feature 1..57: note = derived and/or modified sequence opt4 from anti-HIV_PGT128_HeavyChain_CDR
  source 1..57: mol_type = other RNA
ttcggcggcgaggtgctgagatacaccgactggcccaagcccgcctgggtggacctg

SEQ ID NO: 36193 - RNA, 30 nt, synthetic construct
  misc_feature 1..30: note = derived and/or modified sequence opt4 from anti-HIV_PGT130_LightChain_CDR
  source 1..30: mol_type = other RNA
agcagcctgttcggcagatgggacgtggtg

SEQ ID NO: 36194 - RNA, 57 nt, synthetic construct
  misc_feature 1..57: note = derived and/or modified sequence opt4 from anti-HIV_PGT130_HeavyChain_CDR
  source 1..57: mol_type = other RNA
agcggcggcgacatcctgtactactacgagtggcagaagccccactggttcagcccc

SEQ ID NO: 36195 - RNA, 30 nt, synthetic construct
  misc_feature 1..30: note = derived and/or modified sequence opt4 from anti-HIV_PGT131_LightChain_CDR
  source 1..30: mol_type = other RNA
agcagcctgagcggcagatgggacatcgtg

SEQ ID NO: 36196 - RNA, 57 nt, synthetic construct
  misc_feature 1..57: note = derived and/or modified sequence opt4 from anti-HIV_PGT131_HeavyChain_CDR
  source 1..57: mol_type = other RNA
agcggcggcgacatcctgtactacatcgagtggcagaagccccactggttctacccc

SEQ ID NO: 36197 - RNA, 27 nt, synthetic construct
  misc_feature 1..27: note = derived and/or modified sequence opt4 from anti-HIV_PGT135_PGT136_PGT137_LightChain_CDR
  source 1..27: mol_type = other RNA
cagcagtacgaggagtggcccagaacc

SEQ ID NO: 36198 - RNA, 54 nt, synthetic construct
  misc_feature 1..54: note = derived and/or modified sequence opt4 from anti-HIV_PGT135_HeavyChain_CDR
  source 1..54: mol_type = other RNA
cacagacaccacgacgtgttcatgctggtgcccatcgccggctggttcgacgtg

SEQ ID NO: 36199 - RNA, 54 nt, synthetic construct
  misc_feature 1..54: note = derived and/or modified sequence opt4 from anti-HIV_PGT136_HeavyChain_CDR
  source 1..54: mol_type = other RNA
cacaagtaccacgacatcttcagagtggtgcccgtggccggctggttcgacccc

SEQ ID NO: 36200 - RNA, 54 nt, synthetic construct
  misc_feature 1..54: note = derived and/or modified sequence opt4 from anti-HIV_PGT137_HeavyChain_CDR
  source 1..54: mol_type = other RNA
cacaagtaccacgacatcgtgatggtggtgcccatcgccggctggttcgacccc

SEQ ID NO: 36201 - RNA, 27 nt, synthetic construct
  misc_feature 1..27: note = derived and/or modified sequence opt4 from anti-HIV_PGT141_PGT142_PGT143_PGT144_LightChain_CDR
  source 1..27: mol_type = other RNA
atgcagggcctgaacagaccctggacc

SEQ ID NO: 36202 - RNA, 96 nt, synthetic construct
  misc_feature 1..96: note = derived and/or modified sequence opt4 from anti-HIV_PGT141_HeavyChain_CDR
  source 1..96: mol_type = other RNA
ggcagcaagcacagactgagagactacgtgctgtacgacgactacggcctgatcaactaccaggagtggaacgactacctggagttcctggacgtg

SEQ ID NO: 36203 - RNA, 96 nt, synthetic construct
  misc_feature 1..96: note = derived and/or modified sequence opt4 from anti-HIV_PGT144_HeavyChain_CDR
  source 1..96: mol_type = other RNA
ggcagcaagcacagactgagagactacgtgctgtacgacgactacggcctgatcaaccagcaggagtggaacgactacctggagttcctggacgtg

SEQ ID NO: 36204 - RNA, 27 nt, synthetic construct
  misc_feature 1..27: note = derived and/or modified sequence opt4 from anti-HIV_PGT145_LightChain_CDR
  source 1..27: mol_type = other RNA
atgcagggcctgcacagcccctggacc

SEQ ID NO: 36205 - RNA, 93 nt, synthetic construct
  misc_feature 1..93: note = derived and/or modified sequence opt4 from anti-HIV_PGT145_HeavyChain_CDR
  source 1..93: mol_type = other RNA
ggcagcaagcacagactgagagactacttcctgtacaacgagtacggccccaactacgaggagtggggcgactacctggccaccctggacgtg

SEQ ID NO: 36206 - RNA, 21 nt, synthetic construct
  misc_feature 1..21: note = derived and/or modified sequence opt4 from anti-HIV_VRC-CH30_VRC-CH31_VRC-CH32_VRC-CH33_VRC-CH34_Light Chain _CDR
  source 1..21: mol_type = other RNA
tgccagcagtacgagaccttc

SEQ ID NO: 36207 - RNA, 45 nt, synthetic construct
  misc_feature 1..45: note = derived and/or modified sequence opt4 from anti-HIV_VRC-CH30_VRC-CH31_VRC-CH32_VRC-CH34_HeavyChain_CDR
  source 1..45: mol_type = other RNA
gccagagcccagaagagaggcagaagcgagtgggcctacgcccac

SEQ ID NO: 36208 - RNA, 45 nt, synthetic construct
  misc_feature 1..45: note = derived and/or modified sequence opt4 from anti-HIV_VRC-CH33_HeavyChain_CDR
  source 1..45: mol_type = other RNA
gccagagcccagaagagagccagaagcgagtgggcctacgcccac

SEQ ID NO: 36209 - RNA, 21 nt, synthetic construct
  misc_feature 1..21: note = derived and/or modified sequence opt4 from anti-HIV_VRC-PG04_LightChain_CDR
  source 1..21: mol_type = other RNA
tgccagcagctggagttcttc

SEQ ID NO: 36210 - RNA, 48 nt, synthetic construct
  misc_feature 1..48: note = derived and/or modified sequence opt4 from anti-HIV_VRC-PG04_HeavyChain_CDR
  source 1..48: mol_type = other RNA
gccagacagaagttctacaccggcggccagggctggtacttcgacctg

SEQ ID NO: 36211 - RNA, 21 nt, synthetic construct
  misc_feature 1..21: note = derived and/or modified sequence opt4 from anti-HIV_VRC-PG04b_LightChain_CDR
  source 1..21: mol_type = other RNA
tgccagcaggtggagttcttc

SEQ ID NO: 36212 - RNA, 48 nt, synthetic construct
  misc_feature 1..48: note = derived and/or modified sequence opt4 from anti-HIV_VRC-PG04b_HeavyChain_CDR
  source 1..48: mol_type = other RNA
gccagacagaagttcgagagaggcggccagggctggtacttcgacctg

SEQ ID NO: 36213 - RNA, 21 nt, synthetic construct
  misc_feature 1..21: note = derived and/or modified sequence opt4 from anti-HIV_VRC03_LightChain_CDR
  source 1..21: mol_type = other RNA
tgccagcagttcgagttcttc

SEQ ID NO: 36214 - RNA, 48 nt, synthetic construct
  misc_feature 1..48: note = derived and/or modified sequence opt4 from anti-HIV_VRC03_HeavyChain_CDR
  source 1..48: mol_type = other RNA
gtgagaagaggcagctgcgactactgcggcgacttcccctggcagtac

SEQ ID NO: 36215 - RNA, 21 nt, synthetic construct
  misc_feature 1..21: note = derived and/or modified sequence opt4 from anti-HIV_1TJG_P-Chain
  source 1..21: mol_type = other RNA
gagctggacaagtgggccagc

SEQ ID NO: 36216 - RNA, 69 nt, synthetic construct
  misc_feature 1..69: note = derived and/or modified sequence opt4 from anti-HIV_2B1H_P-Chain
  source 1..69: mol_type = other RNA
aacaacaccaagaagagcatcaagatcagacccagacaggccttctacgccaccaacggcatcatcggc

SEQ ID NO: 36217 - RNA, 69 nt, synthetic construct
  misc_feature 1..69: note = derived and/or modified sequence opt4 from anti-HIV_2B1A_P-Chain
  source 1..69: mol_type = other RNA
aacaacaccagaaagagcatccacctgggccccggcagagccttctacgccaccggcgacatcatcggc

SEQ ID NO: 36218 - RNA, 57 nt, synthetic construct
  misc_feature 1..57: note = derived and/or modified sequence opt4 from anti-HIV_2B0S_P-Chain
  source 1..57: mol_type = other RNA
aagagaaagagaatccacatcggccccggcagagccttctacaccaccaagaacgcc

SEQ ID NO: 36219 - RNA, 69 nt, synthetic construct
  misc_feature 1..69: note = derived and/or modified sequence opt4 from anti-HIV_3UJJ_P-Chain
  source 1..69: mol_type = other RNA
aacaacaccagaaagagcatcagaatcggccccggccaggccttctacgccaccggcgacatcatcggc

SEQ ID NO: 36220 - RNA, 69 nt, synthetic construct
  misc_feature 1..69: note = derived and/or modified sequence opt4 from anti-HIV_3UJI_P-Chain
  source 1..69: mol_type = other RNA
tacaacaagagaaagagaatccacatcggccccggcagagccttctacaccaccaagaacatcatcggc

SEQ ID NO: 36221 - RNA, 75 nt, synthetic construct
  misc_feature 1..75: note = derived and/or modified sequence opt4 from anti-HIV_3MLZ_P-Chain
  source 1..75: mol_type = other RNA
agcaacaacaccagaaagggcatccacatcggccccggcagagccttctacgccaccggccagatcaccggcgac

SEQ ID NO: 36222 - RNA, 60 nt, synthetic construct
  misc_feature 1..60: note = derived and/or modified sequence opt4 from anti-HIV_3MLV_Q-Chain
  source 1..60: mol_type = other RNA
aacaacaccagaaagagaatcagagtgggccccggccagaccgtgtacgccaccaacgcc

SEQ ID NO: 36223 - RNA, 69 nt, synthetic construct
  misc_feature 1..69: note = derived and/or modified sequence opt4 from anti-HIV_3MLU_P-Chain
  source 1..69: mol_type = other RNA
aacaacaccagaaagagcatcagaatcggccccggccaggccttctacgccaccggcggcatcatcggc

SEQ ID NO: 36224 - RNA, 60 nt, synthetic construct
  misc_feature 1..60: note = derived and/or modified sequence opt4 from anti-HIV_3MLR_P-Chain
  source 1..60: mol_type = other RNA
aacaacaccaagaagggcatcgccatcggccccggcagaaccctgtacgccagagagaag

SEQ ID NO: 36225 - RNA, 48 nt, synthetic construct; identical to SEQ ID NO: 13299
  misc_feature 1..48: note = derived and/or modified sequence opt4 from anti-HIV_4XCF_P-Chain
  source 1..48: mol_type = other RNA

SEQ ID NO: 36226 - RNA, 45 nt, synthetic construct; identical to SEQ ID NO: 13300
  misc_feature 1..45: note = derived and/or modified sequence opt4 from anti-HIV_4XBE_P-Chain
  source 1..45: mol_type = other RNA

SEQ ID NO: 36227 - RNA, 48 nt, synthetic construct; identical to SEQ ID NO: 13301
  misc_feature 1..48: note = derived and/or modified sequence opt4 from anti-HIV_4XAW_P-Chain
  source 1..48: mol_type = other RNA

SEQ ID NO: 36228 - RNA, 45 nt, synthetic construct
  misc_feature 1..45: note = derived and/or modified sequence opt4 from anti-HIV_2QSC_P-Chain
  source 1..45: mol_type = other RNA
agaaagagaatccacatcggccccggcagagccttctacaccacc

SEQ ID NO: 36229 - RNA, 60 nt, synthetic construct
  misc_feature 1..60: note = derived and/or modified sequence opt4 from anti-HIV_3MLS_S-Chain
  source 1..60: mol_type = other RNA
gcctgccaggccttctacgccagcagccccagaaagagcatccacatcggcgcctgcgcc

SEQ ID NO: 36230 - RNA, 42 nt, synthetic construct
  misc_feature 1..42: note = derived and/or modified sequence opt4 from anti-HIV_3GO1_P-Chain
  source 1..42: mol_type = other RNA
agaaagagaatccacatcggccccggcagagccttctacacc

SEQ ID NO: 36231 - RNA, 42 nt, synthetic construct
  misc_feature 1..42: note = derived and/or modified sequence opt4 from anti-HIV_4M1D_Q-Chain
  source 1..42: mol_type = other RNA
tgcagaatccacatcggccccggcagagccttctacacctgc

SEQ ID NO: 36232 - RNA, 39 nt, synthetic construct
  misc_feature 1..39: note = derived and/or modified sequence opt4 from anti-HIV_3C2A_Q-Chain
  source 1..39: mol_type = other RNA
aagagcatccacctgggccccggcagagccttctacgcc

SEQ ID NO: 36233 - RNA, 12 nt, synthetic construct
  misc_feature 1..12: note = derived and/or modified sequence opt4 from anti-HIV_CDR
  source 1..12: mol_type = other RNA
cagagcaagacc

SEQ ID NO: 36234 - RNA, 12 nt, synthetic construct
  misc_feature 1..12: note = derived and/or modified sequence opt4 from anti-HIV_CDR
  source 1..12: mol_type = other RNA
gacctgatcgac

SEQ ID NO: 36235 - RNA, 15 nt, synthetic construct
  misc_feature 1..15: note = derived and/or modified sequence opt4 from anti-HIV_CDR
  source 1..15: mol_type = other RNA
gaccactactggagc

SEQ ID NO: 36236 - RNA, 15 nt, synthetic construct
  misc_feature 1..15: note = derived and/or modified sequence opt4 from anti-HIV_CDR
  source 1..15: mol_type = other RNA
ggcagattctggagc

SEQ ID NO: 36237 - RNA, 15 nt, synthetic construct
  misc_feature 1..15: note = derived and/or modified sequence opt4 from anti-HIV_CDR
  source 1..15: mol_type = other RNA
aactactactggacc

SEQ ID NO: 36238 - RNA, 15 nt, synthetic construct
  misc_feature 1..15: note = derived and/or modified sequence opt4 from anti-HIV_CDR
  source 1..15: mol_type = other RNA
gacgcctactggagc

SEQ ID NO: 36239 - RNA, 15 nt, synthetic construct
  misc_feature 1..15: note = derived and/or modified sequence opt4 from anti-HIV_CDR
  source 1..15: mol_type = other RNA
gacagctactggagc

SEQ ID NO: 36240 - RNA, 15 nt, synthetic construct
  misc_feature 1..15: note = derived and/or modified sequence opt4 from anti-HIV_CDR
  source 1..15: mol_type = other RNA
gacaactactggagc

SEQ ID NO: 36241 - RNA, 15 nt, synthetic construct
  misc_feature 1..15: note = derived and/or modified sequence opt4 from anti-HIV_CDR
  source 1..15: mol_type = other RNA
aacagctactggacc

SEQ ID NO: 36242 - RNA, 15 nt, synthetic construct
  misc_feature 1..15: note = derived and/or modified sequence opt4 from anti-HIV_CDR
  source 1..15: mol_type = other RNA
agctactactggagc

SEQ ID NO: 36243 - RNA, 15 nt, synthetic construct
  misc_feature 1..15: note = derived and/or modified sequence opt4 from anti-HIV_CDR
  source 1..15: mol_type = other RNA
agcttcggcatgcac

SEQ ID NO: 36244 - RNA, 15 nt, synthetic construct
  misc_feature 1..15: note = derived and/or modified sequence opt4 from anti-HIV_CDR
  source 1..15: mol_type = other RNA
gccgccttccagtgg

SEQ ID NO: 36245 - RNA, 15 nt, synthetic construct
  misc_feature 1..15: note = derived and/or modified sequence opt4 from anti-HIV_CDR
  source 1..15: mol_type = other RNA
cagcagctgagaacc

SEQ ID NO: 36246 - RNA, 15 nt, synthetic construct
  misc_feature 1..15: note = derived and/or modified sequence opt4 from anti-HIV_CDR
  source 1..15: mol_type = other RNA
cagcagtacgacagc

SEQ ID NO: 36247 - RNA, 15 nt, synthetic construct
  misc_feature 1..15: note = derived and/or modified sequence opt4 from anti-HIV_CDR
  source 1..15: mol_type = other RNA
cagcagctggccacc

SEQ ID NO: 36248 - RNA, 15 nt, synthetic construct
  misc_feature 1..15: note = derived and/or modified sequence opt4 from anti-HIV_CDR
  source 1..15: mol_type = other RNA
gagagcttccagtgg

SEQ ID NO: 36249 - RNA, 15 nt, synthetic construct
  misc_feature 1..15: note = derived and/or modified sequence opt4 from anti-HIV_CDR
  source 1..15: mol_type = other RNA
gaggtgtacgagttc

SEQ ID NO: 36250 - RNA, 15 nt, synthetic construct
  misc_feature 1..15: note = derived and/or modified sequence opt4 from anti-HIV_CDR
  source 1..15: mol_type = other RNA
gccagcctggagttc

SEQ ID NO: 36251 - RNA, 15 nt, synthetic construct
  misc_feature 1..15: note = derived and/or modified sequence opt4 from anti-HIV_CDR
  source 1..15: mol_type = other RNA
agcgtgtacgagttc

SEQ ID NO: 36252 - RNA, 15 nt, synthetic construct
  misc_feature 1..15: note = derived and/or modified sequence opt4 from anti-HIV_CDR
  source 1..15: mol_type = other RNA
gccgccctggagttc

SEQ ID NO: 36253 - RNA, 15 nt, synthetic construct
  misc_feature 1..15: note = derived and/or modified sequence opt4 from anti-HIV_CDR
  source 1..15: mol_type = other RNA
gccgtggtggagttc

SEQ ID NO: 36254 - RNA, 15 nt, synthetic construct
  misc_feature 1..15: note = derived and/or modified sequence opt4 from anti-HIV_CDR
  source 1..15: mol_type = other RNA
cagctgttcgagttc

SEQ ID NO: 36255 - RNA, 15 nt, synthetic construct
  misc_feature 1..15: note = derived and/or modified sequence opt4 from anti-HIV_CDR
  source 1..15: mol_type = other RNA
gccgtgttccagtgg

SEQ ID NO: 36256 - RNA, 15 nt, synthetic construct
  misc_feature 1..15: note = derived and/or modified sequence opt4 from anti-HIV_CDR
  source 1..15: mol_type = other RNA
gccgtgctggagttc

SEQ ID NO: 36257 - RNA, 15 nt, synthetic construct
  misc_feature 1..15: note = derived and/or modified sequence opt4 from anti-HIV_CDR
  source 1..15: mol_type = other RNA
aacggcttcgacgtg

SEQ ID NO: 36258 - RNA, 15 nt, synthetic construct
  misc_feature 1..15: note = derived and/or modified sequence opt4 from anti-HIV_CDR
  source 1..15: mol_type = other RNA
cagcagtacgagttc

SEQ ID NO: 36259 - RNA, 15 nt, synthetic construct
  misc_feature 1..15: note = derived and/or modified sequence opt4 from anti-HIV_CDR
  source 1..15: mol_type = other RNA
cagcactacgagttc

SEQ ID NO: 36260 - RNA, 15 nt, synthetic construct
  misc_feature 1..15: note = derived and/or modified sequence opt4 from anti-HIV_CDR
  source 1..15: mol_type = other RNA
caggtgtacgaggtg

SEQ ID NO: 36261 - RNA, 15 nt, synthetic construct
  misc_feature 1..15: note = derived and/or modified sequence opt4 from anti-HIV_CDR
  source 1..15: mol_type = other RNA
caggtgtacgagttc

SEQ ID NO: 36262 - RNA, 15 nt, synthetic construct
  misc_feature 1..15: note = derived and/or modified sequence opt4 from anti-HIV_CDR
  source 1..15: mol_type = other RNA
ttcagcaaggagagc

SEQ ID NO: 36263 - RNA, 15 nt, synthetic construct
  misc_feature 1..15: note = derived and/or modified sequence opt4 from anti-HIV_CDR
  source 1..15: mol_type = other RNA
ctgaagctgagcagc

SEQ ID NO: 36264 - RNA, 15 nt, synthetic construct
  misc_feature 1..15: note = derived and/or modified sequence opt4 from anti-HIV_CDR
  source 1..15: mol_type = other RNA
tacaaggtgagcagc

SEQ ID NO: 36265 - RNA, 15 nt, synthetic construct
  misc_feature 1..15: note = derived and/or modified sequence opt4 from anti-HIV_CDR
  source 1..15: mol_type = other RNA
cccccccaggagagc

SEQ ID NO: 36266 - RNA, 15 nt, synthetic construct
  misc_feature 1..15: note = derived and/or modified sequence opt4 from anti-HIV_CDR
  source 1..15: mol_type = other RNA
accgccagagactac

SEQ ID NO: 36267 - RNA, 15 nt, synthetic construct
  misc_feature 1..15: note = derived and/or modified sequence opt4 from anti-HIV_CDR
  source 1..15: mol_type = other RNA
atgcagagcatccag

SEQ ID NO: 36268 - RNA, 15 nt, synthetic construct
  misc_feature 1..15: note = derived and/or modified sequence opt4 from anti-HIV_CDR
  source 1..15: mol_type = other RNA
caccagctggacacc

SEQ ID NO: 36269 - RNA, 15 nt, synthetic construct
  misc_feature 1..15: note = derived and/or modified sequence opt4 from anti-HIV_CDR
  source 1..15: mol_type = other RNA
caccagctggacagc

SEQ ID NO: 36270 - RNA, 15 nt, synthetic construct
  misc_feature 1..15: note = derived and/or modified sequence opt4 from anti-HIV_CDR
  source 1..15: mol_type = other RNA
cagcagctgggcacc

SEQ ID NO: 36271 - RNA, 15 nt, synthetic construct
  misc_feature 1..15: note = derived and/or modified sequence opt4 from anti-HIV_CDR
  source 1..15: mol_type = other RNA
cagaaggccaccacc

SEQ ID NO: 36272 - RNA, 15 nt, synthetic construct
  misc_feature 1..15: note = derived and/or modified sequence opt4 from anti-HIV_CDR
  source 1..15: mol_type = other RNA
ctgttcgccggcacc

SEQ ID NO: 36273 - RNA, 18 nt, synthetic construct
  misc_feature 1..18: note = derived and/or modified sequence opt4 from anti-HIV_CDR
  source 1..18: mol_type = other RNA
gtgagaggcagcagcccc

SEQ ID NO: 36274 - RNA, 18 nt, synthetic construct
  misc_feature 1..18: note = derived and/or modified sequence opt4 from anti-HIV_CDR
  source 1..18: mol_type = other RNA
ggcctgctgttcgtggtg

SEQ ID NO: 36275 - RNA, 18 nt, synthetic construct
  misc_feature 1..18: note = derived and/or modified sequence opt4 from anti-HIV_CDR
  source 1..18: mol_type = other RNA
atggactggacctggagc

SEQ ID NO: 36276 - RNA, 18 nt, synthetic construct
  misc_feature 1..18: note = derived and/or modified sequence opt4 from anti-HIV_CDR
  source 1..18: mol_type = other RNA
atggactggacctggaga

SEQ ID NO: 36277 - RNA, 18 nt, synthetic construct
  misc_feature 1..18: note = derived and/or modified sequence opt4 from anti-HIV_CDR
  source 1..18: mol_type = other RNA
atgaagcacctgtggttc

SEQ ID NO: 36278 - RNA, 18 nt, synthetic construct
  misc_feature 1..18: note = derived and/or modified sequence opt4 from anti-HIV_CDR
  source 1..18: mol_type = other RNA
atggactggatctggaga

SEQ ID NO: 36279 - RNA, 18 nt, synthetic construct
  misc_feature 1..18: note = derived and/or modified sequence opt4 from anti-HIV_CDR
  source 1..18: mol_type = other RNA
atggactggacctggacc

SEQ ID NO: 36280 - RNA, 18 nt, synthetic construct
  misc_feature 1..18: note = derived and/or modified sequence opt4 from anti-HIV_CDR
  source 1..18: mol_type = other RNA
atgaagcacctgttcctg

SEQ ID NO: 36281 - RNA, 18 nt, synthetic construct
  misc_feature 1..18: note = derived and/or modified sequence opt4 from anti-HIV_CDR
  source 1..18: mol_type = other RNA
cagctgctgcagagcaac

SEQ ID NO: 36282 - RNA, 18 nt, synthetic construct
  misc_feature 1..18: note = derived and/or modified sequence opt4 from anti-HIV_CDR
  source 1..18: mol_type = other RNA
ggcggcagccccgagcac

SEQ ID NO: 36283 - RNA, 18 nt, synthetic construct
  misc_feature 1..18: note = derived and/or modified sequence opt4 from anti-HIV_CDR
  source 1..18: mol_type = other RNA
ctggagggcaccgactac

SEQ ID NO: 36284 - RNA, 18 nt, synthetic construct
  misc_feature 1..18: note = derived and/or modified sequence opt4 from anti-HIV_CDR
  source 1..18: mol_type = other RNA
cagcagtaccccagcacc

SEQ ID NO: 36285 - RNA, 21 nt, synthetic construct
  misc_feature 1..21: note = derived and/or modified sequence opt4 from anti-HIV_CDR
  source 1..21: mol_type = other RNA
aacaaccacgacagacccagc

SEQ ID NO: 36286 - RNA, 21 nt, synthetic construct
  misc_feature 1..21: note = derived and/or modified sequence opt4 from anti-HIV_CDR
  source 1..21: mol_type = other RNA
aacaaccaggacagacccgcc

SEQ ID NO: 36287 - RNA, 21 nt, synthetic construct
  misc_feature 1..21: note = derived and/or modified sequence opt4 from anti-HIV_CDR
  source 1..21: mol_type = other RNA
aacaacaacgacagacccagc

SEQ ID NO: 36288 - RNA, 21 nt, synthetic construct
  misc_feature 1..21: note = derived and/or modified sequence opt4 from anti-HIV_CDR
  source 1..21: mol_type = other RNA
aacaaccaggacagacccagc

SEQ ID NO: 36289 - RNA, 21 nt, synthetic construct
  misc_feature 1..21: note = derived and/or modified sequence opt4 from anti-HIV_CDR
  source 1..21: mol_type = other RNA
gacgacagcgacagacccagc

SEQ ID NO: 36290 - RNA, 21 nt, synthetic construct
  misc_feature 1..21: note = derived and/or modified sequence opt4 from anti-HIV_CDR
  source 1..21: mol_type = other RNA
tgggccagcaccagacacacc

SEQ ID NO: 36291 - RNA, 21 nt, synthetic construct
  misc_feature 1..21: note = derived and/or modified sequence opt4 from anti-HIV_CDR
  source 1..21: mol_type = other RNA
ggcgccaccgccagagacttc

SEQ ID NO: 36292 - RNA, 21 nt, synthetic construct
  misc_feature 1..21: note = derived and/or modified sequence opt4 from anti-HIV_CDR
  source 1..21: mol_type = other RNA
gccagcatcaagctggccctg

SEQ ID NO: 36293 - RNA, 21 nt, synthetic construct
  misc_feature 1..21: note = derived and/or modified sequence opt4 from anti-HIV_CDR
  source 1..21: mol_type = other RNA
cagcagtacggcagaagcccc

SEQ ID NO: 36294 - RNA, 21 nt, synthetic construct
  misc_feature 1..21: note = derived and/or modified sequence opt4 from anti-HIV_CDR
  source 1..21: mol_type = other RNA
cagcagtactacatcagcccc

SEQ ID NO: 36295 - RNA, 21 nt, synthetic construct
  misc_feature 1..21: note = derived and/or modified sequence opt4 from anti-HIV_CDR
  source 1..21: mol_type = other RNA
cagcagagccacagccccagc

SEQ ID NO: 36296 - RNA, 21 nt, synthetic construct
  misc_feature 1..21: note = derived and/or modified sequence opt4 from anti-HIV_CDR
  source 1..21: mol_type = other RNA
ggcagatgcgccagaagatgg

SEQ ID NO: 36297 - RNA, 21 nt, synthetic construct
  misc_feature 1..21: note = derived and/or modified sequence opt4 from anti-HIV_CDR
  source 1..21: mol_type = other RNA
agattcctgttcgtggtggcc

SEQ ID NO: 36298 - RNA, 21 nt, synthetic construct
  misc_feature 1..21: note = derived and/or modified sequence opt4 from anti-HIV_CDR
  source 1..21: mol_type = other RNA
atgagcgtgagcttcctgatc

SEQ ID NO: 36299 - RNA, 21 nt, synthetic construct
  misc_feature 1..21: note = derived and/or modified sequence opt4 from anti-HIV_CDR
  source 1..21: mol_type = other RNA
ggcagcagcaacagatgcccc

SEQ ID NO: 36300 - RNA, 21 nt, synthetic construct
  misc_feature 1..21: note = derived and/or modified sequence opt4 from anti-HIV_CDR
  source 1..21: mol_type = other RNA
atgaagcacctgtggttcttc

SEQ ID NO: 36301 - RNA, 21 nt, synthetic construct
  misc_feature 1..21: note = derived and/or modified sequence opt4 from anti-HIV_CDR
  source 1..21: mol_type = other RNA
gccagctgggacttcgacttc

SEQ ID NO: 36302 - RNA, 21 nt, synthetic construct
  misc_feature 1..21: note = derived and/or modified sequence opt4 from anti-HIV_CDR
  source 1..21: mol_type = other RNA
gagatcggcgtggccgagcac

SEQ ID NO: 36303 - RNA, 21 nt, synthetic construct
  misc_feature 1..21: note = derived and/or modified sequence opt4 from anti-HIV_CDR
  source 1..21: mol_type = other RNA
cagaagtacgacaccgccccc

SEQ ID NO: 36304 - RNA, 21 nt, synthetic construct
  misc_feature 1..21: note = derived and/or modified sequence opt4 from anti-HIV_CDR
  source 1..21: mol_type = other RNA
cagcagagcagcagcaccccc

SEQ ID NO: 36305 - RNA, 21 nt, synthetic construct
  misc_feature 1..21: note = derived and/or modified sequence opt4 from anti-HIV_CDR
  source 1..21: mol_type = other RNA
cagcagagcgccggcaccccc

SEQ ID NO: 36306 - RNA, 21 nt, synthetic construct
  misc_feature 1..21: note = derived and/or modified sequence opt4 from anti-HIV_CDR
  source 1..21: mol_type = other RNA
cagcagagcagcagcaagccc

SEQ ID NO: 36307 - RNA, 21 nt, synthetic construct
  misc_feature 1..21: note = derived and/or modified sequence opt4 from anti-HIV_CDR
  source 1..21: mol_type = other RNA
caggagtacaacacctacacc

SEQ ID NO: 36308 - RNA, 21 nt, synthetic construct
  misc_feature 1..21: note = derived and/or modified sequence opt4 from anti-HIV_CDR
  source 1..21: mol_type = other RNA
caggagtacaacaactacaac

SEQ ID NO: 36309 - RNA, 21 nt, synthetic construct
  misc_feature 1..21: note = derived and/or modified sequence opt4 from anti-HIV_CDR
  source 1..21: mol_type = other RNA
cactacgacgccctggactac

SEQ ID NO: 36310 - RNA, 24 nt, synthetic construct
  misc_feature 1..24: note = derived and/or modified sequence opt4 from anti-HIV_CDR
  source 1..24: mol_type = other RNA
gccatcttcaagggcgtgcagtgc

SEQ ID NO: 36311 - RNA, 24 nt, synthetic construct
  misc_feature 1..24: note = derived and/or modified sequence opt4 from anti-HIV_CDR
  source 1..24: mol_type = other RNA
ggccccctgggcgactacgacttc

SEQ ID NO: 36312 - RNA, 24 nt, synthetic construct
  misc_feature 1..24: note = derived and/or modified sequence opt4 from anti-HIV_CDR
  source 1..24: mol_type = other RNA
cagcagtacggcagcagcctgaga

SEQ ID NO: 36313 - RNA, 24 nt, synthetic construct
  misc_feature 1..24: note = derived and/or modified sequence opt4 from anti-HIV_CDR
  source 1..24: mol_type = other RNA
cagcagtacagccactacagaacc

SEQ ID NO: 36314 - RNA, 24 nt, synthetic construct
  misc_feature 1..24: note = derived and/or modified sequence opt4 from anti-HIV_CDR
  source 1..24: mol_type = other RNA
cagtactacggcatgagcgtgacc

SEQ ID NO: 36315 - RNA, 24 nt, synthetic construct
  misc_feature 1..24: note = derived and/or modified sequence opt4 from anti-HIV_CDR
  source 1..24: mol_type = other RNA
cagcagtacgagaactggctgacc

SEQ ID NO: 36316 - RNA, 24 nt, synthetic construct
  misc_feature 1..24: note = derived and/or modified sequence opt4 from anti-HIV_CDR
  source 1..24: mol_type = other RNA
agcggcgtgcactacatggacgtg

SEQ ID NO: 36317 - RNA, 24 nt, synthetic construct
  misc_feature 1..24: note = derived and/or modified sequence opt4 from anti-HIV_CDR
  source 1..24: mol_type = other RNA
cagcagtacagcggccccctgacc

SEQ ID NO: 36318 - RNA, 24 nt, synthetic construct
  misc_feature 1..24: note = derived and/or modified sequence opt4 from anti-HIV_CDR
  source 1..24: mol_type = other RNA
cagcagtactacaccgtgcccagc

SEQ ID NO: 36319 - RNA, 24 nt, synthetic construct
  misc_feature 1..24: note = derived and/or modified sequence opt4 from anti-HIV_CDR
  source 1..24: mol_type = other RNA
cagcagtacggcagcagcatcacc

SEQ ID NO: 36320 - RNA, 24 nt, synthetic construct
  misc_feature 1..24: note = derived and/or modified sequence opt4 from anti-HIV_CDR
  source 1..24: mol_type = other RNA
caccagtacaacaagtgggacacc

SEQ ID NO: 36321 - RNA, 24 nt, synthetic construct
  misc_feature 1..24: note = derived and/or modified sequence opt4 from anti-HIV_CDR
  source 1..24: mol_type = other RNA
cagcagagctacaccacccccctg

SEQ ID NO: 36322 - RNA, 24 nt, synthetic construct
  misc_feature 1..24: note = derived and/or modified sequence opt4 from anti-HIV_CDR
  source 1..24: mol_type = other RNA
cagagatgggagaccatcgactac

SEQ ID NO: 36323 - RNA, 24 nt, synthetic construct
  misc_feature 1..24: note = derived and/or modified sequence opt4 from anti-HIV_CDR
  source 1..24: mol_type = other RNA
tgcagctacgccggcagctacacc

SEQ ID NO: 36324 - RNA, 24 nt, synthetic construct
  misc_feature 1..24: note = derived and/or modified sequence opt4 from anti-HIV_CDR
  source 1..24: mol_type = other RNA
cagcagtacgacaacctgcccacc

SEQ ID NO: 36325 - RNA, 24 nt, synthetic construct
  misc_feature 1..24: note = derived and/or modified sequence opt4 from anti-HIV_CDR
  source 1..24: mol_type = other RNA
cagcagtgcaccctgcccctgacc

SEQ ID NO: 36326 - RNA, 24 nt, synthetic construct
  misc_feature 1..24: note = derived and/or modified sequence opt4 from anti-HIV_CDR
  source 1..24: mol_type = other RNA
cagcagagctacagcagcgtgacc

SEQ ID NO: 36327 - RNA, 24 nt, synthetic construct
  misc_feature 1..24: note = derived and/or modified sequence opt4 from anti-HIV_CDR
  source 1..24: mol_type = other RNA
cagcagagccacaccagcgtgacc

SEQ ID NO: 36328 - RNA, 24 nt, synthetic construct
  misc_feature 1..24: note = derived and/or modified sequence opt4 from anti-HIV_CDR
  source 1..24: mol_type = other RNA
cagcagacctacgccagcgtgacc

SEQ ID NO: 36329 - RNA, 24 nt, synthetic construct
  misc_feature 1..24: note = derived and/or modified sequence opt4 from anti-HIV_CDR
  source 1..24: mol_type = other RNA
cagcagtacaacagcgactacacc

SEQ ID NO: 36330 - RNA, 24 nt, synthetic construct
  misc_feature 1..24: note = derived and/or modified sequence opt4 from anti-HIV_CDR
  source 1..24: mol_type = other RNA
cacctgtacgtgagcagacccgtg

SEQ ID NO: 36331 - RNA, 24 nt, synthetic construct
  misc_feature 1..24: note = derived and/or modified sequence opt4 from anti-HIV_CDR
  source 1..24: mol_type = other RNA
cagcagtacggcagaagccccctg

SEQ ID NO: 36332 - RNA, 24 nt, synthetic construct
  misc_feature 1..24: note = derived and/or modified sequence opt4 from anti-HIV_CDR
  source 1..24: mol_type = other RNA
cagcagtacggcagcagccccctg

SEQ ID NO: 36333 - RNA, 24 nt, synthetic construct
  misc_feature 1..24: note = derived and/or modified sequence opt4 from anti-HIV_CDR
  source 1..24: mol_type = other RNA
cagcagtacaacgactggcccgcc

SEQ ID NO: 36334 - RNA, 24 nt, synthetic construct
  misc_feature 1..24: note = derived and/or modified sequence opt4 from anti-HIV_CDR
  source 1..24: mol_type = other RNA
caccagtacggcagcagccagaga

SEQ ID NO: 36335 - RNA, 24 nt, synthetic construct
  misc_feature 1..24: note = derived and/or modified sequence opt4 from anti-HIV_CDR
  source 1..24: mol_type = other RNA
cagcagacctacagcagcgtgacc

SEQ ID NO: 36336 - RNA, 24 nt, synthetic construct
  misc_feature 1..24: note = derived and/or modified sequence opt4 from anti-HIV_CDR
  source 1..24: mol_type = other RNA
cagcagacctacagaagcgtgacc

SEQ ID NO: 36337 - RNA, 24 nt, synthetic construct
  misc_feature 1..24: note = derived and/or modified sequence opt4 from anti-HIV_CDR
  source 1..24: mol_type = other RNA
cagcagtacggcagcagctggacc

SEQ ID NO: 36338 - RNA, 24 nt, synthetic construct
  misc_feature 1..24: note = derived and/or modified sequence opt4 from anti-HIV_CDR
  source 1..24: mol_type = other RNA
agcagctacgccggcatcaacaac

SEQ ID NO: 36339 - RNA, 24 nt, synthetic construct
  misc_feature 1..24: note = derived and/or modified sequence opt4 from anti-HIV_CDR
  source 1..24: mol_type = other RNA
cagaagtacggcagcagcctgacc

SEQ ID NO: 36340 - RNA, 24 nt, synthetic construct
  misc_feature 1..24: note = derived and/or modified sequence opt4 from anti-HIV_CDR
  source 1..24: mol_type = other RNA
atgcaggccctggagaccctgggc

SEQ ID NO: 36341 - RNA, 24 nt, synthetic construct
  misc_feature 1..24: note = derived and/or modified sequence opt4 from anti-HIV_CDR
  source 1..24: mol_type = other RNA
cagcagtacgccggcagcctgacc

SEQ ID NO: 36342 - RNA, 24 nt, synthetic construct
  misc_feature 1..24: note = derived and/or modified sequence opt4 from anti-HIV_CDR
  source 1..24: mol_type = other RNA
agaaactggggcaacttcgaccac

SEQ ID NO: 36343 - RNA, 27 nt, synthetic construct
  misc_feature 1..27: note = derived and/or modified sequence opt4 from anti-HIV_CDR
  source 1..27: mol_type = other RNA
cagcagcactacaccaccccctggacc

SEQ ID NO: 36344 - RNA, 27 nt, synthetic construct
  misc_feature 1..27: note = derived and/or modified sequence opt4 from anti-HIV_CDR
  source 1..27: mol_type = other RNA
cagcagagcttcgccgtgccctacacc

SEQ ID NO: 36345 - RNA, 27 nt, synthetic construct
  misc_feature 1..27: note = derived and/or modified sequence opt4 from anti-HIV_CDR
  source 1..27: mol_type = other RNA
cagcagtacaagagctacagcggcacc

SEQ ID NO: 36346 - RNA, 27 nt, synthetic construct
  misc_feature 1..27: note = derived and/or modified sequence opt4 from anti-HIV_CDR
  source 1..27: mol_type = other RNA
caccagtacgcctacagccccagaacc

SEQ ID NO: 36347 - RNA, 27 nt, synthetic construct
  misc_feature 1..27: note = derived and/or modified sequence opt4 from anti-HIV_CDR
  source 1..27: mol_type = other RNA
cagcagtacaacagcttcccccccacc

SEQ ID NO: 36348 - RNA, 27 nt, synthetic construct
  misc_feature 1..27: note = derived and/or modified sequence opt4 from anti-HIV_CDR
  source 1..27: mol_type = other RNA
cagcagacctacagcaaccccagaatg

SEQ ID NO: 36349 - RNA, 27 nt, synthetic construct
  misc_feature 1..27: note = derived and/or modified sequence opt4 from anti-HIV_CDR
  source 1..27: mol_type = other RNA
cagcagtacgaggaccccccctggacc

SEQ ID NO: 36350 - RNA, 27 nt, synthetic construct
  misc_feature 1..27: note = derived and/or modified sequence opt4 from anti-HIV_CDR
  source 1..27: mol_type = other RNA
caccagtacttcaacacccccagaacc

SEQ ID NO: 36351 - RNA, 27 nt, synthetic construct
  misc_feature 1..27: note = derived and/or modified sequence opt4 from anti-HIV_CDR
  source 1..27: mol_type = other RNA
caccagtacttcagcacccccagaacc

SEQ ID NO: 36352 - RNA, 27 nt, synthetic construct
  misc_feature 1..27: note = derived and/or modified sequence opt4 from anti-HIV_CDR
  source 1..27: mol_type = other RNA
cagcacagaagcaactggccctggacc

SEQ ID NO: 36353 - RNA, 27 nt, synthetic construct
  misc_feature 1..27: note = derived and/or modified sequence opt4 from anti-HIV_CDR
  source 1..27: mol_type = other RNA
agaggcagaagacagatcggcgactac

SEQ ID NO: 36354 - RNA, 27 nt, synthetic construct
  misc_feature 1..27: note = derived and/or modified sequence opt4 from anti-HIV_CDR
  source 1..27: mol_type = other RNA
cagcagtacggcctgagcccctggacc

SEQ ID NO: 36355 - RNA, 27 nt, synthetic construct
  misc_feature 1..27: note = derived and/or modified sequence opt4 from anti-HIV_CDR
  source 1..27: mol_type = other RNA
cagcagacctacaccagccccatcacc

SEQ ID NO: 36356 - RNA, 27 nt, synthetic construct
  misc_feature 1..27: note = derived and/or modified sequence opt4 from anti-HIV_CDR
  source 1..27: mol_type = other RNA
cagcagtacggcagcagcccccccacc

SEQ ID NO: 36357 - RNA, 27 nt, synthetic construct
  misc_feature 1..27: note = derived and/or modified sequence opt4 from anti-HIV_CDR
  source 1..27: mol_type = other RNA
cagcagtacggcaccagcagctgcacc

SEQ ID NO: 36358 - RNA, 27 nt, synthetic construct
  misc_feature 1..27: note = derived and/or modified sequence opt4 from anti-HIV_CDR
  source 1..27: mol_type = other RNA
cagcagtacgacgacgcccccatcacc

SEQ ID NO: 36359 - RNA, 27 nt, synthetic construct
  misc_feature 1..27: note = derived and/or modified sequence opt4 from anti-HIV_CDR
  source 1..27: mol_type = other RNA
ggccccctgctgagatacctggacagc

SEQ ID NO: 36360 - RNA, 27 nt, synthetic construct
  misc_feature 1..27: note = derived and/or modified sequence opt4 from anti-HIV_CDR
  source 1..27: mol_type = other RNA
tgcctgaagaagaccagcagctacgtg

SEQ ID NO: 36361 - RNA, 27 nt, synthetic construct
  misc_feature 1..27: note = derived and/or modified sequence opt4 from anti-HIV_CDR
  source 1..27: mol_type = other RNA
cagcagtacaaccactggccccagacc

SEQ ID NO: 36362 - RNA, 27 nt, synthetic construct
  misc_feature 1..27: note = derived and/or modified sequence opt4 from anti-HIV_CDR
  source 1..27: mol_type = other RNA
cagcagtacagcaacctgccctacacc

SEQ ID NO: 36363 - RNA, 27 nt, synthetic construct
  misc_feature 1..27: note = derived and/or modified sequence opt4 from anti-HIV_CDR
  source 1..27: mol_type = other RNA
cagcagtacgacacctaccccggcacc

SEQ ID NO: 36364 - RNA, 27 nt, synthetic construct
  misc_feature 1..27: note = derived and/or modified sequence opt4 from anti-HIV_CDR
  source 1..27: mol_type = other RNA
caggagtacagcagcaccccctacaac

SEQ ID NO: 36365 - RNA, 27 nt, synthetic construct
  misc_feature 1..27: note = derived and/or modified sequence opt4 from anti-HIV_CDR
  source 1..27: mol_type = other RNA
ggcgcctgggacgacaccctgtacgtg

SEQ ID NO: 36366 - RNA, 27 nt, synthetic construct
  misc_feature 1..27: note = derived and/or modified sequence opt4 from anti-HIV_CDR
  source 1..27: mol_type = other RNA
gccgcctgggacgacaccctgtacgtg

SEQ ID NO: 36367 - RNA, 27 nt, synthetic construct
  misc_feature 1..27: note = derived and/or modified sequence opt4 from anti-HIV_CDR
  source 1..27: mol_type = other RNA
cagcagtactacagcgacagcatcacc

SEQ ID NO: 36368 - RNA, 27 nt, synthetic construct
  misc_feature 1..27: note = derived and/or modified sequence opt4 from anti-HIV_CDR
  source 1..27: mol_type = other RNA
cagcagtacggcagaagcccctacacc

SEQ ID NO: 36369 - RNA, 27 nt, synthetic construct
  misc_feature 1..27: note = derived and/or modified sequence opt4 from anti-HIV_CDR
  source 1..27: mol_type = other RNA
cagcagtacaccaactacccctggacc

SEQ ID NO: 36370 - RNA, 27 nt, synthetic construct
  misc_feature 1..27: note = derived and/or modified sequence opt4 from anti-HIV_CDR
  source 1..27: mol_type = other RNA
cagcagagacacaactggcccatcagc

SEQ ID NO: 36371 - RNA, 27 nt, synthetic construct
  misc_feature 1..27: note = derived and/or modified sequence opt4 from anti-HIV_CDR
  source 1..27: mol_type = other RNA
cagcagtaccacaactggcccagaacc

SEQ ID NO: 36372 - RNA, 27 nt, synthetic construct
  misc_feature 1..27: note = derived and/or modified sequence opt4 from anti-HIV_CDR
  source 1..27: mol_type = other RNA
cagcagagaagcacctggccccccacc

SEQ ID NO: 36373 - RNA, 27 nt, synthetic construct
  misc_feature 1..27: note = derived and/or modified sequence opt4 from anti-HIV_CDR
  source 1..27: mol_type = other RNA
cagcagtacgacagcttcagctggacc

SEQ ID NO: 36374 - RNA, 27 nt, synthetic construct
  misc_feature 1..27: note = derived and/or modified sequence opt4 from anti-HIV_CDR
  source 1..27: mol_type = other RNA
cagcagtacaacaacctgcccgtgacc

SEQ ID NO: 36375 - RNA, 27 nt, synthetic construct
  misc_feature 1..27: note = derived and/or modified sequence opt4 from anti-HIV_CDR
  source 1..27: mol_type = other RNA
cagcagtacaacagatacagctacacc

SEQ ID NO: 36376 - RNA, 27 nt, synthetic construct
  misc_feature 1..27: note = derived and/or modified sequence opt4 from anti-HIV_CDR
  source 1..27: mol_type = other RNA
caggagtactacatcctgccctgcagc

SEQ ID NO: 36377 - RNA, 27 nt, synthetic construct
  misc_feature 1..27: note = derived and/or modified sequence opt4 from anti-HIV_CDR
  source 1..27: mol_type = other RNA
cagcagtacgacaacctgctggcccac

SEQ ID NO: 36378 - RNA, 27 nt, synthetic construct
  misc_feature 1..27: note = derived and/or modified sequence opt4 from anti-HIV_CDR
  source 1..27: mol_type = other RNA
caccagtgcgacaacctgatcgccaga

SEQ ID NO: 36379 - RNA, 27 nt, synthetic construct
  misc_feature 1..27: note = derived and/or modified sequence opt4 from anti-HIV_CDR
  source 1..27: mol_type = other RNA
cagcagagcttcagcaccctgtggacc

SEQ ID NO: 36380 - RNA, 27 nt, synthetic construct
  misc_feature 1..27: note = derived and/or modified sequence opt4 from anti-HIV_CDR
  source 1..27: mol_type = other RNA
caccagagctacagcaccccccccacc

SEQ ID NO: 36381 - RNA, 27 nt, synthetic construct
  misc_feature 1..27: note = derived and/or modified sequence opt4 from anti-HIV_CDR
  source 1..27: mol_type = other RNA
cagcagggctacagcaccccctggacc

SEQ ID NO: 36382 - RNA, 27 nt, synthetic construct
  misc_feature 1..27: note = derived and/or modified sequence opt4 from anti-HIV_CDR
  source 1..27: mol_type = other RNA
cagcagtacagcaccacccccagaacc

SEQ ID NO: 36383 - RNA, 27 nt, synthetic construct
  misc_feature 1..27: note = derived and/or modified sequence opt4 from anti-HIV_CDR
  source 1..27: mol_type = other RNA
cagctgtacaacagcgtgccccagacc

SEQ ID NO: 36384 - RNA, 27 nt, synthetic construct
  misc_feature 1..27: note = derived and/or modified sequence opt4 from anti-HIV_CDR
  source 1..27: mol_type = other RNA
cagcagagaaccagctggccccagacc

SEQ ID NO: 36385 - RNA, 27 nt, synthetic construct
  misc_feature 1..27: note = derived and/or modified sequence opt4 from anti-HIV_CDR
  source 1..27: mol_type = other RNA
cagcagttcaacacctacagccagacc

SEQ ID NO: 36386 - RNA, 27 nt, synthetic construct
  misc_feature 1..27: note = derived and/or modified sequence opt4 from anti-HIV_CDR
  source 1..27: mol_type = other RNA
atgcagagcctgcagacccccatcacc

SEQ ID NO: 36387 - RNA, 27 nt, synthetic construct
  misc_feature 1..27: note = derived and/or modified sequence opt4 from anti-HIV_CDR
  source 1..27: mol_type = other RNA
cagcagtacaacagctaccccctgacc

SEQ ID NO: 36388 - RNA, 27 nt, synthetic construct
  misc_feature 1..27: note = derived and/or modified sequence opt4 from anti-HIV_CDR
  source 1..27: mol_type = other RNA
cagcagtacaacagctacagcggcacc

SEQ ID NO: 36389 - RNA, 27 nt, synthetic construct
  misc_feature 1..27: note = derived and/or modified sequence opt4 from anti-HIV_CDR
  source 1..27: mol_type = other RNA
cagagctacgacagcagcctgagcggc

SEQ ID NO: 36390 - RNA, 27 nt, synthetic construct
  misc_feature 1..27: note = derived and/or modified sequence opt4 from anti-HIV_CDR
  source 1..27: mol_type = other RNA
agccagggcaacaccgccatcgactac

SEQ ID NO: 36391 - RNA, 27 nt, synthetic construct
  misc_feature 1..27: note = derived and/or modified sequence opt4 from anti-HIV_CDR
  source 1..27: mol_type = other RNA
gaggagcccagagacgccttcgacctg

SEQ ID NO: 36392 - RNA, 27 nt, synthetic construct
  misc_feature 1..27: note = derived and/or modified sequence opt4 from anti-HIV_CDR
  source 1..27: mol_type = other RNA
cagcagagctacaccacccccgtgacc

SEQ ID NO: 36393 - RNA, 27 nt, synthetic construct
  misc_feature 1..27: note = derived and/or modified sequence opt4 from anti-HIV_CDR
  source 1..27: mol_type = other RNA
gccggcagagagggctggttcgacccc

SEQ ID NO: 36394 - RNA, 27 nt, synthetic construct
  misc_feature 1..27: note = derived and/or modified sequence opt4 from anti-HIV_CDR
  source 1..27: mol_type = other RNA
cagcagtactacagcaccccccacacc

SEQ ID NO: 36395 - RNA, 27 nt, synthetic construct
  misc_feature 1..27: note = derived and/or modified sequence opt4 from anti-HIV_CDR
  source 1..27: mol_type = other RNA
cagcagagctacagcatcgccggcacc

SEQ ID NO: 36396 - RNA, 27 nt, synthetic construct
  misc_feature 1..27: note = derived and/or modified sequence opt4 from anti-HIV_CDR
  source 1..27: mol_type = other RNA
cagaactacaacaagccccccagaacc

SEQ ID NO: 36397 - RNA, 27 nt, synthetic construct
  misc_feature 1..27: note = derived and/or modified sequence opt4 from anti-HIV_CDR
  source 1..27: mol_type = other RNA
atgcagagcatccagctgcccctgacc

SEQ ID NO: 36398 - RNA, 27 nt, synthetic construct
  misc_feature 1..27: note = derived and/or modified sequence opt4 from anti-HIV_CDR
  source 1..27: mol_type = other RNA
atgcaggccctgcagaccagcctgacc

SEQ ID NO: 36399 - RNA, 27 nt, synthetic construct
  misc_feature 1..27: note = derived and/or modified sequence opt4 from anti-HIV_CDR
  source 1..27: mol_type = other RNA
cagcagtacagcagcagccccagaacc

SEQ ID NO: 36400 - RNA, 27 nt, synthetic construct
  misc_feature 1..27: note = derived and/or modified sequence opt4 from anti-HIV_CDR
  source 1..27: mol_type = other RNA
caggcctgggacagcagcaccgccgtg

SEQ ID NO: 36401 - RNA, 27 nt, synthetic construct
  misc_feature 1..27: note = derived and/or modified sequence opt4 from anti-HIV_CDR
  source 1..27: mol_type = other RNA
cagcactacaacaactggccctacacc

SEQ ID NO: 36402 - RNA, 27 nt, synthetic construct
  misc_feature 1..27: note = derived and/or modified sequence opt4 from anti-HIV_CDR
  source 1..27: mol_type = other RNA
cagcagtacgacagactgcccatcacc

SEQ ID NO: 36403 - RNA, 27 nt, synthetic construct
  misc_feature 1..27: note = derived and/or modified sequence opt4 from anti-HIV_CDR
  source 1..27: mol_type = other RNA
cagcagtacggcagcagccccatcacc

SEQ ID NO: 36404 - RNA, 27 nt, synthetic construct
  misc_feature 1..27: note = derived and/or modified sequence opt4 from anti-HIV_CDR
  source 1..27: mol_type = other RNA
cagcagtacgacgtgtggcccctgacc

SEQ ID NO: 36405 - RNA, 27 nt, synthetic construct
  misc_feature 1..27: note = derived and/or modified sequence opt4 from anti-HIV_CDR
  source 1..27: mol_type = other RNA
caccagtacgccagcagccccagaacc

SEQ ID NO: 36406 - RNA, 27 nt, synthetic construct
  misc_feature 1..27: note = derived and/or modified sequence opt4 from anti-HIV_CDR
  source 1..27: mol_type = other RNA
atgcagagcctgcacctgccctacacc

SEQ ID NO: 36407 - RNA, 27 nt, synthetic construct
  misc_feature 1..27: note = derived and/or modified sequence opt4 from anti-HIV_CDR
  source 1..27: mol_type = other RNA
cagcagtactacagcagccccctgacc

SEQ ID NO: 36408 - RNA, 27 nt, synthetic construct
  misc_feature 1..27: note = derived and/or modified sequence opt4 from anti-HIV_CDR
  source 1..27: mol_type = other RNA
cagcagcacgacaccttccccttcacc

SEQ ID NO: 36409 - RNA, 27 nt, synthetic construct
  misc_feature 1..27: note = derived and/or modified sequence opt4 from anti-HIV_CDR
  source 1..27: mol_type = other RNA
cagcagagctacagcaccccctacacc

SEQ ID NO: 36410 - RNA, 27 nt, synthetic construct
  misc_feature 1..27: note = derived and/or modified sequence opt4 from anti-HIV_CDR
  source 1..27: mol_type = other RNA
cagcagtacaagacctaccccgtgacc

SEQ ID NO: 36411 - RNA, 27 nt, synthetic construct
  misc_feature 1..27: note = derived and/or modified sequence opt4 from anti-HIV_CDR
  source 1..27: mol_type = other RNA
cagcagtactacagcacccccgtgacc

SEQ ID NO: 36412 - RNA, 27 nt, synthetic construct
  misc_feature 1..27: note = derived and/or modified sequence opt4 from anti-HIV_CDR
  source 1..27: mol_type = other RNA
cagcagtacaactggccccccttcacc

SEQ ID NO: 36413 - RNA, 27 nt, synthetic construct
  misc_feature 1..27: note = derived and/or modified sequence opt4 from anti-HIV_CDR
  source 1..27: mol_type = other RNA
atgcagggcacccactggccctggacc

SEQ ID NO: 36414 - RNA, 27 nt, synthetic construct
  misc_feature 1..27: note = derived and/or modified sequence opt4 from anti-HIV_CDR
  source 1..27: mol_type = other RNA
caccagtgcggcagcagccccagaacc

SEQ ID NO: 36415 - RNA, 27 nt, synthetic construct
  misc_feature 1..27: note = derived and/or modified sequence opt4 from anti-HIV_CDR
  source 1..27: mol_type = other RNA
cagcagtacaacagctacttcagaacc

SEQ ID NO: 36416 - RNA, 27 nt, synthetic construct
  misc_feature 1..27: note = derived and/or modified sequence opt4 from anti-HIV_CDR
  source 1..27: mol_type = other RNA
cagcagtaccacaactggccccccagc

SEQ ID NO: 36417 - RNA, 27 nt, synthetic construct
  misc_feature 1..27: note = derived and/or modified sequence opt4 from anti-HIV_CDR
  source 1..27: mol_type = other RNA
atgcagggcacctactggctgtggacc

SEQ ID NO: 36418 - RNA, 27 nt, synthetic construct
  misc_feature 1..27: note = derived and/or modified sequence opt4 from anti-HIV_CDR
  source 1..27: mol_type = other RNA
cagcagggcttcagcgcccccttcacc

SEQ ID NO: 36419 - RNA, 27 nt, synthetic construct
  misc_feature 1..27: note = derived and/or modified sequence opt4 from anti-HIV_CDR
  source 1..27: mol_type = other RNA
cagcagtacaacacctaccccctgacc

SEQ ID NO: 36420 - RNA, 27 nt, synthetic construct
  misc_feature 1..27: note = derived and/or modified sequence opt4 from anti-HIV_CDR
  source 1..27: mol_type = other RNA
atgcagggcacccactggcccagaacc

SEQ ID NO: 36421 - RNA, 27 nt, synthetic construct
  misc_feature 1..27: note = derived and/or modified sequence opt4 from anti-HIV_CDR
  source 1..27: mol_type = other RNA
ttcggcagaaccccctggttcgacccc

SEQ ID NO: 36422 - RNA, 27 nt, synthetic construct
  misc_feature 1..27: note = derived and/or modified sequence opt4 from anti-HIV_CDR
  source 1..27: mol_type = other RNA
cagcagtacttcaccagcgtgatcacc

SEQ ID NO: 36423 - RNA, 27 nt, synthetic construct
  misc_feature 1..27: note = derived and/or modified sequence opt4 from anti-HIV_CDR
  source 1..27: mol_type = other RNA
caccactacatgagcgacctgcagacc

SEQ ID NO: 36424 - RNA, 27 nt, synthetic construct
  misc_feature 1..27: note = derived and/or modified sequence opt4 from anti-HIV_CDR
  source 1..27: mol_type = other RNA
caccactacagcagcagcagccacacc

SEQ ID NO: 36425 - RNA, 27 nt, synthetic construct
  misc_feature 1..27: note = derived and/or modified sequence opt4 from anti-HIV_CDR
  source 1..27: mol_type = other RNA
caccactacaagagcgactgccagacc

SEQ ID NO: 36426 - RNA, 27 nt, synthetic construct
  misc_feature 1..27: note = derived and/or modified sequence opt4 from anti-HIV_CDR
  source 1..27: mol_type = other RNA
cagcacagaagcagctggcccctgacc

SEQ ID NO: 36427 - RNA, 27 nt, synthetic construct
  misc_feature 1..27: note = derived and/or modified sequence opt4 from anti-HIV_CDR
  source 1..27: mol_type = other RNA
ctgcagcaccacagctacccctggacc

SEQ ID NO: 36428 - RNA, 27 nt, synthetic construct
  misc_feature 1..27: note = derived and/or modified sequence opt4 from anti-HIV_CDR
  source 1..27: mol_type = other RNA
cagcagtacggcaccagccccggcacc

SEQ ID NO: 36429 - RNA, 27 nt, synthetic construct
  misc_feature 1..27: note = derived and/or modified sequence opt4 from anti-HIV_CDR
  source 1..27: mol_type = other RNA
cagcagtacggcagcagccccaccacc

SEQ ID NO: 36430 - RNA, 27 nt, synthetic construct
  misc_feature 1..27: note = derived and/or modified sequence opt4 from anti-HIV_CDR
  source 1..27: mol_type = other RNA
cagcagtacggcaccagccccaccacc

SEQ ID NO: 36431 - RNA, 27 nt, synthetic construct
  misc_feature 1..27: note = derived and/or modified sequence opt4 from anti-HIV_CDR
  source 1..27: mol_type = other RNA
atgcaggccacccactggccccccggc

SEQ ID NO: 36432 - RNA, 27 nt, synthetic construct
  misc_feature 1..27: note = derived and/or modified sequence opt4 from anti-HIV_CDR
  source 1..27: mol_type = other RNA
cagagatacaacagagacccctacatc

SEQ ID NO: 36433 - RNA, 27 nt, synthetic construct
  misc_feature 1..27: note = derived and/or modified sequence opt4 from anti-HIV_CDR
  source 1..27: mol_type = other RNA
cagcagtacgacaacctgcccctggcc

SEQ ID NO: 36434 - RNA, 27 nt, synthetic construct
  misc_feature 1..27: note = derived and/or modified sequence opt4 from anti-HIV_CDR
  source 1..27: mol_type = other RNA
agcagctacagcgccaccggcgtggcc

SEQ ID NO: 36435 - RNA, 27 nt, synthetic construct
  misc_feature 1..27: note = derived and/or modified sequence opt4 from anti-HIV_CDR
  source 1..27: mol_type = other RNA
cagcactacggcaacagcagatggacc

SEQ ID NO: 36436 - RNA, 27 nt, synthetic construct
  misc_feature 1..27: note = derived and/or modified sequence opt4 from anti-HIV_CDR
  source 1..27: mol_type = other RNA
cagcagtacgagacctacccctggacc

SEQ ID NO: 36437 - RNA, 27 nt, synthetic construct
  misc_feature 1..27: note = derived and/or modified sequence opt4 from anti-HIV_CDR
  source 1..27: mol_type = other RNA
cagcagtacggcagcagccccagcacc

SEQ ID NO: 36438 - RNA, 27 nt, synthetic construct
  misc_feature 1..27: note = derived and/or modified sequence opt4 from anti-HIV_CDR
  source 1..27: mol_type = other RNA
cagcagagccagagaaccccccacacc

SEQ ID NO: 36439 - RNA, 27 nt, synthetic construct
  misc_feature 1..27: note = derived and/or modified sequence opt4 from anti-HIV_CDR
  source 1..27: mol_type = other RNA
cagcagtacgacatcctgcccctgacc

SEQ ID NO: 36440 - RNA, 27 nt, synthetic construct
  misc_feature 1..27: note = derived and/or modified sequence opt4 from anti-HIV_CDR
  source 1..27: mol_type = other RNA
cagcagagcaacagcagcccctggacc

SEQ ID NO: 36441 - RNA, 27 nt, synthetic construct
  misc_feature 1..27: note = derived and/or modified sequence opt4 from anti-HIV_CDR
  source 1..27: mol_type = other RNA
cagcagagctacgacacccccagaacc

SEQ ID NO: 36442 - RNA, 27 nt, synthetic construct
  misc_feature 1..27: note = derived and/or modified sequence opt4 from anti-HIV_CDR
  source 1..27: mol_type = other RNA
cagcagttcggcagcagccccggcacc

SEQ ID NO: 36443 - RNA, 27 nt, synthetic construct
  misc_feature 1..27: note = derived and/or modified sequence opt4 from anti-HIV_CDR
  source 1..27: mol_type = other RNA
caccagtacggcagcagcccccagacc

SEQ ID NO: 36444 - RNA, 27 nt, synthetic construct
  misc_feature 1..27: note = derived and/or modified sequence opt4 from anti-HIV_CDR
  source 1..27: mol_type = other RNA
caccagtacggcagcagcccccagagc

SEQ ID NO: 36445 - RNA, 27 nt, synthetic construct
  misc_feature 1..27: note = derived and/or modified sequence opt4 from anti-HIV_CDR
  source 1..27: mol_type = other RNA
ctgcagcacaacagctaccccctgacc

SEQ ID NO: 36446 - RNA, 27 nt, synthetic construct
  misc_feature 1..27: note = derived and/or modified sequence opt4 from anti-HIV_CDR
  source 1..27: mol_type = other RNA
cagcagtacaacgactggcccatcacc

SEQ ID NO: 36447 - RNA, 27 nt, synthetic construct
  misc_feature 1..27: note = derived and/or modified sequence opt4 from anti-HIV_CDR
  source 1..27: mol_type = other RNA
cagcagaccttcaccttcccctacacc

SEQ ID NO: 36448 - RNA, 27 nt, synthetic construct
  misc_feature 1..27: note = derived and/or modified sequence opt4 from anti-HIV_CDR
  source 1..27: mol_type = other RNA
cagcagagctacaccttcccctacatc

SEQ ID NO: 36449 - RNA, 27 nt, synthetic construct
  misc_feature 1..27: note = derived and/or modified sequence opt4 from anti-HIV_CDR
  source 1..27: mol_type = other RNA
cagtactacggcagcagcccctacacc

SEQ ID NO: 36450 - RNA, 27 nt, synthetic construct
  misc_feature 1..27: note = derived and/or modified sequence opt4 from anti-HIV_CDR
  source 1..27: mol_type = other RNA
cagcagagcttcggcacccccagaacc

SEQ ID NO: 36451 - RNA, 27 nt, synthetic construct
  misc_feature 1..27: note = derived and/or modified sequence opt4 from anti-HIV_CDR
  source 1..27: mol_type = other RNA
cagcagtacaacgactggcccagaacc

SEQ ID NO: 36452 - RNA, 27 nt, synthetic construct
  misc_feature 1..27: note = derived and/or modified sequence opt4 from anti-HIV_CDR
  source 1..27: mol_type = other RNA
cagcagtacggcagcagccccagaacc

SEQ ID NO: 36453 - RNA, 27 nt, synthetic construct
  misc_feature 1..27: note = derived and/or modified sequence opt4 from anti-HIV_CDR
  source 1..27: mol_type = other RNA
ctgcagcacaacagatacccctggacc

SEQ ID NO: 36454 - RNA, 27 nt, synthetic construct
  misc_feature 1..27: note = derived and/or modified sequence opt4 from anti-HIV_CDR
  source 1..27: mol_type = other RNA
ctgcagcacaacaactacccctggacc

SEQ ID NO: 36455 - RNA, 27 nt, synthetic construct
  misc_feature 1..27: note = derived and/or modified sequence opt4 from anti-HIV_CDR
  source 1..27: mol_type = other RNA
ctgcagtacagcacctaccccctgacc

SEQ ID NO: 36456 - RNA, 27 nt, synthetic construct
  misc_feature 1..27: note = derived and/or modified sequence opt4 from anti-HIV_CDR
  source 1..27: mol_type = other RNA
ctgcagtacaacgcctaccccctgacc

SEQ ID NO: 36457 - RNA, 27 nt, synthetic construct
  misc_feature 1..27: note = derived and/or modified sequence opt4 from anti-HIV_CDR
  source 1..27: mol_type = other RNA
cagcagtacgacagcgcccccgtgacc

SEQ ID NO: 36458 - RNA, 27 nt, synthetic construct
  misc_feature 1..27: note = derived and/or modified sequence opt4 from anti-HIV_CDR
  source 1..27: mol_type = other RNA
cagcagacctacaccttcccctacagc

SEQ ID NO: 36459 - RNA, 27 nt, synthetic construct
  misc_feature 1..27: note = derived and/or modified sequence opt4 from anti-HIV_CDR
  source 1..27: mol_type = other RNA
ggctacgacaacagcggccccgactac

SEQ ID NO: 36460 - RNA, 27 nt, synthetic construct
  misc_feature 1..27: note = derived and/or modified sequence opt4 from anti-HIV_CDR
  source 1..27: mol_type = other RNA
cagcagtacaacaactggccccccgcc

SEQ ID NO: 36461 - RNA, 27 nt, synthetic construct
  misc_feature 1..27: note = derived and/or modified sequence opt4 from anti-HIV_CDR
  source 1..27: mol_type = other RNA
caccagtacgccctgagcccctggacc

SEQ ID NO: 36462 - RNA, 27 nt, synthetic construct
  misc_feature 1..27: note = derived and/or modified sequence opt4 from anti-HIV_CDR
  source 1..27: mol_type = other RNA
cagaagtacgacaccgaccccatgacc

SEQ ID NO: 36463 - RNA, 27 nt, synthetic construct
  misc_feature 1..27: note = derived and/or modified sequence opt4 from anti-HIV_CDR
  source 1..27: mol_type = other RNA
cagcagtacaactactaccccatcacc

SEQ ID NO: 36464 - RNA, 27 nt, synthetic construct
  misc_feature 1..27: note = derived and/or modified sequence opt4 from anti-HIV_CDR
  source 1..27: mol_type = other RNA
cagcagaccttcaccgaccccgtgacc

SEQ ID NO: 36465 - RNA, 27 nt, synthetic construct
  misc_feature 1..27: note = derived and/or modified sequence opt4 from anti-HIV_CDR
  source 1..27: mol_type = other RNA
gccgcctgggacgacagcctgcacgtg

SEQ ID NO: 36466 - RNA, 27 nt, synthetic construct
  misc_feature 1..27: note = derived and/or modified sequence opt4 from anti-HIV_CDR
  source 1..27: mol_type = other RNA
cagcagtacgccagcagccccttcacc

SEQ ID NO: 36467 - RNA, 27 nt, synthetic construct
  misc_feature 1..27: note = derived and/or modified sequence opt4 from anti-HIV_CDR
  source 1..27: mol_type = other RNA
cagcagagcagcagcacccccttcacc

SEQ ID NO: 36468 - RNA, 27 nt, synthetic construct
  misc_feature 1..27: note = derived and/or modified sequence opt4 from anti-HIV_CDR
  source 1..27: mol_type = other RNA
cagcagagaagcaactgggccatcacc

SEQ ID NO: 36469 - RNA, 27 nt, synthetic construct
  misc_feature 1..27: note = derived and/or modified sequence opt4 from anti-HIV_CDR
  source 1..27: mol_type = other RNA
cagcagtacggcagcagccccttcacc

SEQ ID NO: 36470 - RNA, 27 nt, synthetic construct
  misc_feature 1..27: note = derived and/or modified sequence opt4 from anti-HIV_CDR
  source 1..27: mol_type = other RNA
cagaagtacaacggcgccccctggacc

SEQ ID NO: 36471 - RNA, 27 nt, synthetic construct
  misc_feature 1..27: note = derived and/or modified sequence opt4 from anti-HIV_CDR
  source 1..27: mol_type = other RNA
cagaagtacaacaacgccccctggacc

SEQ ID NO: 36472 - RNA, 27 nt, synthetic construct
  misc_feature 1..27: note = derived and/or modified sequence opt4 from anti-HIV_CDR
  source 1..27: mol_type = other RNA
cagcagagagtgaactggccccccaac

SEQ ID NO: 36473 - RNA, 27 nt, synthetic construct
  misc_feature 1..27: note = derived and/or modified sequence opt4 from anti-HIV_CDR
  source 1..27: mol_type = other RNA
cagcagagaggccactggcccctgacc

SEQ ID NO: 36474 - RNA, 27 nt, synthetic construct
  misc_feature 1..27: note = derived and/or modified sequence opt4 from anti-HIV_CDR
  source 1..27: mol_type = other RNA
cagcagtacagatacagcgtgatcatc

SEQ ID NO: 36475 - RNA, 27 nt, synthetic construct
  misc_feature 1..27: note = derived and/or modified sequence opt4 from anti-HIV_CDR
  source 1..27: mol_type = other RNA
cagcagagcggcaccagcctgctgacc

SEQ ID NO: 36476 - RNA, 27 nt, synthetic construct
  misc_feature 1..27: note = derived and/or modified sequence opt4 from anti-HIV_CDR
  source 1..27: mol_type = other RNA
atgaagagccagcacagccccagaacc

SEQ ID NO: 36477 - RNA, 27 nt, synthetic construct
  misc_feature 1..27: note = derived and/or modified sequence opt4 from anti-HIV_CDR
  source 1..27: mol_type = other RNA
atgcagcccctgcagaccccctacacc

SEQ ID NO: 36478 - RNA, 27 nt, synthetic construct
  misc_feature 1..27: note = derived and/or modified sequence opt4 from anti-HIV_CDR
  source 1..27: mol_type = other RNA
cagcagtacaccgcctacccctggacc

SEQ ID NO: 36479 - RNA, 27 nt, synthetic construct
  misc_feature 1..27: note = derived and/or modified sequence opt4 from anti-HIV_CDR
  source 1..27: mol_type = other RNA
ctgcagaaccacaactaccccagaacc

SEQ ID NO: 36480 - RNA, 27 nt, synthetic construct
  misc_feature 1..27: note = derived and/or modified sequence opt4 from anti-HIV_CDR
  source 1..27: mol_type = other RNA
ctgcagacccacagctaccccagaacc

SEQ ID NO: 36481 - RNA, 30 nt, synthetic construct; identical to SEQ ID NO: 13555
  misc_feature 1..30: note = derived and/or modified sequence opt4 from anti-HIV_CDR
  source 1..30: mol_type = other RNA

SEQ ID NO: 36482 - RNA, 30 nt, synthetic construct
  misc_feature 1..30: note = derived and/or modified sequence opt4 from anti-HIV_CDR
  source 1..30: mol_type = other RNA
cagcacagcttcggcagccccccctggacc

SEQ ID NO: 36483 - RNA, 30 nt, synthetic construct
  misc_feature 1..30: note = derived and/or modified sequence opt4 from anti-HIV_CDR
  source 1..30: mol_type = other RNA
agcagcttcacccccaccaacaccctggtg

SEQ ID NO: 36484 - RNA, 30 nt, synthetic construct
  misc_feature 1..30: note = derived and/or modified sequence opt4 from anti-HIV_CDR
  source 1..30: mol_type = other RNA
cagcagtacggcaccctgcaccccagaacc

SEQ ID NO: 36485 - RNA, 30 nt, synthetic construct; identical to SEQ ID NO: 21201
  misc_feature 1..30: note = derived and/or modified sequence opt4 from anti-HIV_CDR
  source 1..30: mol_type = other RNA

SEQ ID NO: 36486 - RNA, 30 nt, synthetic construct; identical to SEQ ID NO: 13560
  misc_feature 1..30: note = derived and/or modified sequence opt4 from anti-HIV_CDR
  source 1..30: mol_type = other RNA

SEQ ID NO: 36487 - RNA, 30 nt, synthetic construct
  misc_feature 1..30: note = derived and/or modified sequence opt4 from anti-HIV_CDR
  source 1..30: mol_type = other RNA
cagcagagagccaactggagactgctgacc

SEQ ID NO: 36488 - RNA, 30 nt, synthetic construct
  misc_feature 1..30: note = derived and/or modified sequence opt4 from anti-HIV_CDR
  source 1..30: mol_type = other RNA
agacacagcgactactgcgacctggacgtg

SEQ ID NO: 36489 - RNA, 30 nt, synthetic construct
  misc_feature 1..30: note = derived and/or modified sequence opt4 from anti-HIV_CDR
  source 1..30: mol_type = other RNA
agaagaagcgactactgcgacttcgacgtg

SEQ ID NO: 36490 - RNA, 30 nt, synthetic construct
  misc_feature 1..30: note = derived and/or modified sequence opt4 from anti-HIV_CDR
  source 1..30: mol_type = other RNA
agacacaccgactactgcgacttcgacgtg

SEQ ID NO: 36491 - RNA, 30 nt, synthetic construct
  misc_feature 1..30: note = derived and/or modified sequence opt4 from anti-HIV_CDR
  source 1..30: mol_type = other RNA
cagagaagcgactactgggacttcgacgtg

SEQ ID NO: 36492 - RNA, 30 nt, synthetic construct
  misc_feature 1..30: note = derived and/or modified sequence opt4 from anti-HIV_CDR
  source 1..30: mol_type = other RNA
agacacagcgactactgcgacttcgacatc

SEQ ID NO: 36493 - RNA, 30 nt, synthetic construct; identical to SEQ ID NO: 13567
  misc_feature 1..30: note = derived and/or modified sequence opt4 from anti-HIV_CDR
  source 1..30: mol_type = other RNA

SEQ ID NO: 36494 - RNA, 30 nt, synthetic construct; identical to SEQ ID NO: 13568
  misc_feature 1..30: note = derived and/or modified sequence opt4 from anti-HIV_CDR
  source 1..30: mol_type = other RNA

SEQ ID NO: 36495 - RNA, 30 nt, synthetic construct
  misc_feature 1..30: note = derived and/or modified sequence opt4 from anti-HIV_CDR
  source 1..30: mol_type = other RNA
cagagaagcgacttctgggacttcgacgtg

SEQ ID NO: 36496 - RNA, 30 nt, synthetic construct
  misc_feature 1..30: note = derived and/or modified sequence opt4 from anti-HIV_CDR
  source 1..30: mol_type = other RNA
agacacagcgactactgcgacttcgacgtg

SEQ ID NO: 36497 - RNA, 30 nt, synthetic construct
  misc_feature 1..30: note = derived and/or modified sequence opt4 from anti-HIV_CDR
  source 1..30: mol_type = other RNA
tgcagctacgccggcggcagaaccgtggtg

SEQ ID NO: 36498 - RNA, 30 nt, synthetic construct; identical to SEQ ID NO: 13572
  misc_feature 1..30: note = derived and/or modified sequence opt4 from anti-HIV_CDR
  source 1..30: mol_type = other RNA

SEQ ID NO: 36499 - RNA, 30 nt, synthetic construct
  misc_feature 1..30: note = derived and/or modified sequence opt4 from anti-HIV_CDR
  source 1..30: mol_type = other RNA
cagcagagaagcaactggcccagactgacc

SEQ ID NO: 36500 - RNA, 30 nt, synthetic construct; identical to SEQ ID NO: 21216
  misc_feature 1..30: note = derived and/or modified sequence opt4 from anti-HIV_CDR
  source 1..30: mol_type = other RNA

SEQ ID NO: 36501 - RNA, 30 nt, synthetic construct
  misc_feature 1..30: note = derived and/or modified sequence opt4 from anti-HIV_CDR
  source 1..30: mol_type = other RNA
atgcagggcacctactggccccccctgacc

SEQ ID NO: 36502 - RNA, 30 nt, synthetic construct
  misc_feature 1..30: note = derived and/or modified sequence opt4 from anti-HIV_CDR
  source 1..30: mol_type = other RNA
cagcagtacggcagcagcctgctgtacacc

SEQ ID NO: 36503 - RNA, 30 nt, synthetic construct
  misc_feature 1..30: note = derived and/or modified sequence opt4 from anti-HIV_CDR
  source 1..30: mol_type = other RNA
cagcagagcttcggcatccccccctggacc

SEQ ID NO: 36504 - RNA, 30 nt, synthetic construct
  misc_feature 1..30: note = derived and/or modified sequence opt4 from anti-HIV_CDR
  source 1..30: mol_type = other RNA
tgcagctacgccggcagctacagctacgtg

SEQ ID NO: 36505 - RNA, 30 nt, synthetic construct
  misc_feature 1..30: note = derived and/or modified sequence opt4 from anti-HIV_CDR
  source 1..30: mol_type = other RNA
tacagctacgccggcaacagcctgggcgtg

SEQ ID NO: 36506 - RNA, 30 nt, synthetic construct
  misc_feature 1..30: note = derived and/or modified sequence opt4 from anti-HIV_CDR
  source 1..30: mol_type = other RNA
agcagctacaccatcagcagccccagagtg

SEQ ID NO: 36507 - RNA, 30 nt, synthetic construct; identical to SEQ ID NO: 13581
  misc_feature 1..30: note = derived and/or modified sequence opt4 from anti-HIV_CDR
  source 1..30: mol_type = other RNA

SEQ ID NO: 36508 - RNA, 30 nt, synthetic construct
  misc_feature 1..30: note = derived and/or modified sequence opt4 from anti-HIV_CDR
  source 1..30: mol_type = other RNA
ctgatccccgtgagcggcgccttcgacgtg

SEQ ID NO: 36509 - RNA, 30 nt, synthetic construct
  misc_feature 1..30: note = derived and/or modified sequence opt4 from anti-HIV_CDR
  source 1..30: mol_type = other RNA
gacagagactacgacgaggacttcgacttc

SEQ ID NO: 36510 - RNA, 30 nt, synthetic construct
  misc_feature 1..30: note = derived and/or modified sequence opt4 from anti-HIV_CDR
  source 1..30: mol_type = other RNA
caggagtacggcagaagcccccccttcccc

SEQ ID NO: 36511 - RNA, 30 nt, synthetic construct; identical to SEQ ID NO: 13585
  misc_feature 1..30: note = derived and/or modified sequence opt4 from anti-HIV_CDR
  source 1..30: mol_type = other RNA

SEQ ID NO: 36512 - RNA, 30 nt, synthetic construct
  misc_feature 1..30: note = derived and/or modified sequence opt4 from anti-HIV_CDR
  source 1..30: mol_type = other RNA
ttcacccagagacagggcggcttcgactac

SEQ ID NO: 36513 - RNA, 30 nt, synthetic construct; identical to SEQ ID NO: 21229
  misc_feature 1..30: note = derived and/or modified sequence opt4 from anti-HIV_CDR
  source 1..30: mol_type = other RNA

SEQ ID NO: 36514 - RNA, 30 nt, synthetic construct
  misc_feature 1..30: note = derived and/or modified sequence opt4 from anti-HIV_CDR
  source 1..30: mol_type = other RNA
cagcagtacggcagcagcgccccctacacc

SEQ ID NO: 36515 - RNA, 30 nt, synthetic construct
  misc_feature 1..30: note = derived and/or modified sequence opt4 from anti-HIV_CDR
  source 1..30: mol_type = other RNA
cagcagctgaacagcgaccccccctggacc

SEQ ID NO: 36516 - RNA, 30 nt, synthetic construct
  misc_feature 1..30: note = derived and/or modified sequence opt4 from anti-HIV_CDR
  source 1..30: mol_type = other RNA
cagcaccacggcagcagccccacctggacc

SEQ ID NO: 36517 - RNA, 30 nt, synthetic construct; identical to SEQ ID NO: 21233
  misc_feature 1..30: note = derived and/or modified sequence opt4 from anti-HIV_CDR
  source 1..30: mol_type = other RNA

SEQ ID NO: 36518 - RNA, 30 nt, synthetic construct; identical to SEQ ID NO: 13592
  misc_feature 1..30: note = derived and/or modified sequence opt4 from anti-HIV_CDR
  source 1..30: mol_type = other RNA

SEQ ID NO: 36519 - RNA, 30 nt, synthetic construct
  misc_feature 1..30: note = derived and/or modified sequence opt4 from anti-HIV_CDR
  source 1..30: mol_type = other RNA
cagagctacaacggcgacccccccgtgacc

SEQ ID NO: 36520 - RNA, 30 nt, synthetic construct
  misc_feature 1..30: note = derived and/or modified sequence opt4 from anti-HIV_CDR
  source 1..30: mol_type = other RNA
cagcagtacggcagcagcagaagatggacc

SEQ ID NO: 36521 - RNA, 30 nt, synthetic construct
  misc_feature 1..30: note = derived and/or modified sequence opt4 from anti-HIV_CDR
  source 1..30: mol_type = other RNA
cagcagttcaacagctacccccccctgacc

SEQ ID NO: 36522 - RNA, 30 nt, synthetic construct
  misc_feature 1..30: note = derived and/or modified sequence opt4 from anti-HIV_CDR
  source 1..30: mol_type = other RNA
agagagggcagccagggcgccttcgacatc

SEQ ID NO: 36523 - RNA, 30 nt, synthetic construct
  misc_feature 1..30: note = derived and/or modified sequence opt4 from anti-HIV_CDR
  source 1..30: mol_type = other RNA
ggcgacagcggccccaccggcttcgactac

SEQ ID NO: 36524 - RNA, 30 nt, synthetic construct
  misc_feature 1..30: note = derived and/or modified sequence opt4 from anti-HIV_CDR
  source 1..30: mol_type = other RNA
gtgagaagaggcagcagctaccccgactac

SEQ ID NO: 36525 - RNA, 30 nt, synthetic construct
  misc_feature 1..30: note = derived and/or modified sequence opt4 from anti-HIV_CDR
  source 1..30: mol_type = other RNA
agcgcctactacagaaactggttcgacagc

SEQ ID NO: 36526 - RNA, 30 nt, synthetic construct
  misc_feature 1..30: note = derived and/or modified sequence opt4 from anti-HIV_CDR
  source 1..30: mol_type = other RNA
cagagctacgacagcagcgtgagcgtggtg

SEQ ID NO: 36527 - RNA, 30 nt, synthetic construct
  misc_feature 1..30: note = derived and/or modified sequence opt4 from anti-HIV_CDR
  source 1..30: mol_type = other RNA
agcagctacaccagcagcctgaccctggtg

SEQ ID NO: 36528 - RNA, 30 nt, synthetic construct
  misc_feature 1..30: note = derived and/or modified sequence opt4 from anti-HIV_CDR
  source 1..30: mol_type = other RNA
tacgagggcaagagaagcggcatggacgtg

SEQ ID NO: 36529 - RNA, 30 nt, synthetic construct
  misc_feature 1..30: note = derived and/or modified sequence opt4 from anti-HIV_CDR
  source 1..30: mol_type = other RNA
cagcagtacggcagcagccccgagtacacc

SEQ ID NO: 36530 - RNA, 30 nt, synthetic construct
  misc_feature 1..30: note = derived and/or modified sequence opt4 from anti-HIV_CDR
  source 1..30: mol_type = other RNA
cagtactacgaccacagacccgccatcgcc

SEQ ID NO: 36531 - RNA, 30 nt, synthetic construct
  misc_feature 1..30: note = derived and/or modified sequence opt4 from anti-HIV_CDR
  source 1..30: mol_type = other RNA
cagcagtacgacaacctgcccagagtgacc

SEQ ID NO: 36532 - RNA, 30 nt, synthetic construct
  misc_feature 1..30: note = derived and/or modified sequence opt4 from anti-HIV_CDR
  source 1..30: mol_type = other RNA
ggcgcctacaccaccaccagcaccctggtg

SEQ ID NO: 36533 - RNA, 30 nt, synthetic construct
  misc_feature 1..30: note = derived and/or modified sequence opt4 from anti-HIV_CDR
  source 1..30: mol_type = other RNA
cagcagtacaagagctacagccccctgacc

SEQ ID NO: 36534 - RNA, 30 nt, synthetic construct
  misc_feature 1..30: note = derived and/or modified sequence opt4 from anti-HIV_CDR
  source 1..30: mol_type = other RNA
cagcagagctacaacaccagacccctgacc

SEQ ID NO: 36535 - RNA, 30 nt, synthetic construct
  misc_feature 1..30: note = derived and/or modified sequence opt4 from anti-HIV_CDR
  source 1..30: mol_type = other RNA
cagcagtacggcggcagcccccccgacacc

SEQ ID NO: 36536 - RNA, 30 nt, synthetic construct
  misc_feature 1..30: note = derived and/or modified sequence opt4 from anti-HIV_CDR
  source 1..30: mol_type = other RNA
tgcagctacaccagcagcgccaccgtggtg

SEQ ID NO: 36537 - RNA, 30 nt, synthetic construct
  misc_feature 1..30: note = derived and/or modified sequence opt4 from anti-HIV_CDR
  source 1..30: mol_type = other RNA
tgcagccacaccagcagcgacaccctggtg

SEQ ID NO: 36538 - RNA, 30 nt, synthetic construct; identical to SEQ ID NO: 28896
  misc_feature 1..30: note = derived and/or modified sequence opt4 from anti-HIV_CDR
  source 1..30: mol_type = other RNA

SEQ ID NO: 36539 - RNA, 30 nt, synthetic construct
  misc_feature 1..30: note = derived and/or modified sequence opt4 from anti-HIV_CDR
  source 1..30: mol_type = other RNA
gacgccttcgtgagcagcgccatggacgtg

SEQ ID NO: 36540 - RNA, 30 nt, synthetic construct
  misc_feature 1..30: note = derived and/or modified sequence opt4 from anti-HIV_CDR
  source 1..30: mol_type = other RNA
ctgagagccaccacccccggcttcgactac

SEQ ID NO: 36541 - RNA, 30 nt, synthetic construct; identical to SEQ ID NO: 28899
  misc_feature 1..30: note = derived and/or modified sequence opt4 from anti-HIV_CDR
  source 1..30: mol_type = other RNA

SEQ ID NO: 36542 - RNA, 30 nt, synthetic construct
  misc_feature 1..30: note = derived and/or modified sequence opt4 from anti-HIV_CDR
  source 1..30: mol_type = other RNA
ctgagagccaccatcgccggcttcgactac

SEQ ID NO: 36543 - RNA, 30 nt, synthetic construct
  misc_feature 1..30: note = derived and/or modified sequence opt4 from anti-HIV_CDR
  source 1..30: mol_type = other RNA
tgcagctacgccggcagctacatctgggtg

SEQ ID NO: 36544 - RNA, 30 nt, synthetic construct
  misc_feature 1..30: note = derived and/or modified sequence opt4 from anti-HIV_CDR
  source 1..30: mol_type = other RNA
tgcagctacgccggcacctacagctacgtg

SEQ ID NO: 36545 - RNA, 30 nt, synthetic construct
  misc_feature 1..30: note = derived and/or modified sequence opt4 from anti-HIV_CDR
  source 1..30: mol_type = other RNA
agcagctacgccggcagcaacaacttcgtg

SEQ ID NO: 36546 - RNA, 30 nt, synthetic construct
  misc_feature 1..30: note = derived and/or modified sequence opt4 from anti-HIV_CDR
  source 1..30: mol_type = other RNA
ggcagcttcaccaccagcctgaccctggtg

SEQ ID NO: 36547 - RNA, 30 nt, synthetic construct
  misc_feature 1..30: note = derived and/or modified sequence opt4 from anti-HIV_CDR
  source 1..30: mol_type = other RNA
cagcagtacgccaccagcagcctgtacacc

SEQ ID NO: 36548 - RNA, 30 nt, synthetic construct
  misc_feature 1..30: note = derived and/or modified sequence opt4 from anti-HIV_CDR
  source 1..30: mol_type = other RNA
cagtggtacggcaccctgcaccccagaacc

SEQ ID NO: 36549 - RNA, 30 nt, synthetic construct
  misc_feature 1..30: note = derived and/or modified sequence opt4 from anti-HIV_CDR
  source 1..30: mol_type = other RNA
agcagctacagcagcaccaacacctacgtg

SEQ ID NO: 36550 - RNA, 30 nt, synthetic construct
  misc_feature 1..30: note = derived and/or modified sequence opt4 from anti-HIV_CDR
  source 1..30: mol_type = other RNA
accttcatcaccgccagctggttcgacagc

SEQ ID NO: 36551 - RNA, 30 nt, synthetic construct
  misc_feature 1..30: note = derived and/or modified sequence opt4 from anti-HIV_CDR
  source 1..30: mol_type = other RNA
accggcggcctgctgagattccccgaggtg

SEQ ID NO: 36552 - RNA, 30 nt, synthetic construct
  misc_feature 1..30: note = derived and/or modified sequence opt4 from anti-HIV_CDR
  source 1..30: mol_type = other RNA
tgcagctacgccggcagctacacctacgtg

SEQ ID NO: 36553 - RNA, 30 nt, synthetic construct
  misc_feature 1..30: note = derived and/or modified sequence opt4 from anti-HIV_CDR
  source 1..30: mol_type = other RNA
cagcagagatacagctggcccagcctgacc

SEQ ID NO: 36554 - RNA, 30 nt, synthetic construct
  misc_feature 1..30: note = derived and/or modified sequence opt4 from anti-HIV_CDR
  source 1..30: mol_type = other RNA
ctgcagtgcggcagcagccccccctacacc

SEQ ID NO: 36555 - RNA, 30 nt, synthetic construct
  misc_feature 1..30: note = derived and/or modified sequence opt4 from anti-HIV_CDR
  source 1..30: mol_type = other RNA
agcagctacgccggcaccaaccactgggtg

SEQ ID NO: 36556 - RNA, 30 nt, synthetic construct
  misc_feature 1..30: note = derived and/or modified sequence opt4 from anti-HIV_CDR
  source 1..30: mol_type = other RNA
agcagctacgccgccaccaaccactgggtg

SEQ ID NO: 36557 - RNA, 30 nt, synthetic construct
  misc_feature 1..30: note = derived and/or modified sequence opt4 from anti-HIV_CDR
  source 1..30: mol_type = other RNA
cagtactacggcaccagcccccccagcacc

SEQ ID NO: 36558 - RNA, 30 nt, synthetic construct
  misc_feature 1..30: note = derived and/or modified sequence opt4 from anti-HIV_CDR
  source 1..30: mol_type = other RNA
cagtactacggcagcagcccccccagcacc

SEQ ID NO: 36559 - RNA, 30 nt, synthetic construct
  misc_feature 1..30: note = derived and/or modified sequence opt4 from anti-HIV_CDR
  source 1..30: mol_type = other RNA
caggagttcggcagagcccccccctacccc

SEQ ID NO: 36560 - RNA, 30 nt, synthetic construct
  misc_feature 1..30: note = derived and/or modified sequence opt4 from anti-HIV_CDR
  source 1..30: mol_type = other RNA
caggagtacggcagaagccccccctacccc

SEQ ID NO: 36561 - RNA, 30 nt, synthetic construct
  misc_feature 1..30: note = derived and/or modified sequence opt4 from anti-HIV_CDR
  source 1..30: mol_type = other RNA
caggagtacggcagagcccccccctacccc

SEQ ID NO: 36562 - RNA, 30 nt, synthetic construct
  misc_feature 1..30: note = derived and/or modified sequence opt4 from anti-HIV_CDR
  source 1..30: mol_type = other RNA
cacatcgccgtgggcggcagcgaggagcac

SEQ ID NO: 36563 - RNA, 30 nt, synthetic construct
  misc_feature 1..30: note = derived and/or modified sequence opt4 from anti-HIV_CDR
  source 1..30: mol_type = other RNA
cacatcgccgtgggcggcagcgaggaccac

SEQ ID NO: 36564 - RNA, 30 nt, synthetic construct
  misc_feature 1..30: note = derived and/or modified sequence opt4 from anti-HIV_CDR
  source 1..30: mol_type = other RNA
cacatcgccgtgggcggcagagaggaggag

SEQ ID NO: 36565 - RNA, 33 nt, synthetic construct
  misc_feature 1..33: note = derived and/or modified sequence opt4 from anti-HIV_CDR
  source 1..33: mol_type = other RNA
ggcgagaagagcagaggcagcagagccgtgcag

SEQ ID NO: 36566 - RNA, 33 nt, synthetic construct
  misc_feature 1..33: note = derived and/or modified sequence opt4 from anti-HIV_CDR
  source 1..33: mol_type = other RNA
ggcgagaagagcttcgccagcagagccgtgcag

SEQ ID NO: 36567 - RNA, 33 nt, synthetic construct
  misc_feature 1..33: note = derived and/or modified sequence opt4 from anti-HIV_CDR
  source 1..33: mol_type = other RNA
ggcagacaggccctgggcagcagagccgtgcag

SEQ ID NO: 36568 - RNA, 33 nt, synthetic construct
  misc_feature 1..33: note = derived and/or modified sequence opt4 from anti-HIV_CDR
  source 1..33: mol_type = other RNA
ggcgaggagagcctgggcagcagaagcgtgatc

SEQ ID NO: 36569 - RNA, 33 nt, synthetic construct
  misc_feature 1..33: note = derived and/or modified sequence opt4 from anti-HIV_CDR
  source 1..33: mol_type = other RNA
ggcgagaagagcctgggcagcagagccgtgcag

SEQ ID NO: 36570 - RNA, 33 nt, synthetic construct
  misc_feature 1..33: note = derived and/or modified sequence opt4 from anti-HIV_CDR
  source 1..33: mol_type = other RNA
ggcaaggagagcatcggcagcagagccgtgcag

SEQ ID NO: 36571 - RNA, 33 nt, synthetic construct
  misc_feature 1..33: note = derived and/or modified sequence opt4 from anti-HIV_CDR
  source 1..33: mol_type = other RNA
ggcggcaacaacatcggcagcaagagcgtgcac

SEQ ID NO: 36572 - RNA, 33 nt, synthetic construct
  misc_feature 1..33: note = derived and/or modified sequence opt4 from anti-HIV_CDR
  source 1..33: mol_type = other RNA
ggcgagaagagcatcggcagcagagccgtgcag

SEQ ID NO: 36573 - RNA, 33 nt, synthetic construct
  misc_feature 1..33: note = derived and/or modified sequence opt4 from anti-HIV_CDR
  source 1..33: mol_type = other RNA
aaggccagccaggacgtgagcaccgccgtggcc

SEQ ID NO: 36574 - RNA, 33 nt, synthetic construct
  misc_feature 1..33: note = derived and/or modified sequence opt4 from anti-HIV_CDR
  source 1..33: mol_type = other RNA
ggcagcagaaacctgagccacagactgctgagc

SEQ ID NO: 36575 - RNA, 33 nt, synthetic construct
  misc_feature 1..33: note = derived and/or modified sequence opt4 from anti-HIV_CDR
  source 1..33: mol_type = other RNA
ggcacctacgacagccagggcagcaccagactg

SEQ ID NO: 36576 - RNA, 33 nt, synthetic construct
  misc_feature 1..33: note = derived and/or modified sequence opt4 from anti-HIV_CDR
  source 1..33: mol_type = other RNA
cagcagagaaccatctggccccccggctgcagc

SEQ ID NO: 36577 - RNA, 33 nt, synthetic construct
  misc_feature 1..33: note = derived and/or modified sequence opt4 from anti-HIV_CDR
  source 1..33: mol_type = other RNA
ggcacctgggacagcagcctgagcgccgtgctg

SEQ ID NO: 36578 - RNA, 33 nt, synthetic construct
  misc_feature 1..33: note = derived and/or modified sequence opt4 from anti-HIV_CDR
  source 1..33: mol_type = other RNA
gccagctgggacaacagcctgagcggccccgtg

SEQ ID NO: 36579 - RNA, 33 nt, synthetic construct
  misc_feature 1..33: note = derived and/or modified sequence opt4 from anti-HIV_CDR
  source 1..33: mol_type = other RNA
gccagctgggacgacagcctgagcggctgggtg

SEQ ID NO: 36580 - RNA, 33 nt, synthetic construct
  misc_feature 1..33: note = derived and/or modified sequence opt4 from anti-HIV_CDR
  source 1..33: mol_type = other RNA
ctgctgctgccctactacggcggcccctggatc

SEQ ID NO: 36581 - RNA, 33 nt, synthetic construct
  misc_feature 1..33: note = derived and/or modified sequence opt4 from anti-HIV_CDR
  source 1..33: mol_type = other RNA
cagcacagaaccaactggccccccagcatcacc

SEQ ID NO: 36582 - RNA, 33 nt, synthetic construct
  misc_feature 1..33: note = derived and/or modified sequence opt4 from anti-HIV_CDR
  source 1..33: mol_type = other RNA
cagagctacgacagaagcctgagaggcagcgtg

SEQ ID NO: 36583 - RNA, 33 nt, synthetic construct
  misc_feature 1..33: note = derived and/or modified sequence opt4 from anti-HIV_CDR
  source 1..33: mol_type = other RNA
agcagcggcaactacgacttcgccttcgacatc

SEQ ID NO: 36584 - RNA, 33 nt, synthetic construct
  misc_feature 1..33: note = derived and/or modified sequence opt4 from anti-HIV_CDR
  source 1..33: mol_type = other RNA
agcagcggcaactacgacttcgcctacgacatc

SEQ ID NO: 36585 - RNA, 33 nt, synthetic construct
  misc_feature 1..33: note = derived and/or modified sequence opt4 from anti-HIV_CDR
  source 1..33: mol_type = other RNA
agcagcggcaacttcgagttcgccttcgagatc

SEQ ID NO: 36586 - RNA, 33 nt, synthetic construct
  misc_feature 1..33: note = derived and/or modified sequence opt4 from anti-HIV_CDR
  source 1..33: mol_type = other RNA
gccacctacgacagccacggcagcatcagactg

SEQ ID NO: 36587 - RNA, 33 nt, synthetic construct
  misc_feature 1..33: note = derived and/or modified sequence opt4 from anti-HIV_CDR
  source 1..33: mol_type = other RNA
ggcacctacgacaccagcctgagcctgagactg

SEQ ID NO: 36588 - RNA, 33 nt, synthetic construct
  misc_feature 1..33: note = derived and/or modified sequence opt4 from anti-HIV_CDR
  source 1..33: mol_type = other RNA
gccgccttcgacagcgccctgagcctgcccctg

SEQ ID NO: 36589 - RNA, 33 nt, synthetic construct
  misc_feature 1..33: note = derived and/or modified sequence opt4 from anti-HIV_CDR
  source 1..33: mol_type = other RNA
gccacctacgacagcgacggcagcatcagactg

SEQ ID NO: 36590 - RNA, 33 nt, synthetic construct
  misc_feature 1..33: note = derived and/or modified sequence opt4 from anti-HIV_CDR
  source 1..33: mol_type = other RNA
gccacctacgacagcggctggagcatcagactg

SEQ ID NO: 36591 - RNA, 33 nt, synthetic construct
  misc_feature 1..33: note = derived and/or modified sequence opt4 from anti-HIV_CDR
  source 1..33: mol_type = other RNA
gccacctacgacaccggcctgagcctgagactg

SEQ ID NO: 36592 - RNA, 33 nt, synthetic construct
  misc_feature 1..33: note = derived and/or modified sequence opt4 from anti-HIV_CDR
  source 1..33: mol_type = other RNA
gccgcctacgacagcaccctgagcctgagactg

SEQ ID NO: 36593 - RNA, 33 nt, synthetic construct
  misc_feature 1..33: note = derived and/or modified sequence opt4 from anti-HIV_CDR
  source 1..33: mol_type = other RNA
gccgcctacgacagcgccgtgagcctgcccgtg

SEQ ID NO: 36594 - RNA, 33 nt, synthetic construct
  misc_feature 1..33: note = derived and/or modified sequence opt4 from anti-HIV_CDR
  source 1..33: mol_type = other RNA
gccacctacgacaccgacctgagcctgagactg

SEQ ID NO: 36595 - RNA, 33 nt, synthetic construct
  misc_feature 1..33: note = derived and/or modified sequence opt4 from anti-HIV_CDR
  source 1..33: mol_type = other RNA
gccgcctacgacagcagcctgagcctgagactg

SEQ ID NO: 36596 - RNA, 33 nt, synthetic construct
  misc_feature 1..33: note = derived and/or modified sequence opt4 from anti-HIV_CDR
  source 1..33: mol_type = other RNA
gccgcctacgacagcaccttcagcctgcccgtg

SEQ ID NO: 36597 - RNA, 33 nt, synthetic construct
  misc_feature 1..33: note = derived and/or modified sequence opt4 from anti-HIV_CDR
  source 1..33: mol_type = other RNA
gccacctacgacagccagggcagcaccagactg

SEQ ID NO: 36598 - RNA, 33 nt, synthetic construct
  misc_feature 1..33: note = derived and/or modified sequence opt4 from anti-HIV_CDR
  source 1..33: mol_type = other RNA
gccacctacgacagccagagaagcatcagactg

SEQ ID NO: 36599 - RNA, 33 nt, synthetic construct
  misc_feature 1..33: note = derived and/or modified sequence opt4 from anti-HIV_CDR
  source 1..33: mol_type = other RNA
gccgtgtacgacagcagcctgagcctgggcctg

SEQ ID NO: 36600 - RNA, 33 nt, synthetic construct; identical to SEQ ID NO: 28958
  misc_feature 1..33: note = derived and/or modified sequence opt4 from anti-HIV_CDR
  source 1..33: mol_type = other RNA

SEQ ID NO: 36601 - RNA, 33 nt, synthetic construct; identical to SEQ ID NO: 28959
  misc_feature 1..33: note = derived and/or modified sequence opt4 from anti-HIV_CDR
  source 1..33: mol_type = other RNA

SEQ ID NO: 36602 - RNA, 33 nt, synthetic construct
  misc_feature 1..33: note = derived and/or modified sequence opt4 from anti-HIV_CDR
  source 1..33: mol_type = other RNA
tgcgaggtggacgccgacgagaccgtgacctgc

SEQ ID NO: 36603 - RNA, 33 nt, synthetic construct
  misc_feature 1..33: note = derived and/or modified sequence opt4 from anti-HIV_CDR
  source 1..33: mol_type = other RNA
tgcgaggtggacgccgaggtgaccatgaccgtg

SEQ ID NO: 36604 - RNA, 33 nt, synthetic construct
  misc_feature 1..33: note = derived and/or modified sequence opt4 from anti-HIV_CDR
  source 1..33: mol_type = other RNA
agcagctacgccgacaccaacgacttcggcgtg

SEQ ID NO: 36605 - RNA, 33 nt, synthetic construct; identical to SEQ ID NO: 13679
  misc_feature 1..33: note = derived and/or modified sequence opt4 from anti-HIV_CDR
  source 1..33: mol_type = other RNA

SEQ ID NO: 36606 - RNA, 33 nt, synthetic construct
  misc_feature 1..33: note = derived and/or modified sequence opt4 from anti-HIV_CDR
  source 1..33: mol_type = other RNA
ggcacctgggacggcagcctgaccaccggcgtg

SEQ ID NO: 36607 - RNA, 33 nt, synthetic construct
  misc_feature 1..33: note = derived and/or modified sequence opt4 from anti-HIV_CDR
  source 1..33: mol_type = other RNA
cagagctacgacaacagcctgagcggctgggtg

SEQ ID NO: 36608 - RNA, 33 nt, synthetic construct
  misc_feature 1..33: note = derived and/or modified sequence opt4 from anti-HIV_CDR
  source 1..33: mol_type = other RNA
cagcagtactacagcatccccccctggaccttc

SEQ ID NO: 36609 - RNA, 33 nt, synthetic construct
  misc_feature 1..33: note = derived and/or modified sequence opt4 from anti-HIV_CDR
  source 1..33: mol_type = other RNA
atgcagggcacctactggccccccagcatcacc

SEQ ID NO: 36610 - RNA, 33 nt, synthetic construct
  misc_feature 1..33: note = derived and/or modified sequence opt4 from anti-HIV_CDR
  source 1..33: mol_type = other RNA
cagagctacgacagcagcctgggcgtggaggtg

SEQ ID NO: 36611 - RNA, 33 nt, synthetic construct
  misc_feature 1..33: note = derived and/or modified sequence opt4 from anti-HIV_CDR
  source 1..33: mol_type = other RNA
caggtgtgggacagcggcagagacagctgggtg

SEQ ID NO: 36612 - RNA, 33 nt, synthetic construct
  misc_feature 1..33: note = derived and/or modified sequence opt4 from anti-HIV_CDR
  source 1..33: mol_type = other RNA
cagagctacgacagcagcctgagcggctgggtg

SEQ ID NO: 36613 - RNA, 33 nt, synthetic construct
  misc_feature 1..33: note = derived and/or modified sequence opt4 from anti-HIV_CDR
  source 1..33: mol_type = other RNA
ggcagctgggacggcagcctgaacgccggcgtg

SEQ ID NO: 36614 - RNA, 33 nt, synthetic construct
  misc_feature 1..33: note = derived and/or modified sequence opt4 from anti-HIV_CDR
  source 1..33: mol_type = other RNA
ctgagcgccgacagcagcagcacctaccaggtg

SEQ ID NO: 36615 - RNA, 33 nt, synthetic construct
  misc_feature 1..33: note = derived and/or modified sequence opt4 from anti-HIV_CDR
  source 1..33: mol_type = other RNA
tgcagctacgccggcagagacaccagctgggtg

SEQ ID NO: 36616 - RNA, 33 nt, synthetic construct
  misc_feature 1..33: note = derived and/or modified sequence opt4 from anti-HIV_CDR
  source 1..33: mol_type = other RNA
cagcagagaagcaactggccccccggcctgacc

SEQ ID NO: 36617 - RNA, 33 nt, synthetic construct
  misc_feature 1..33: note = derived and/or modified sequence opt4 from anti-HIV_CDR
  source 1..33: mol_type = other RNA
aagggcagaggctacggctactggttcgacagc

SEQ ID NO: 36618 - RNA, 33 nt, synthetic construct
  misc_feature 1..33: note = derived and/or modified sequence opt4 from anti-HIV_CDR
  source 1..33: mol_type = other RNA
gagatggccgccaccagcgacgccttcgacatc

SEQ ID NO: 36619 - RNA, 33 nt, synthetic construct
  misc_feature 1..33: note = derived and/or modified sequence opt4 from anti-HIV_CDR
  source 1..33: mol_type = other RNA
agcatctacagcaccggccccgcccccgtgtac

SEQ ID NO: 36620 - RNA, 33 nt, synthetic construct
  misc_feature 1..33: note = derived and/or modified sequence opt4 from anti-HIV_CDR
  source 1..33: mol_type = other RNA
agaggcagcctgctgatcaagtacttcgactac

SEQ ID NO: 36621 - RNA, 33 nt, synthetic construct
  misc_feature 1..33: note = derived and/or modified sequence opt4 from anti-HIV_CDR
  source 1..33: mol_type = other RNA
cagcagtacgacaacctgccccccagagtgacc

SEQ ID NO: 36622 - RNA, 33 nt, synthetic construct
  misc_feature 1..33: note = derived and/or modified sequence opt4 from anti-HIV_CDR
  source 1..33: mol_type = other RNA
gacgtgagactggtggccgtgcccggcgccgac

SEQ ID NO: 36623 - RNA, 33 nt, synthetic construct
  misc_feature 1..33: note = derived and/or modified sequence opt4 from anti-HIV_CDR
  source 1..33: mol_type = other RNA
cagcagagaaccacctggccccccgagtacacc

SEQ ID NO: 36624 - RNA, 33 nt, synthetic construct; identical to SEQ ID NO: 13698
  misc_feature 1..33: note = derived and/or modified sequence opt4 from anti-HIV_CDR
  source 1..33: mol_type = other RNA

SEQ ID NO: 36625 - RNA, 33 nt, synthetic construct
  misc_feature 1..33: note = derived and/or modified sequence opt4 from anti-HIV_CDR
  source 1..33: mol_type = other RNA
agaagaagaagcgcctggagccccttcgacagc

SEQ ID NO: 36626 - RNA, 33 nt, synthetic construct
  misc_feature 1..33: note = derived and/or modified sequence opt4 from anti-HIV_CDR
  source 1..33: mol_type = other RNA
gccacctgggacagcagcctgagaaccgccctg

SEQ ID NO: 36627 - RNA, 33 nt, synthetic construct
  misc_feature 1..33: note = derived and/or modified sequence opt4 from anti-HIV_CDR
  source 1..33: mol_type = other RNA
ggcacctgggacagcagcctgagagccgccctg

SEQ ID NO: 36628 - RNA, 33 nt, synthetic construct
  misc_feature 1..33: note = derived and/or modified sequence opt4 from anti-HIV_CDR
  source 1..33: mol_type = other RNA
cagcagagaagcatctggccccccagcctgacc

SEQ ID NO: 36629 - RNA, 33 nt, synthetic construct
  misc_feature 1..33: note = derived and/or modified sequence opt4 from anti-HIV_CDR
  source 1..33: mol_type = other RNA
gagttccagaccagcggcgtggtgagagagggc

SEQ ID NO: 36630 - RNA, 33 nt, synthetic construct
  misc_feature 1..33: note = derived and/or modified sequence opt4 from anti-HIV_CDR
  source 1..33: mol_type = other RNA
cacatcggcgccggcggcccctacagcgagtac

SEQ ID NO: 36631 - RNA, 33 nt, synthetic construct
  misc_feature 1..33: note = derived and/or modified sequence opt4 from anti-HIV_CDR
  source 1..33: mol_type = other RNA
agaggccacagcttcaccagccccttcgacagc

SEQ ID NO: 36632 - RNA, 33 nt, synthetic construct
  misc_feature 1..33: note = derived and/or modified sequence opt4 from anti-HIV_CDR
  source 1..33: mol_type = other RNA
cagcacctgaacagctaccccagaatgtacacc

SEQ ID NO: 36633 - RNA, 33 nt, synthetic construct
  misc_feature 1..33: note = derived and/or modified sequence opt4 from anti-HIV_CDR
  source 1..33: mol_type = other RNA
cagcagagaagcaactggccccccaagatcacc

SEQ ID NO: 36634 - RNA, 33 nt, synthetic construct
  misc_feature 1..33: note = derived and/or modified sequence opt4 from anti-HIV_CDR
  source 1..33: mol_type = other RNA
gccgcctgggacgacagcctgggcggcgtggtg

SEQ ID NO: 36635 - RNA, 33 nt, synthetic construct
  misc_feature 1..33: note = derived and/or modified sequence opt4 from anti-HIV_CDR
  source 1..33: mol_type = other RNA
ggcacctgggacagcagcctgagcgccgtggtg

SEQ ID NO: 36636 - RNA, 33 nt, synthetic construct
  misc_feature 1..33: note = derived and/or modified sequence opt4 from anti-HIV_CDR
  source 1..33: mol_type = other RNA
cagcagagagccaactggccccccggcggcacc

SEQ ID NO: 36637 - RNA, 33 nt, synthetic construct
  misc_feature 1..33: note = derived and/or modified sequence opt4 from anti-HIV_CDR
  source 1..33: mol_type = other RNA
ggcggcggctaccccagaggcaacatggacgtg

SEQ ID NO: 36638 - RNA, 33 nt, synthetic construct
  misc_feature 1..33: note = derived and/or modified sequence opt4 from anti-HIV_CDR
  source 1..33: mol_type = other RNA
ctgctgctgctgtactacggcggcccctggatc

SEQ ID NO: 36639 - RNA, 33 nt, synthetic construct
  misc_feature 1..33: note = derived and/or modified sequence opt4 from anti-HIV_CDR
  source 1..33: mol_type = other RNA
cagcagagaggcatctggcccctgcagatcacc

SEQ ID NO: 36640 - RNA, 33 nt, synthetic construct
  misc_feature 1..33: note = derived and/or modified sequence opt4 from anti-HIV_CDR
  source 1..33: mol_type = other RNA
agaagccccggcggcggctacgccttcgacatc

SEQ ID NO: 36641 - RNA, 33 nt, synthetic construct
  misc_feature 1..33: note = derived and/or modified sequence opt4 from anti-HIV_CDR
  source 1..33: mol_type = other RNA
agcggccccggcctgctgagaggcttcgactac

SEQ ID NO: 36642 - RNA, 33 nt, synthetic construct
  misc_feature 1..33: note = derived and/or modified sequence opt4 from anti-HIV_CDR
  source 1..33: mol_type = other RNA
cagcagagaaccaccagaccccccgagtacacc

SEQ ID NO: 36643 - RNA, 33 nt, synthetic construct
  misc_feature 1..33: note = derived and/or modified sequence opt4 from anti-HIV_CDR
  source 1..33: mol_type = other RNA
cagcagagaaccaccagaccccccgactacacc

SEQ ID NO: 36644 - RNA, 33 nt, synthetic construct
  misc_feature 1..33: note = derived and/or modified sequence opt4 from anti-HIV_CDR
  source 1..33: mol_type = other RNA
cagggcagaaccaccagaccccccgactacacc

SEQ ID NO: 36645 - RNA, 33 nt, synthetic construct
  misc_feature 1..33: note = derived and/or modified sequence opt4 from anti-HIV_CDR
  source 1..33: mol_type = other RNA
cagcagagaagcaccaccccccccgagtacacc

SEQ ID NO: 36646 - RNA, 33 nt, synthetic construct
  misc_feature 1..33: note = derived and/or modified sequence opt4 from anti-HIV_CDR
  source 1..33: mol_type = other RNA
cagcagagaaccagctggcccctggccctgagc

SEQ ID NO: 36647 - RNA, 33 nt, synthetic construct
  misc_feature 1..33: note = derived and/or modified sequence opt4 from anti-HIV_CDR
  source 1..33: mol_type = other RNA
agaggccacagcttcagcctgcccttcgacagc

SEQ ID NO: 36648 - RNA, 36 nt, synthetic construct
  misc_feature 1..36: note = derived and/or modified sequence opt4 from anti-HIV_CDR
  source 1..36: mol_type = other RNA
cactactgggacagcagaagccccatcagctgggtg

SEQ ID NO: 36649 - RNA, 36 nt, synthetic construct
  misc_feature 1..36: note = derived and/or modified sequence opt4 from anti-HIV_CDR
  source 1..36: mol_type = other RNA
cacaagtgggacagcagaagccccctgagctgggtg

SEQ ID NO: 36650 - RNA, 36 nt, synthetic construct
  misc_feature 1..36: note = derived and/or modified sequence opt4 from anti-HIV_CDR
  source 1..36: mol_type = other RNA
cacatgtgggacagcagaagcggcttcagctggagc

SEQ ID NO: 36651 - RNA, 36 nt, synthetic construct
  misc_feature 1..36: note = derived and/or modified sequence opt4 from anti-HIV_CDR
  source 1..36: mol_type = other RNA
cacatctgggacagcagagtgcccaccaagtgggtg

SEQ ID NO: 36652 - RNA, 36 nt, synthetic construct
  misc_feature 1..36: note = derived and/or modified sequence opt4 from anti-HIV_CDR
  source 1..36: mol_type = other RNA
caggtgtgggacagcagcagcgaccacccctgggtg

SEQ ID NO: 36653 - RNA, 36 nt, synthetic construct
  misc_feature 1..36: note = derived and/or modified sequence opt4 from anti-HIV_CDR
  source 1..36: mol_type = other RNA
cacatctacgacgccagaagacccaccaactgggtg

SEQ ID NO: 36654 - RNA, 36 nt, synthetic construct
  misc_feature 1..36: note = derived and/or modified sequence opt4 from anti-HIV_CDR
  source 1..36: mol_type = other RNA
ctggacggcgaggccttcagatactacctggacctg

SEQ ID NO: 36655 - RNA, 36 nt, synthetic construct
  misc_feature 1..36: note = derived and/or modified sequence opt4 from anti-HIV_CDR
  source 1..36: mol_type = other RNA
ccccagtacaacctgggcagagaccccctggacgtg

SEQ ID NO: 36656 - RNA, 36 nt, synthetic construct
  misc_feature 1..36: note = derived and/or modified sequence opt4 from anti-HIV_CDR
  source 1..36: mol_type = other RNA
cccgagcccagcagcatcgtggcccccctgtactac

SEQ ID NO: 36657 - RNA, 36 nt, synthetic construct
  misc_feature 1..36: note = derived and/or modified sequence opt4 from anti-HIV_CDR
  source 1..36: mol_type = other RNA
ggcggcggcgacggcagaaactggcacctgcacccc

SEQ ID NO: 36658 - RNA, 36 nt, synthetic construct
  misc_feature 1..36: note = derived and/or modified sequence opt4 from anti-HIV_CDR
  source 1..36: mol_type = other RNA
cccaagagcggcagagactactggagcttcgacctg

SEQ ID NO: 36659 - RNA, 36 nt, synthetic construct
  misc_feature 1..36: note = derived and/or modified sequence opt4 from anti-HIV_CDR
  source 1..36: mol_type = other RNA
cccagaggcggcagagacaactggagcttccacgtg

SEQ ID NO: 36660 - RNA, 36 nt, synthetic construct
  misc_feature 1..36: note = derived and/or modified sequence opt4 from anti-HIV_CDR
  source 1..36: mol_type = other RNA
ccccacagccccgacgacgcctggagcctggacgtg

SEQ ID NO: 36661 - RNA, 36 nt, synthetic construct
  misc_feature 1..36: note = derived and/or modified sequence opt4 from anti-HIV_CDR
  source 1..36: mol_type = other RNA
cccctgagaggcggcgacacctggcactaccacagc

SEQ ID NO: 36662 - RNA, 36 nt, synthetic construct
  misc_feature 1..36: note = derived and/or modified sequence opt4 from anti-HIV_CDR
  source 1..36: mol_type = other RNA
ctgcagcccgtgtacatcctgagaagcatctgccac

SEQ ID NO: 36663 - RNA, 36 nt, synthetic construct
  misc_feature 1..36: note = derived and/or modified sequence opt4 from anti-HIV_CDR
  source 1..36: mol_type = other RNA
ctgcagcccgtgtacatcctgaagtgcaactggtgc

SEQ ID NO: 36664 - RNA, 36 nt, synthetic construct
  misc_feature 1..36: note = derived and/or modified sequence opt4 from anti-HIV_CDR
  source 1..36: mol_type = other RNA
gagtacagattcgacgactggggccccctggaccac

SEQ ID NO: 36665 - RNA, 36 nt, synthetic construct
  misc_feature 1..36: note = derived and/or modified sequence opt4 from anti-HIV_CDR
  source 1..36: mol_type = other RNA
gccgcctgggacgacagcctgaacggccacggcgtg

SEQ ID NO: 36666 - RNA, 36 nt, synthetic construct; identical to SEQ ID NO: 13740
  misc_feature 1..36: note = derived and/or modified sequence opt4 from anti-HIV_CDR
  source 1..36: mol_type = other RNA

SEQ ID NO: 36667 - RNA, 36 nt, synthetic construct
  misc_feature 1..36: note = derived and/or modified sequence opt4 from anti-HIV_CDR
  source 1..36: mol_type = other RNA
ggcctgtacgacagcagcggctactacttcggctac

SEQ ID NO: 36668 - RNA, 36 nt, synthetic construct
  misc_feature 1..36: note = derived and/or modified sequence opt4 from anti-HIV_CDR
  source 1..36: mol_type = other RNA
ctgggctgcagcggcggcagctgctacgaggacagc

SEQ ID NO: 36669 - RNA, 36 nt, synthetic construct
  misc_feature 1..36: note = derived and/or modified sequence opt4 from anti-HIV_CDR
  source 1..36: mol_type = other RNA
gccagcggcagctacatcctgggcaccatggacgtg

SEQ ID NO: 36670 - RNA, 36 nt, synthetic construct
  misc_feature 1..36: note = derived and/or modified sequence opt4 from anti-HIV_CDR
  source 1..36: mol_type = other RNA
tacagcaccgacaacagcggcaagcagcactgggtg

SEQ ID NO: 36671 - RNA, 36 nt, synthetic construct
  misc_feature 1..36: note = derived and/or modified sequence opt4 from anti-HIV_CDR
  source 1..36: mol_type = other RNA
gtgaagcagttcctggagtggctgtacctggactac

SEQ ID NO: 36672 - RNA, 36 nt, synthetic construct
  misc_feature 1..36: note = derived and/or modified sequence opt4 from anti-HIV_CDR
  source 1..36: mol_type = other RNA
ggcgtgagaagcatcgtgggcgcccacttcgactac

SEQ ID NO: 36673 - RNA, 36 nt, synthetic construct
  misc_feature 1..36: note = derived and/or modified sequence opt4 from anti-HIV_CDR
  source 1..36: mol_type = other RNA
ggcgtgggcaccagatactacgtgtacttcgacagc

SEQ ID NO: 36674 - RNA, 36 nt, synthetic construct
  misc_feature 1..36: note = derived and/or modified sequence opt4 from anti-HIV_CDR
  source 1..36: mol_type = other RNA
gccccctacatcagcagcagccacctggactactgg

SEQ ID NO: 36675 - RNA, 36 nt, synthetic construct
  misc_feature 1..36: note = derived and/or modified sequence opt4 from anti-HIV_CDR
  source 1..36: mol_type = other RNA
agaggcatcgccgccgccggcttctacttccagcac

SEQ ID NO: 36676 - RNA, 36 nt, synthetic construct
  misc_feature 1..36: note = derived and/or modified sequence opt4 from anti-HIV_CDR
  source 1..36: mol_type = other RNA
agaggcatcgccgccgccgccttctacttccagacc

SEQ ID NO: 36677 - RNA, 36 nt, synthetic construct
  misc_feature 1..36: note = derived and/or modified sequence opt4 from anti-HIV_CDR
  source 1..36: mol_type = other RNA
agaggcatcgccgccgccggcttctacttccagaac

SEQ ID NO: 36678 - RNA, 36 nt, synthetic construct
  misc_feature 1..36: note = derived and/or modified sequence opt4 from anti-HIV_CDR
  source 1..36: mol_type = other RNA
cagagctacgacaccagcctgaccgacaccggcgtg

SEQ ID NO: 36679 - RNA, 36 nt, synthetic construct
  misc_feature 1..36: note = derived and/or modified sequence opt4 from anti-HIV_CDR
  source 1..36: mol_type = other RNA
cagagctacgacaccagcctgagcgacaccggcgtg

SEQ ID NO: 36680 - RNA, 36 nt, synthetic construct
  misc_feature 1..36: note = derived and/or modified sequence opt4 from anti-HIV_CDR
  source 1..36: mol_type = other RNA
agaaccaccctggtgaacttcggcgtgttcgacctg

SEQ ID NO: 36681 - RNA, 36 nt, synthetic construct
  misc_feature 1..36: note = derived and/or modified sequence opt4 from anti-HIV_CDR
  source 1..36: mol_type = other RNA
cccgtggtgaacaccatcctgccctactgcgacgtg

SEQ ID NO: 36682 - RNA, 36 nt, synthetic construct
  misc_feature 1..36: note = derived and/or modified sequence opt4 from anti-HIV_CDR
  source 1..36: mol_type = other RNA
tgctacagcggcagaagcagatacttcttcgacagc

SEQ ID NO: 36683 - RNA, 36 nt, synthetic construct; identical to SEQ ID NO: 13757
  misc_feature 1..36: note = derived and/or modified sequence opt4 from anti-HIV_CDR
  source 1..36: mol_type = other RNA

SEQ ID NO: 36684 - RNA, 36 nt, synthetic construct
  misc_feature 1..36: note = derived and/or modified sequence opt4 from anti-HIV_CDR
  source 1..36: mol_type = other RNA
ctgagaagaggctactacgacagcggcgaggactac

SEQ ID NO: 36685 - RNA, 36 nt, synthetic construct
  misc_feature 1..36: note = derived and/or modified sequence opt4 from anti-HIV_CDR
  source 1..36: mol_type = other RNA
ctgagaagaggctacttcgacagcggcggcgaccac

SEQ ID NO: 36686 - RNA, 36 nt, synthetic construct
  misc_feature 1..36: note = derived and/or modified sequence opt4 from anti-HIV_CDR
  source 1..36: mol_type = other RNA
agcagctacaccagcagcagcaccctgggcgtggtg

SEQ ID NO: 36687 - RNA, 36 nt, synthetic construct
  misc_feature 1..36: note = derived and/or modified sequence opt4 from anti-HIV_CDR
  source 1..36: mol_type = other RNA
ctggacggcgaggccttcagatactacttcgacagc

SEQ ID NO: 36688 - RNA, 36 nt, synthetic construct
  misc_feature 1..36: note = derived and/or modified sequence opt4 from anti-HIV_CDR
  source 1..36: mol_type = other RNA
agaagaggccagagactgctggcctacttcgactac

SEQ ID NO: 36689 - RNA, 36 nt, synthetic construct
  misc_feature 1..36: note = derived and/or modified sequence opt4 from anti-HIV_CDR
  source 1..36: mol_type = other RNA
ccccagtacaacctgggcagagagcccctgaacgtg

SEQ ID NO: 36690 - RNA, 36 nt, synthetic construct
  misc_feature 1..36: note = derived and/or modified sequence opt4 from anti-HIV_CDR
  source 1..36: mol_type = other RNA
gcccaccacgacttctggagagcccccgtggacgtg

SEQ ID NO: 36691 - RNA, 36 nt, synthetic construct
  misc_feature 1..36: note = derived and/or modified sequence opt4 from anti-HIV_CDR
  source 1..36: mol_type = other RNA
ggcagaagagagggcctgaacttcctgctggactac

SEQ ID NO: 36692 - RNA, 36 nt, synthetic construct
  misc_feature 1..36: note = derived and/or modified sequence opt4 from anti-HIV_CDR
  source 1..36: mol_type = other RNA
cccgagcccagcagcatcgtgggcgccctgtactac

SEQ ID NO: 36693 - RNA, 36 nt, synthetic construct
  misc_feature 1..36: note = derived and/or modified sequence opt4 from anti-HIV_CDR
  source 1..36: mol_type = other RNA
ggccccgacgacttctggagcggctaccccaagtac

SEQ ID NO: 36694 - RNA, 36 nt, synthetic construct
  misc_feature 1..36: note = derived and/or modified sequence opt4 from anti-HIV_CDR
  source 1..36: mol_type = other RNA
gactacagcgccgccggcagacacctgttcgacagc

SEQ ID NO: 36695 - RNA, 36 nt, synthetic construct
  misc_feature 1..36: note = derived and/or modified sequence opt4 from anti-HIV_CDR
  source 1..36: mol_type = other RNA
gactacaccgccagaggcagacacttcttcgactac

SEQ ID NO: 36696 - RNA, 36 nt, synthetic construct
  misc_feature 1..36: note = derived and/or modified sequence opt4 from anti-HIV_CDR
  source 1..36: mol_type = other RNA
gactacaccgccagcggcagacacttcttcgactac

SEQ ID NO: 36697 - RNA, 36 nt, synthetic construct
  misc_feature 1..36: note = derived and/or modified sequence opt4 from anti-HIV_CDR
  source 1..36: mol_type = other RNA
cagagctacgacagcagcctgagcggcagctgggtg

SEQ ID NO: 36698 - RNA, 36 nt, synthetic construct
  misc_feature 1..36: note = derived and/or modified sequence opt4 from anti-HIV_CDR
  source 1..36: mol_type = other RNA
cccgcccaggccggcgtgggccccagattcgactac

SEQ ID NO: 36699 - RNA, 36 nt, synthetic construct
  misc_feature 1..36: note = derived and/or modified sequence opt4 from anti-HIV_CDR
  source 1..36: mol_type = other RNA
ggcgccatcaacagcagccccctgtacttcgacagc

SEQ ID NO: 36700 - RNA, 36 nt, synthetic construct
  misc_feature 1..36: note = derived and/or modified sequence opt4 from anti-HIV_CDR
  source 1..36: mol_type = other RNA
ggcgacatcaccagcagccccctgtacttcgacttc

SEQ ID NO: 36701 - RNA, 36 nt, synthetic construct
  misc_feature 1..36: note = derived and/or modified sequence opt4 from anti-HIV_CDR
  source 1..36: mol_type = other RNA
ggcgccatcaacagcagccccagctacttcgacagc

SEQ ID NO: 36702 - RNA, 36 nt, synthetic construct
  misc_feature 1..36: note = derived and/or modified sequence opt4 from anti-HIV_CDR
  source 1..36: mol_type = other RNA
tgggtggtgaccgccgccgaggagtacttcgactac

SEQ ID NO: 36703 - RNA, 39 nt, synthetic construct
  misc_feature 1..39: note = derived and/or modified sequence opt4 from anti-HIV_CDR
  source 1..39: mol_type = other RNA
gacccccaggtggaggtgagaggcaacgccttcgacatc

SEQ ID NO: 36704 - RNA, 39 nt, synthetic construct
  misc_feature 1..39: note = derived and/or modified sequence opt4 from anti-HIV_CDR
  source 1..39: mol_type = other RNA
gaccacggcgaccccagaaccggctactacttcgactac

SEQ ID NO: 36705 - RNA, 39 nt, synthetic construct
  misc_feature 1..39: note = derived and/or modified sequence opt4 from anti-HIV_CDR
  source 1..39: mol_type = other RNA
gacgagagcggctacgacctgaactggcacctggacagc

SEQ ID NO: 36706 - RNA, 39 nt, synthetic construct
  misc_feature 1..39: note = derived and/or modified sequence opt4 from anti-HIV_CDR
  source 1..39: mol_type = other RNA
gacggcagcggcgacgacagaaactggcacctggacccc

SEQ ID NO: 36707 - RNA, 39 nt, synthetic construct
  misc_feature 1..39: note = derived and/or modified sequence opt4 from anti-HIV_CDR
  source 1..39: mol_type = other RNA
gacagaagagacgacggcctggactggctgctggacccc

SEQ ID NO: 36708 - RNA, 39 nt, synthetic construct
  misc_feature 1..39: note = derived and/or modified sequence opt4 from anti-HIV_CDR
  source 1..39: mol_type = other RNA
gacggcggcggcgacgacagaacctggctgctggacgcc

SEQ ID NO: 36709 - RNA, 39 nt, synthetic construct
  misc_feature 1..39: note = derived and/or modified sequence opt4 from anti-HIV_CDR
  source 1..39: mol_type = other RNA
gacggcagcggcgacgccagagactggcacctgcacccc

SEQ ID NO: 36710 - RNA, 39 nt, synthetic construct
  misc_feature 1..39: note = derived and/or modified sequence opt4 from anti-HIV_CDR
  source 1..39: mol_type = other RNA
gacggcagcggcgacgacaccagctggtacctggacccc

SEQ ID NO: 36711 - RNA, 39 nt, synthetic construct
  misc_feature 1..39: note = derived and/or modified sequence opt4 from anti-HIV_CDR
  source 1..39: mol_type = other RNA
gacggcagcggcgacgacaccagctggcacctggacccc

SEQ ID NO: 36712 - RNA, 39 nt, synthetic construct
  misc_feature 1..39: note = derived and/or modified sequence opt4 from anti-HIV_CDR
  source 1..39: mol_type = other RNA
gacagaagagacgacgacagagcctggctgctggacccc

SEQ ID NO: 36713 - RNA, 39 nt, synthetic construct
  misc_feature 1..39: note = derived and/or modified sequence opt4 from anti-HIV_CDR
  source 1..39: mol_type = other RNA
gacggcagcggcgacgccagagactggcacctggacccc

SEQ ID NO: 36714 - RNA, 39 nt, synthetic construct
  misc_feature 1..39: note = derived and/or modified sequence opt4 from anti-HIV_CDR
  source 1..39: mol_type = other RNA
gacggcagcggcgacgccaccagctggcacctgcacccc

SEQ ID NO: 36715 - RNA, 39 nt, synthetic construct
  misc_feature 1..39: note = derived and/or modified sequence opt4 from anti-HIV_CDR
  source 1..39: mol_type = other RNA
gacgagagcggcgacgacctgaagtggcacctgcacccc

SEQ ID NO: 36716 - RNA, 39 nt, synthetic construct
  misc_feature 1..39: note = derived and/or modified sequence opt4 from anti-HIV_CDR
  source 1..39: mol_type = other RNA
gacggcagcggcgacgacaccagctggcacctgcacccc

SEQ ID NO: 36717 - RNA, 39 nt, synthetic construct
  misc_feature 1..39: note = derived and/or modified sequence opt4 from anti-HIV_CDR
  source 1..39: mol_type = other RNA
gcccagggcgacatcctgaccgagggctacttcgactac

SEQ ID NO: 36718 - RNA, 39 nt, synthetic construct
  misc_feature 1..39: note = derived and/or modified sequence opt4 from anti-HIV_CDR
  source 1..39: mol_type = other RNA
gacagaatgttctggcagcagctggccaagtacgacagc

SEQ ID NO: 36719 - RNA, 39 nt, synthetic construct
  misc_feature 1..39: note = derived and/or modified sequence opt4 from anti-HIV_CDR
  source 1..39: mol_type = other RNA
agcacctgggactacagcctgagcgcccacgaggacgtg

SEQ ID NO: 36720 - RNA, 39 nt, synthetic construct
  misc_feature 1..39: note = derived and/or modified sequence opt4 from anti-HIV_CDR
  source 1..39: mol_type = other RNA
gccgcctgggacgacagcctgagcggcctgaactgggtg

SEQ ID NO: 36721 - RNA, 39 nt, synthetic construct
  misc_feature 1..39: note = derived and/or modified sequence opt4 from anti-HIV_CDR
  source 1..39: mol_type = other RNA
ctgagcagcgacagaatcgtggtggtgggccccgactac

SEQ ID NO: 36722 - RNA, 39 nt, synthetic construct
  misc_feature 1..39: note = derived and/or modified sequence opt4 from anti-HIV_CDR
  source 1..39: mol_type = other RNA
gaggccggcagcgtgaccgccaccggccccttcgacagc

SEQ ID NO: 36723 - RNA, 39 nt, synthetic construct
  misc_feature 1..39: note = derived and/or modified sequence opt4 from anti-HIV_CDR
  source 1..39: mol_type = other RNA
gacttcggcagagcctacgccatcggctacttcgagtac

SEQ ID NO: 36724 - RNA, 39 nt, synthetic construct
  misc_feature 1..39: note = derived and/or modified sequence opt4 from anti-HIV_CDR
  source 1..39: mol_type = other RNA
gacagagccccctacggcgccttcgagcccttcgacttc

SEQ ID NO: 36725 - RNA, 39 nt, synthetic construct
  misc_feature 1..39: note = derived and/or modified sequence opt4 from anti-HIV_CDR
  source 1..39: mol_type = other RNA
aacggccacagcagcctgggcggcggctacttcccccac

SEQ ID NO: 36726 - RNA, 39 nt, synthetic construct
  misc_feature 1..39: note = derived and/or modified sequence opt4 from anti-HIV_CDR
  source 1..39: mol_type = other RNA
aacggccacagcgccctgggcggcgagtacttccagcac

SEQ ID NO: 36727 - RNA, 39 nt, synthetic construct
  misc_feature 1..39: note = derived and/or modified sequence opt4 from anti-HIV_CDR
  source 1..39: mol_type = other RNA
gccgccagaagagccttctactactactacatggacgtg

SEQ ID NO: 36728 - RNA, 39 nt, synthetic construct
  misc_feature 1..39: note = derived and/or modified sequence opt4 from anti-HIV_CDR
  source 1..39: mol_type = other RNA
gccaactactacgacagcagcggctacggcctggacatc

SEQ ID NO: 36729 - RNA, 39 nt, synthetic construct
  misc_feature 1..39: note = derived and/or modified sequence opt4 from anti-HIV_CDR
  source 1..39: mol_type = other RNA
cacagcagacccggcgcccccccccactacttcgactac

SEQ ID NO: 36730 - RNA, 39 nt, synthetic construct
  misc_feature 1..39: note = derived and/or modified sequence opt4 from anti-HIV_CDR
  source 1..39: mol_type = other RNA
ggcctgaccgtggccaccctgtacgacgccttcgacgtg

SEQ ID NO: 36731 - RNA, 39 nt, synthetic construct
  misc_feature 1..39: note = derived and/or modified sequence opt4 from anti-HIV_CDR
  source 1..39: mol_type = other RNA
agagacagatacaactggaagtactactacctggacgtg

SEQ ID NO: 36732 - RNA, 39 nt, synthetic construct
  misc_feature 1..39: note = derived and/or modified sequence opt4 from anti-HIV_CDR
  source 1..39: mol_type = other RNA
gacagaggcagcagcggctggtacggctggctggacccc

SEQ ID NO: 36733 - RNA, 39 nt, synthetic construct
  misc_feature 1..39: note = derived and/or modified sequence opt4 from anti-HIV_CDR
  source 1..39: mol_type = other RNA
gacagactgagcagcttctggagcggcggcatcgaccag

SEQ ID NO: 36734 - RNA, 39 nt, synthetic construct
  misc_feature 1..39: note = derived and/or modified sequence opt4 from anti-HIV_CDR
  source 1..39: mol_type = other RNA
gacgtgatcgtgggcgccctgctgggcgccttcgacatc

SEQ ID NO: 36735 - RNA, 39 nt, synthetic construct
  misc_feature 1..39: note = derived and/or modified sequence opt4 from anti-HIV_CDR
  source 1..39: mol_type = other RNA
cacctgatcgcccccaccgccggcaactacttctacccc

SEQ ID NO: 36736 - RNA, 39 nt, synthetic construct
  misc_feature 1..39: note = derived and/or modified sequence opt4 from anti-HIV_CDR
  source 1..39: mol_type = other RNA
gacagcagaccccaggccctggtggccgccctggacgtg

SEQ ID NO: 36737 - RNA, 39 nt, synthetic construct
  misc_feature 1..39: note = derived and/or modified sequence opt4 from anti-HIV_CDR
  source 1..39: mol_type = other RNA
gacgagatcgtgggcgccctgctgggcgccttcgacatc

SEQ ID NO: 36738 - RNA, 39 nt, synthetic construct
  misc_feature 1..39: note = derived and/or modified sequence opt4 from anti-HIV_CDR
  source 1..39: mol_type = other RNA
agcgaccccgccatcgccgccgccggcagcctggacctg

SEQ ID NO: 36739 - RNA, 39 nt, synthetic construct
  misc_feature 1..39: note = derived and/or modified sequence opt4 from anti-HIV_CDR
  source 1..39: mol_type = other RNA
ccctacgtgcagaccgtggccaccaccaccttcgacttc

SEQ ID NO: 36740 - RNA, 39 nt, synthetic construct
  misc_feature 1..39: note = derived and/or modified sequence opt4 from anti-HIV_CDR
  source 1..39: mol_type = other RNA
ggccccaagagcgtggccagcctgagctacttcgacaag

SEQ ID NO: 36741 - RNA, 39 nt, synthetic construct
  misc_feature 1..39: note = derived and/or modified sequence opt4 from anti-HIV_CDR
  source 1..39: mol_type = other RNA
ggcgccctgtggttcggccagctgagaggcctggacccc

SEQ ID NO: 36742 - RNA, 39 nt, synthetic construct
  misc_feature 1..39: note = derived and/or modified sequence opt4 from anti-HIV_CDR
  source 1..39: mol_type = other RNA
gacctgagacccatgagaggcaactgggccatgcacgtg

SEQ ID NO: 36743 - RNA, 39 nt, synthetic construct
  misc_feature 1..39: note = derived and/or modified sequence opt4 from anti-HIV_CDR
  source 1..39: mol_type = other RNA
gacccccaggtgaacagaagaggcaactgcttcgaccac

SEQ ID NO: 36744 - RNA, 39 nt, synthetic construct
  misc_feature 1..39: note = derived and/or modified sequence opt4 from anti-HIV_CDR
  source 1..39: mol_type = other RNA
gacccccagatcgagatcagaggcaacgccttcgacatc

SEQ ID NO: 36745 - RNA, 39 nt, synthetic construct
  misc_feature 1..39: note = derived and/or modified sequence opt4 from anti-HIV_CDR
  source 1..39: mol_type = other RNA
gtgcccagaaccaccgccaccagaaacgccttcgacatc

SEQ ID NO: 36746 - RNA, 39 nt, synthetic construct
  misc_feature 1..39: note = derived and/or modified sequence opt4 from anti-HIV_CDR
  source 1..39: mol_type = other RNA
cacaagagcgtgctgctgtggttcagagagctggactac

SEQ ID NO: 36747 - RNA, 39 nt, synthetic construct
  misc_feature 1..39: note = derived and/or modified sequence opt4 from anti-HIV_CDR
  source 1..39: mol_type = other RNA
gacagcgaggactacgtggactactactacatggacgtg

SEQ ID NO: 36748 - RNA, 39 nt, synthetic construct
  misc_feature 1..39: note = derived and/or modified sequence opt4 from anti-HIV_CDR
  source 1..39: mol_type = other RNA
ctgcccagaaccaccggcatcagaaacgccttcgacatc

SEQ ID NO: 36749 - RNA, 39 nt, synthetic construct
  misc_feature 1..39: note = derived and/or modified sequence opt4 from anti-HIV_CDR
  source 1..39: mol_type = other RNA
ctgcccagaaccaccggcatcagaaacgccttcgacttc

SEQ ID NO: 36750 - RNA, 42 nt, synthetic construct
  misc_feature 1..42: note = derived and/or modified sequence opt4 from anti-HIV_CDR
  source 1..42: mol_type = other RNA
ggcaccctgtggttcggcgagagcggcctgagactggaccac

SEQ ID NO: 36751 - RNA, 42 nt, synthetic construct
  misc_feature 1..42: note = derived and/or modified sequence opt4 from anti-HIV_CDR
  source 1..42: mol_type = other RNA
gtggcctacgtgcacgtggtgaccaccagaagcctggacaac

SEQ ID NO: 36752 - RNA, 42 nt, synthetic construct
  misc_feature 1..42: note = derived and/or modified sequence opt4 from anti-HIV_CDR
  source 1..42: mol_type = other RNA
gccgactacgacctgctgaccagcagctaccacttcgacagc

SEQ ID NO: 36753 - RNA, 42 nt, synthetic construct
  misc_feature 1..42: note = derived and/or modified sequence opt4 from anti-HIV_CDR
  source 1..42: mol_type = other RNA
accagatgcttcggcgccaactgcttcaacttcatggacgtg

SEQ ID NO: 36754 - RNA, 42 nt, synthetic construct
  misc_feature 1..42: note = derived and/or modified sequence opt4 from anti-HIV_CDR
  source 1..42: mol_type = other RNA
ggcggcctgtactgcagcagcatcagctgcatcatggacgtg

SEQ ID NO: 36755 - RNA, 42 nt, synthetic construct
  misc_feature 1..42: note = derived and/or modified sequence opt4 from anti-HIV_CDR
  source 1..42: mol_type = other RNA
aacgagccccagtaccacagcctgcccggcatgttcgactac

SEQ ID NO: 36756 - RNA, 42 nt, synthetic construct
  misc_feature 1..42: note = derived and/or modified sequence opt4 from anti-HIV_CDR
  source 1..42: mol_type = other RNA
gagcccagagagatgggcaccctgaccgccggcttcgagtac

SEQ ID NO: 36757 - RNA, 42 nt, synthetic construct
  misc_feature 1..42: note = derived and/or modified sequence opt4 from anti-HIV_CDR
  source 1..42: mol_type = other RNA
gccaccggctacagctacggctacctggacgccttcgacatc

SEQ ID NO: 36758 - RNA, 42 nt, synthetic construct
  misc_feature 1..42: note = derived and/or modified sequence opt4 from anti-HIV_CDR
  source 1..42: mol_type = other RNA
ggcagcctgtggttcggcgagagcggcctgagactggaccac

SEQ ID NO: 36759 - RNA, 42 nt, synthetic construct
  misc_feature 1..42: note = derived and/or modified sequence opt4 from anti-HIV_CDR
  source 1..42: mol_type = other RNA
gacaacaccatcagcggcgtggtgcccagatggttcgactac

SEQ ID NO: 36760 - RNA, 42 nt, synthetic construct
  misc_feature 1..42: note = derived and/or modified sequence opt4 from anti-HIV_CDR
  source 1..42: mol_type = other RNA
atctacgacggcagaggctactacagctacttcttcgacctg

SEQ ID NO: 36761 - RNA, 42 nt, synthetic construct
  misc_feature 1..42: note = derived and/or modified sequence opt4 from anti-HIV_CDR
  source 1..42: mol_type = other RNA
gacagattcaactggaacgacggcggctacttcttcgacagc

SEQ ID NO: 36762 - RNA, 42 nt, synthetic construct
  misc_feature 1..42: note = derived and/or modified sequence opt4 from anti-HIV_CDR
  source 1..42: mol_type = other RNA
ggccacagcagcagctggaccaagttcaactggttcggcccc

SEQ ID NO: 36763 - RNA, 42 nt, synthetic construct; identical to SEQ ID NO: 13837
  misc_feature 1..42: note = derived and/or modified sequence opt4 from anti-HIV_CDR
  source 1..42: mol_type = other RNA

SEQ ID NO: 36764 - RNA, 42 nt, synthetic construct
  misc_feature 1..42: note = derived and/or modified sequence opt4 from anti-HIV_CDR
  source 1..42: mol_type = other RNA
agcttctacgacaacggcggctactacctgggcctggactac

SEQ ID NO: 36765 - RNA, 42 nt, synthetic construct
  misc_feature 1..42: note = derived and/or modified sequence opt4 from anti-HIV_CDR
  source 1..42: mol_type = other RNA
gacaaggacgccagcatctacggctacagaatcctgaaccac

SEQ ID NO: 36766 - RNA, 42 nt, synthetic construct
  misc_feature 1..42: note = derived and/or modified sequence opt4 from anti-HIV_CDR
  source 1..42: mol_type = other RNA
gtgctgaccgacctggaccagggcaaccccagaatggacgtg

SEQ ID NO: 36767 - RNA, 42 nt, synthetic construct
  misc_feature 1..42: note = derived and/or modified sequence opt4 from anti-HIV_CDR
  source 1..42: mol_type = other RNA
agagagatcaagttcggcgagctgagcttctacttcgacagc

SEQ ID NO: 36768 - RNA, 42 nt, synthetic construct
  misc_feature 1..42: note = derived and/or modified sequence opt4 from anti-HIV_CDR
  source 1..42: mol_type = other RNA
agagagatcagattcggcgagctgagcttctacttcgactac

SEQ ID NO: 36769 - RNA, 42 nt, synthetic construct
  misc_feature 1..42: note = derived and/or modified sequence opt4 from anti-HIV_CDR
  source 1..42: mol_type = other RNA
ccccacagccccaccaacatccccagcagacccctggactac

SEQ ID NO: 36770 - RNA, 42 nt, synthetic construct
  misc_feature 1..42: note = derived and/or modified sequence opt4 from anti-HIV_CDR
  source 1..42: mol_type = other RNA
ggcgactacgacatcctgaccagcagctaccagttcgactac

SEQ ID NO: 36771 - RNA, 42 nt, synthetic construct
  misc_feature 1..42: note = derived and/or modified sequence opt4 from anti-HIV_CDR
  source 1..42: mol_type = other RNA
agcacccccctggtgtggccccccgccaacggcctggacgtg

SEQ ID NO: 36772 - RNA, 42 nt, synthetic construct
  misc_feature 1..42: note = derived and/or modified sequence opt4 from anti-HIV_CDR
  source 1..42: mol_type = other RNA
accagaaacaccggcaacagcctgccctactggttcgacctg

SEQ ID NO: 36773 - RNA, 45 nt, synthetic construct
  misc_feature 1..45: note = derived and/or modified sequence opt4 from anti-HIV_CDR
  source 1..45: mol_type = other RNA
gagaagggccagtggctgaccgtgcccccctactacttcgacagc

SEQ ID NO: 36774 - RNA, 45 nt, synthetic construct
  misc_feature 1..45: note = derived and/or modified sequence opt4 from anti-HIV_CDR
  source 1..45: mol_type = other RNA
ggcagcggcagatggaccatcggcgccagaatctacttcgacaac

SEQ ID NO: 36775 - RNA, 45 nt, synthetic construct; identical to SEQ ID NO: 13849
  misc_feature 1..45: note = derived and/or modified sequence opt4 from anti-HIV_CDR
  source 1..45: mol_type = other RNA

SEQ ID NO: 36776 - RNA, 45 nt, synthetic construct
  misc_feature 1..45: note = derived and/or modified sequence opt4 from anti-HIV_CDR
  source 1..45: mol_type = other RNA
ctggaggccgacggcggcgactacagccccaagatgttcgactac

SEQ ID NO: 36777 - RNA, 45 nt, synthetic construct; identical to SEQ ID NO: 13851
  misc_feature 1..45: note = derived and/or modified sequence opt4 from anti-HIV_CDR
  source 1..45: mol_type = other RNA

SEQ ID NO: 36778 - RNA, 45 nt, synthetic construct; identical to SEQ ID NO: 13852
  misc_feature 1..45: note = derived and/or modified sequence opt4 from anti-HIV_CDR
  source 1..45: mol_type = other RNA

SEQ ID NO: 36779 - RNA, 45 nt, synthetic construct
  misc_feature 1..45: note = derived and/or modified sequence opt4 from anti-HIV_CDR
  source 1..45: mol_type = other RNA
ctggaggccgacggcagcgactacagccccaagatgttcgacttc

SEQ ID NO: 36780 - RNA, 45 nt, synthetic construct; identical to SEQ ID NO: 13854
  misc_feature 1..45: note = derived and/or modified sequence opt4 from anti-HIV_CDR
  source 1..45: mol_type = other RNA

SEQ ID NO: 36781 - RNA, 45 nt, synthetic construct; identical to SEQ ID NO: 13855
  misc_feature 1..45: note = derived and/or modified sequence opt4 from anti-HIV_CDR
  source 1..45: mol_type = other RNA

SEQ ID NO: 36782 - RNA, 45 nt, synthetic construct
  misc_feature 1..45: note = derived and/or modified sequence opt4 from anti-HIV_CDR
  source 1..45: mol_type = other RNA
gcccccagactggacctgggcgagctgagcagcggcttccacttc

SEQ ID NO: 36783 - RNA, 45 nt, synthetic construct
  misc_feature 1..45: note = derived and/or modified sequence opt4 from anti-HIV_CDR
  source 1..45: mol_type = other RNA
gcccccagactggagctgggcgagctgagcagcggcttccactac

SEQ ID NO: 36784 - RNA, 45 nt, synthetic construct
  misc_feature 1..45: note = derived and/or modified sequence opt4 from anti-HIV_CDR
  source 1..45: mol_type = other RNA
ggcagactgctgatgcagtggccccccagaggcggcttcgacccc

SEQ ID NO: 36785 - RNA, 45 nt, synthetic construct
  misc_feature 1..45: note = derived and/or modified sequence opt4 from anti-HIV_CDR
  source 1..45: mol_type = other RNA
ggcagactgttcatgcagtggccccccagaggcggcttcgacccc

SEQ ID NO: 36786 - RNA, 45 nt, synthetic construct
  misc_feature 1..45: note = derived and/or modified sequence opt4 from anti-HIV_CDR
  source 1..45: mol_type = other RNA
ggcagactgttcgtgcagtggcccccccagggcggcttcgacccc

SEQ ID NO: 36787 - RNA, 45 nt, synthetic construct
  misc_feature 1..45: note = derived and/or modified sequence opt4 from anti-HIV_CDR
  source 1..45: mol_type = other RNA
ggcagactgttcatgcagtggcccccccagggcggcttcgacccc

SEQ ID NO: 36788 - RNA, 45 nt, synthetic construct
  misc_feature 1..45: note = derived and/or modified sequence opt4 from anti-HIV_CDR
  source 1..45: mol_type = other RNA
ggcagactgttcgtgcagtggcccccccagggcggcttcgacacc

SEQ ID NO: 36789 - RNA, 45 nt, synthetic construct
  misc_feature 1..45: note = derived and/or modified sequence opt4 from anti-HIV_CDR
  source 1..45: mol_type = other RNA
aacaacaacaccagaaagagcatcaacatcggccccggcagagcc

SEQ ID NO: 36790 - RNA, 45 nt, synthetic construct; identical to SEQ ID NO: 13864
  misc_feature 1..45: note = derived and/or modified sequence opt4 from anti-HIV_CDR
  source 1..45: mol_type = other RNA

SEQ ID NO: 36791 - RNA, 45 nt, synthetic construct
  misc_feature 1..45: note = derived and/or modified sequence opt4 from anti-HIV_CDR
  source 1..45: mol_type = other RNA
gacctgctgcccgactaccccgtgagcagcgcccccgaggacttc

SEQ ID NO: 36792 - RNA, 45 nt, synthetic construct
  misc_feature 1..45: note = derived and/or modified sequence opt4 from anti-HIV_CDR
  source 1..45: mol_type = other RNA
gagagctggctgtacagcaacggcgactactactacatggacgtg

SEQ ID NO: 36793 - RNA, 45 nt, synthetic construct
  misc_feature 1..45: note = derived and/or modified sequence opt4 from anti-HIV_CDR
  source 1..45: mol_type = other RNA
agatactgcagcagcaccacctgctacagaggccacttcgactac

SEQ ID NO: 36794 - RNA, 45 nt, synthetic construct
  misc_feature 1..45: note = derived and/or modified sequence opt4 from anti-HIV_CDR
  source 1..45: mol_type = other RNA
cagaccaccgacgagggcagacagtggctggtgggcttccagcac

SEQ ID NO: 36795 - RNA, 45 nt, synthetic construct
  misc_feature 1..45: note = derived and/or modified sequence opt4 from anti-HIV_CDR
  source 1..45: mol_type = other RNA
cccagctacggcggctacgacgaccagggctggtacttcgagtac

SEQ ID NO: 36796 - RNA, 45 nt, synthetic construct
  misc_feature 1..45: note = derived and/or modified sequence opt4 from anti-HIV_CDR
  source 1..45: mol_type = other RNA
gccgccatccccatcggcgacagcaagtacagctacttcgacagc

SEQ ID NO: 36797 - RNA, 45 nt, synthetic construct
  misc_feature 1..45: note = derived and/or modified sequence opt4 from anti-HIV_CDR
  source 1..45: mol_type = other RNA
gcccccccccccggcagcaccgagtgggcctactacttcgactac

SEQ ID NO: 36798 - RNA, 45 nt, synthetic construct
  misc_feature 1..45: note = derived and/or modified sequence opt4 from anti-HIV_CDR
  source 1..45: mol_type = other RNA
gcccagttccacaacagcggctactactacagcggcctggactac

SEQ ID NO: 36799 - RNA, 45 nt, synthetic construct
  misc_feature 1..45: note = derived and/or modified sequence opt4 from anti-HIV_CDR
  source 1..45: mol_type = other RNA
ggcggctacgactacggcgaccactactactactacatggacgtg

SEQ ID NO: 36800 - RNA, 45 nt, synthetic construct
  misc_feature 1..45: note = derived and/or modified sequence opt4 from anti-HIV_CDR
  source 1..45: mol_type = other RNA
ggcacccagagctacagcgccgtggcccccggctggttcgacccc

SEQ ID NO: 36801 - RNA, 45 nt, synthetic construct
  misc_feature 1..45: note = derived and/or modified sequence opt4 from anti-HIV_CDR
  source 1..45: mol_type = other RNA
atcaagggcccccccagaggcaacttcggcgtggccttctacttc

SEQ ID NO: 36802 - RNA, 45 nt, synthetic construct
  misc_feature 1..45: note = derived and/or modified sequence opt4 from anti-HIV_CDR
  source 1..45: mol_type = other RNA
aaggtgtacagcgacggctggagcccccccaccggcttcgtgtac

SEQ ID NO: 36803 - RNA, 45 nt, synthetic construct
  misc_feature 1..45: note = derived and/or modified sequence opt4 from anti-HIV_CDR
  source 1..45: mol_type = other RNA
agatacaagtacctgcccggcgaccagcacatgccctgggacaac

SEQ ID NO: 36804 - RNA, 45 nt, synthetic construct
  misc_feature 1..45: note = derived and/or modified sequence opt4 from anti-HIV_CDR
  source 1..45: mol_type = other RNA
agatacaagtacctgcccggcgaccagcacatgccctgggactac

SEQ ID NO: 36805 - RNA, 45 nt, synthetic construct
  misc_feature 1..45: note = derived and/or modified sequence opt4 from anti-HIV_CDR
  source 1..45: mol_type = other RNA
ggcggcggctacgccgtggtgggccccaagtacggcctggacgtg

SEQ ID NO: 36806 - RNA, 45 nt, synthetic construct
  misc_feature 1..45: note = derived and/or modified sequence opt4 from anti-HIV_CDR
  source 1..45: mol_type = other RNA
ctggacagcagcagcggctgggaggaggtgggctacttcgacaga

SEQ ID NO: 36807 - RNA, 45 nt, synthetic construct
  misc_feature 1..45: note = derived and/or modified sequence opt4 from anti-HIV_CDR
  source 1..45: mol_type = other RNA
gagaactacagcgacggctgggaggaggtgggccacttcgactac

SEQ ID NO: 36808 - RNA, 45 nt, synthetic construct
  misc_feature 1..45: note = derived and/or modified sequence opt4 from anti-HIV_CDR
  source 1..45: mol_type = other RNA
gagaactacagcgacggctgggaggaggtgggccacttcgacagc

SEQ ID NO: 36809 - RNA, 45 nt, synthetic construct
  misc_feature 1..45: note = derived and/or modified sequence opt4 from anti-HIV_CDR
  source 1..45: mol_type = other RNA
gagaactacagcgacggctggaacgaggtgggccacttcgacttc

SEQ ID NO: 36810 - RNA, 45 nt, synthetic construct
  misc_feature 1..45: note = derived and/or modified sequence opt4 from anti-HIV_CDR
  source 1..45: mol_type = other RNA
gagaactacagcgacggctggtacgaggtgggccacttcgacctg

SEQ ID NO: 36811 - RNA, 45 nt, synthetic construct
  misc_feature 1..45: note = derived and/or modified sequence opt4 from anti-HIV_CDR
  source 1..45: mol_type = other RNA
gacagaagaagattcctggagtggagcctgtacggcatggacgtg

SEQ ID NO: 36812 - RNA, 45 nt, synthetic construct
  misc_feature 1..45: note = derived and/or modified sequence opt4 from anti-HIV_CDR
  source 1..45: mol_type = other RNA
ggccccagagtgttcttcgagagcagcggctactacttcagagac

SEQ ID NO: 36813 - RNA, 45 nt, synthetic construct
  misc_feature 1..45: note = derived and/or modified sequence opt4 from anti-HIV_CDR
  source 1..45: mol_type = other RNA
ggccccagagtgctgttcgagagcagcggccactacctgagagac

SEQ ID NO: 36814 - RNA, 45 nt, synthetic construct
  misc_feature 1..45: note = derived and/or modified sequence opt4 from anti-HIV_CDR
  source 1..45: mol_type = other RNA
ggccccagagtgttcttcgagagcagcggctactacttcagaaac

SEQ ID NO: 36815 - RNA, 45 nt, synthetic construct
  misc_feature 1..45: note = derived and/or modified sequence opt4 from anti-HIV_CDR
  source 1..45: mol_type = other RNA
gagggcggcagcctgtggttcggcggcgccaactggctggacccc

SEQ ID NO: 36816 - RNA, 45 nt, synthetic construct
  misc_feature 1..45: note = derived and/or modified sequence opt4 from anti-HIV_CDR
  source 1..45: mol_type = other RNA
gccgactacgacaacatctgggacagcagaggcggcttcgacctg

SEQ ID NO: 36817 - RNA, 45 nt, synthetic construct
  misc_feature 1..45: note = derived and/or modified sequence opt4 from anti-HIV_CDR
  source 1..45: mol_type = other RNA
gtgggcggcaccgtgtggagcggctacagcaactacctggactac

SEQ ID NO: 36818 - RNA, 45 nt, synthetic construct
  misc_feature 1..45: note = derived and/or modified sequence opt4 from anti-HIV_CDR
  source 1..45: mol_type = other RNA
gacaacagagaccagtggctggtgctgagaagctggttcgacccc

SEQ ID NO: 36819 - RNA, 45 nt, synthetic construct
  misc_feature 1..45: note = derived and/or modified sequence opt4 from anti-HIV_CDR
  source 1..45: mol_type = other RNA
gagaagggccagtgggtgaccctgcccccctactacttcgacagc

SEQ ID NO: 36820 - RNA, 48 nt, synthetic construct
  misc_feature 1..48: note = derived and/or modified sequence opt4 from anti-HIV_CDR
  source 1..48: mol_type = other RNA
tacttcagcgacaccgacagaagcgagtacagccccagcctgagaagc

SEQ ID NO: 36821 - RNA, 48 nt, synthetic construct
  misc_feature 1..48: note = derived and/or modified sequence opt4 from anti-HIV_CDR
  source 1..48: mol_type = other RNA
tacatcagcgacagagagagcgccacctacaaccccagcctgaacagc

SEQ ID NO: 36822 - RNA, 48 nt, synthetic construct
  misc_feature 1..48: note = derived and/or modified sequence opt4 from anti-HIV_CDR
  source 1..48: mol_type = other RNA
tacttcagcgacaccgagaagagcaactacaaccccagcctgagaagc

SEQ ID NO: 36823 - RNA, 48 nt, synthetic construct
  misc_feature 1..48: note = derived and/or modified sequence opt4 from anti-HIV_CDR
  source 1..48: mol_type = other RNA
tacatcagcgacagagccagcgccacctacaaccccagcctgaacagc

SEQ ID NO: 36824 - RNA, 48 nt, synthetic construct
  misc_feature 1..48: note = derived and/or modified sequence opt4 from anti-HIV_CDR
  source 1..48: mol_type = other RNA
tacgtgcaccacagcggcgacaccaactacaaccccagcctgaagaga

SEQ ID NO: 36825 - RNA, 48 nt, synthetic construct
  misc_feature 1..48: note = derived and/or modified sequence opt4 from anti-HIV_CDR
  source 1..48: mol_type = other RNA
tacgtgcacaagagcggcgacaccaactacagccccagcctgaagagc

SEQ ID NO: 36826 - RNA, 48 nt, synthetic construct
  misc_feature 1..48: note = derived and/or modified sequence opt4 from anti-HIV_CDR
  source 1..48: mol_type = other RNA
tacgtgcacgacagcggcgacaccaactacaaccccagcctgaagagc

SEQ ID NO: 36827 - RNA, 48 nt, synthetic construct
  misc_feature 1..48: note = derived and/or modified sequence opt4 from anti-HIV_CDR
  source 1..48: mol_type = other RNA
tacatcagcaagagcgagagcgccaactacaaccccagcctgaacagc

SEQ ID NO: 36828 - RNA, 48 nt, synthetic construct
  misc_feature 1..48: note = derived and/or modified sequence opt4 from anti-HIV_CDR
  source 1..48: mol_type = other RNA
tacatctactacagcggcagcaccaactacaaccccagcctgaagagc

SEQ ID NO: 36829 - RNA, 48 nt, synthetic construct
  misc_feature 1..48: note = derived and/or modified sequence opt4 from anti-HIV_CDR
  source 1..48: mol_type = other RNA
tacgtgcacgacagcggcgacatcaactacaaccccagcctgaagaac

SEQ ID NO: 36830 - RNA, 48 nt, synthetic construct
  misc_feature 1..48: note = derived and/or modified sequence opt4 from anti-HIV_CDR
  source 1..48: mol_type = other RNA
agctactacgacttcagcatcggcgacggcaacgacgccttcgacgtg

SEQ ID NO: 36831 - RNA, 48 nt, synthetic construct
  misc_feature 1..48: note = derived and/or modified sequence opt4 from anti-HIV_CDR
  source 1..48: mol_type = other RNA
ggcttcagaggcagccccttcagcagcggcagcctgtacttcgacagc

SEQ ID NO: 36832 - RNA, 48 nt, synthetic construct
  misc_feature 1..48: note = derived and/or modified sequence opt4 from anti-HIV_CDR
  source 1..48: mol_type = other RNA
gtgatcagcggcagaatcaccatcttctactacaactacatcgacgtg

SEQ ID NO: 36833 - RNA, 48 nt, synthetic construct
  misc_feature 1..48: note = derived and/or modified sequence opt4 from anti-HIV_CDR
  source 1..48: mol_type = other RNA
gacggcctgggcgaggtggcccccgactacagatacggcatcgacgtg

SEQ ID NO: 36834 - RNA, 48 nt, synthetic construct
  misc_feature 1..48: note = derived and/or modified sequence opt4 from anti-HIV_CDR
  source 1..48: mol_type = other RNA
gacggcctgggcgagctggcccccgcctaccagtacggcatcgacgtg

SEQ ID NO: 36835 - RNA, 48 nt, synthetic construct
  misc_feature 1..48: note = derived and/or modified sequence opt4 from anti-HIV_CDR
  source 1..48: mol_type = other RNA
gacggcctgggcgagctggcccccgcctaccactacggcatcgacgtg

SEQ ID NO: 36836 - RNA, 48 nt, synthetic construct
  misc_feature 1..48: note = derived and/or modified sequence opt4 from anti-HIV_CDR
  source 1..48: mol_type = other RNA
gacggcctgggcgaggtggcccccgcctacctgtacggcatcgacgcc

SEQ ID NO: 36837 - RNA, 48 nt, synthetic construct
  misc_feature 1..48: note = derived and/or modified sequence opt4 from anti-HIV_CDR
  source 1..48: mol_type = other RNA
gccgtgaagggcttctggttcgacgaggtgtacaactggttcggcccc

SEQ ID NO: 36838 - RNA, 48 nt, synthetic construct
  misc_feature 1..48: note = derived and/or modified sequence opt4 from anti-HIV_CDR
  source 1..48: mol_type = other RNA
gccgtgaagggcttctggttcgacgacccctacacctggttcggcccc

SEQ ID NO: 36839 - RNA, 48 nt, synthetic construct
  misc_feature 1..48: note = derived and/or modified sequence opt4 from anti-HIV_CDR
  source 1..48: mol_type = other RNA
gccgtgaagggcttctggttcgacgagcccagcacctggttcggcccc

SEQ ID NO: 36840 - RNA, 48 nt, synthetic construct
  misc_feature 1..48: note = derived and/or modified sequence opt4 from anti-HIV_CDR
  source 1..48: mol_type = other RNA
gccgtgaagggcctgtggttcgacgagacctacacctggttcggcccc

SEQ ID NO: 36841 - RNA, 48 nt, synthetic construct
  misc_feature 1..48: note = derived and/or modified sequence opt4 from anti-HIV_CDR
  source 1..48: mol_type = other RNA
gccgtggccggcctgtggttcgaggacgcctacaactggttcggcccc

SEQ ID NO: 36842 - RNA, 48 nt, synthetic construct
  misc_feature 1..48: note = derived and/or modified sequence opt4 from anti-HIV_CDR
  source 1..48: mol_type = other RNA
gccgaggccgagagccagagccacagcagacccatcatgttcgactac

SEQ ID NO: 36843 - RNA, 48 nt, synthetic construct
  misc_feature 1..48: note = derived and/or modified sequence opt4 from anti-HIV_CDR
  source 1..48: mol_type = other RNA
gccgaggccgccagcgacagccacagcagacccatcatgttcgaccac

SEQ ID NO: 36844 - RNA, 48 nt, synthetic construct
  misc_feature 1..48: note = derived and/or modified sequence opt4 from anti-HIV_CDR
  source 1..48: mol_type = other RNA
ctggaggccgagagcgacagccacagcagacccatcatgttcgaccac

SEQ ID NO: 36845 - RNA, 48 nt, synthetic construct
  misc_feature 1..48: note = derived and/or modified sequence opt4 from anti-HIV_CDR
  source 1..48: mol_type = other RNA
gccgaggccgagagccagagccacagcagacccatcatgttcgacagc

SEQ ID NO: 36846 - RNA, 48 nt, synthetic construct
  misc_feature 1..48: note = derived and/or modified sequence opt4 from anti-HIV_CDR
  source 1..48: mol_type = other RNA
gccgaggccgagagccagagccacagcagacccatcatgttcgacttc

SEQ ID NO: 36847 - RNA, 48 nt, synthetic construct
  misc_feature 1..48: note = derived and/or modified sequence opt4 from anti-HIV_CDR
  source 1..48: mol_type = other RNA
gacaaccccctgctgcagagcggcgagttcagcagcagcctggagaac

SEQ ID NO: 36848 - RNA, 48 nt, synthetic construct
  misc_feature 1..48: note = derived and/or modified sequence opt4 from anti-HIV_CDR
  source 1..48: mol_type = other RNA
gacaaccccctgctgcagagcggcgagttcagcagcagcctggacaac

SEQ ID NO: 36849 - RNA, 48 nt, synthetic construct
  misc_feature 1..48: note = derived and/or modified sequence opt4 from anti-HIV_CDR
  source 1..48: mol_type = other RNA
ggcagagactacaacttctggggcggcggcggcaagatcaacttcccc

SEQ ID NO: 36850 - RNA, 48 nt, synthetic construct
  misc_feature 1..48: note = derived and/or modified sequence opt4 from anti-HIV_CDR
  source 1..48: mol_type = other RNA
accaactgggccaacgacttcgtgaccggctactacagattcgacttc

SEQ ID NO: 36851 - RNA, 48 nt, synthetic construct
  misc_feature 1..48: note = derived and/or modified sequence opt4 from anti-HIV_CDR
  source 1..48: mol_type = other RNA
gccggccactgcagcagcaccagcagcgtgtactgccccttcgacatg

SEQ ID NO: 36852 - RNA, 48 nt, synthetic construct
  misc_feature 1..48: note = derived and/or modified sequence opt4 from anti-HIV_CDR
  source 1..48: mol_type = other RNA
caggtgagcagctacagcagcagcggctacagaagagagttcgactac

SEQ ID NO: 36853 - RNA, 48 nt, synthetic construct
  misc_feature 1..48: note = derived and/or modified sequence opt4 from anti-HIV_CDR
  source 1..48: mol_type = other RNA
agaatggccaccctgaccggcggctactactactactacatggacgtg

SEQ ID NO: 36854 - RNA, 48 nt, synthetic construct
  misc_feature 1..48: note = derived and/or modified sequence opt4 from anti-HIV_CDR
  source 1..48: mol_type = other RNA
gagggcggctacagcgacttctggagcggctacagcggcttcgactac

SEQ ID NO: 36855 - RNA, 48 nt, synthetic construct
  misc_feature 1..48: note = derived and/or modified sequence opt4 from anti-HIV_CDR
  source 1..48: mol_type = other RNA
ctgtactacaacttcggcagcggctacgacaccggcatcggcgaccac

SEQ ID NO: 36856 - RNA, 48 nt, synthetic construct
  misc_feature 1..48: note = derived and/or modified sequence opt4 from anti-HIV_CDR
  source 1..48: mol_type = other RNA
gccagagagggcagatggttcagcgacaactactacgccatggacgtg

SEQ ID NO: 36857 - RNA, 48 nt, synthetic construct
  misc_feature 1..48: note = derived and/or modified sequence opt4 from anti-HIV_CDR
  source 1..48: mol_type = other RNA
gacagagtgggcagaagactgggcgagctgagcgccggcttcgactac

SEQ ID NO: 36858 - RNA, 48 nt, synthetic construct
  misc_feature 1..48: note = derived and/or modified sequence opt4 from anti-HIV_CDR
  source 1..48: mol_type = other RNA
gccagacccagaagcccctgggacagcaccggctggagcgtgggctac

SEQ ID NO: 36859 - RNA, 48 nt, synthetic construct
  misc_feature 1..48: note = derived and/or modified sequence opt4 from anti-HIV_CDR
  source 1..48: mol_type = other RNA
agctactacgacttcagaagcgacagcggcaacgacgccttcgacatc

SEQ ID NO: 36860 - RNA, 48 nt, synthetic construct
  misc_feature 1..48: note = derived and/or modified sequence opt4 from anti-HIV_CDR
  source 1..48: mol_type = other RNA
agctactacgacttccagaccgacagcggcaacgacgccttcgacgtg

SEQ ID NO: 36861 - RNA, 48 nt, synthetic construct
  misc_feature 1..48: note = derived and/or modified sequence opt4 from anti-HIV_CDR
  source 1..48: mol_type = other RNA
gacaaccccgtgctgcagctgggcgagctgagcagcagcctggactac

SEQ ID NO: 36862 - RNA, 48 nt, synthetic construct
  misc_feature 1..48: note = derived and/or modified sequence opt4 from anti-HIV_CDR
  source 1..48: mol_type = other RNA
ggcttcagaggcagccccttcagcagcggcagcatgtacttcgacagc

SEQ ID NO: 36863 - RNA, 48 nt, synthetic construct
  misc_feature 1..48: note = derived and/or modified sequence opt4 from anti-HIV_CDR
  source 1..48: mol_type = other RNA
ggcttcagaggcagccccctgagcagcggcagcctgtacttcgacagc

SEQ ID NO: 36864 - RNA, 48 nt, synthetic construct
  misc_feature 1..48: note = derived and/or modified sequence opt4 from anti-HIV_CDR
  source 1..48: mol_type = other RNA
ggcttcagaggcaacgtgttcagcaccggctggttctacctggacttc

SEQ ID NO: 36865 - RNA, 48 nt, synthetic construct
  misc_feature 1..48: note = derived and/or modified sequence opt4 from anti-HIV_CDR
  source 1..48: mol_type = other RNA
gacagactgagcttcagcgtgcaggtggagcagggcgtgctggactac

SEQ ID NO: 36866 - RNA, 48 nt, synthetic construct
  misc_feature 1..48: note = derived and/or modified sequence opt4 from anti-HIV_CDR
  source 1..48: mol_type = other RNA
gacagactgagcttcagcgtgcaggtggagcagggcgtgctgcagttc

SEQ ID NO: 36867 - RNA, 48 nt, synthetic construct
  misc_feature 1..48: note = derived and/or modified sequence opt4 from anti-HIV_CDR
  source 1..48: mol_type = other RNA
gtgctgagcggcagaatcaccatcttctactactactacatggacgtg

SEQ ID NO: 36868 - RNA, 51 nt, synthetic construct
  misc_feature 1..51: note = derived and/or modified sequence opt4 from anti-HIV_CDR
  source 1..51: mol_type = other RNA
tacatcagcagcggcagcagcaccctgcactacgccgacaccgtgaagggc

SEQ ID NO: 36869 - RNA, 51 nt, synthetic construct
  misc_feature 1..51: note = derived and/or modified sequence opt4 from anti-HIV_CDR
  source 1..51: mol_type = other RNA
agatacctggactggagccccatcggcagagacacctacggcaccgacgtg

SEQ ID NO: 36870 - RNA, 51 nt, synthetic construct
  misc_feature 1..51: note = derived and/or modified sequence opt4 from anti-HIV_CDR
  source 1..51: mol_type = other RNA
agatacttcgactggagccccttcagaagagacacctacggcaccgacgtg

SEQ ID NO: 36871 - RNA, 51 nt, synthetic construct
  misc_feature 1..51: note = derived and/or modified sequence opt4 from anti-HIV_CDR
  source 1..51: mol_type = other RNA
ggcagagactacaacttctggagcggcggcggcagatactacttcgacttc

SEQ ID NO: 36872 - RNA, 51 nt, synthetic construct
  misc_feature 1..51: note = derived and/or modified sequence opt4 from anti-HIV_CDR
  source 1..51: mol_type = other RNA
ggcatccaggaggactacgacttctggagagagtacagagagctggactac

SEQ ID NO: 36873 - RNA, 51 nt, synthetic construct
  misc_feature 1..51: note = derived and/or modified sequence opt4 from anti-HIV_CDR
  source 1..51: mol_type = other RNA
gtgctgaacaacaacaccagaaagagcatcaacatcggccccggcagagcc

SEQ ID NO: 36874 - RNA, 51 nt, synthetic construct
  misc_feature 1..51: note = derived and/or modified sequence opt4 from anti-HIV_CDR
  source 1..51: mol_type = other RNA
gacctgaacttcggcgtggtgaccccctactactactactacctggacgtg

SEQ ID NO: 36875 - RNA, 51 nt, synthetic construct
  misc_feature 1..51: note = derived and/or modified sequence opt4 from anti-HIV_CDR
  source 1..51: mol_type = other RNA
cacggcagaaccgtgttcggcgtggtgagaaactactactacatggacgtg

SEQ ID NO: 36876 - RNA, 51 nt, synthetic construct
  misc_feature 1..51: note = derived and/or modified sequence opt4 from anti-HIV_CDR
  source 1..51: mol_type = other RNA
cactactacggcagcggcctgaccaaggactactacgagtacatcgacgtg

SEQ ID NO: 36877 - RNA, 51 nt, synthetic construct
  misc_feature 1..51: note = derived and/or modified sequence opt4 from anti-HIV_CDR
  source 1..51: mol_type = other RNA
acctactacaacttctggagcgaccagagccagggcctggacttcgactac

SEQ ID NO: 36878 - RNA, 51 nt, synthetic construct
  misc_feature 1..51: note = derived and/or modified sequence opt4 from anti-HIV_CDR
  source 1..51: mol_type = other RNA
ggcgtgtgggaggcccccgacggcagcagctactactactacatggccgac

SEQ ID NO: 36879 - RNA, 51 nt, synthetic construct
  misc_feature 1..51: note = derived and/or modified sequence opt4 from anti-HIV_CDR
  source 1..51: mol_type = other RNA
gaccagggcggctaccccgtgagccccgtgggccccaagtggttcgacccc

SEQ ID NO: 36880 - RNA, 51 nt, synthetic construct
  misc_feature 1..51: note = derived and/or modified sequence opt4 from anti-HIV_CDR
  source 1..51: mol_type = other RNA
agagacaagtaccagtacatcgacagcagcggcgactaccccttcgacaga

SEQ ID NO: 36881 - RNA, 51 nt, synthetic construct
  misc_feature 1..51: note = derived and/or modified sequence opt4 from anti-HIV_CDR
  source 1..51: mol_type = other RNA
cagctgagagcccccaccaccagattcagacacggcggctacttcgagaac

SEQ ID NO: 36882 - RNA, 51 nt, synthetic construct
  misc_feature 1..51: note = derived and/or modified sequence opt4 from anti-HIV_CDR
  source 1..51: mol_type = other RNA
caggtgagagcccccaccctgagattcagacacggcggctacttcgagacc

SEQ ID NO: 36883 - RNA, 51 nt, synthetic construct
  misc_feature 1..51: note = derived and/or modified sequence opt4 from anti-HIV_CDR
  source 1..51: mol_type = other RNA
gtgagcatcacctacgccggcctgatcgtggtgcccggcgccttcgacgtg

SEQ ID NO: 36884 - RNA, 51 nt, synthetic construct
  misc_feature 1..51: note = derived and/or modified sequence opt4 from anti-HIV_CDR
  source 1..51: mol_type = other RNA
gtggccatcagctacgccggcctgatcgtggtgcccggccccttcgacgtg

SEQ ID NO: 36885 - RNA, 51 nt, synthetic construct
  misc_feature 1..51: note = derived and/or modified sequence opt4 from anti-HIV_CDR
  source 1..51: mol_type = other RNA
agcctgaccggcagactgcacctgggcgagctgagcagcggcatcggcccc

SEQ ID NO: 36886 - RNA, 51 nt, synthetic construct
  misc_feature 1..51: note = derived and/or modified sequence opt4 from anti-HIV_CDR
  source 1..51: mol_type = other RNA
ggcggcagcgccctgatcaccatcttcggcgtggaccccaagttcgacccc

SEQ ID NO: 36887 - RNA, 51 nt, synthetic construct
  misc_feature 1..51: note = derived and/or modified sequence opt4 from anti-HIV_CDR
  source 1..51: mol_type = other RNA
atggccctgaccagcggcccctacgacgtgagcggctactacttcgactac

SEQ ID NO: 36888 - RNA, 51 nt, synthetic construct
  misc_feature 1..51: note = derived and/or modified sequence opt4 from anti-HIV_CDR
  source 1..51: mol_type = other RNA
atggccctggccagcggcccctacgacgtgagcggctactacttcgactac

SEQ ID NO: 36889 - RNA, 51 nt, synthetic construct
  misc_feature 1..51: note = derived and/or modified sequence opt4 from anti-HIV_CDR
  source 1..51: mol_type = other RNA
atggccctgcccagcggccccctggacagaagcggctactacttcgacgac

SEQ ID NO: 36890 - RNA, 54 nt, synthetic construct
  misc_feature 1..54: note = derived and/or modified sequence opt4 from anti-HIV_CDR
  source 1..54: mol_type = other RNA
gtggtgcccatgttcagcatcttcggcgtggtgaaggccaactacttcgactac

SEQ ID NO: 36891 - RNA, 54 nt, synthetic construct
  misc_feature 1..54: note = derived and/or modified sequence opt4 from anti-HIV_CDR
  source 1..54: mol_type = other RNA
aacagaagagtggccatgcccgaggccatgatcctgagcttctacatggacgtg

SEQ ID NO: 36892 - RNA, 54 nt, synthetic construct
  misc_feature 1..54: note = derived and/or modified sequence opt4 from anti-HIV_CDR
  source 1..54: mol_type = other RNA
ggcctgtgcagaggcggcaactgcagactgggccccagcggctggctggacccc

SEQ ID NO: 36893 - RNA, 54 nt, synthetic construct
  misc_feature 1..54: note = derived and/or modified sequence opt4 from anti-HIV_CDR
  source 1..54: mol_type = other RNA
acccccccccactacgacgtgctgaccggctaccccagcagcgtgctggagttc

SEQ ID NO: 36894 - RNA, 54 nt, synthetic construct
  misc_feature 1..54: note = derived and/or modified sequence opt4 from anti-HIV_CDR
  source 1..54: mol_type = other RNA
atcccctaccacagcgagagctactacaaggtggtgatcggcggcttcgacgtg

SEQ ID NO: 36895 - RNA, 54 nt, synthetic construct
  misc_feature 1..54: note = derived and/or modified sequence opt4 from anti-HIV_CDR
  source 1..54: mol_type = other RNA
gccgaccccttcaaggtggcccaggacgagggcctgttcgtgatcttcgactac

SEQ ID NO: 36896 - RNA, 54 nt, synthetic construct
  misc_feature 1..54: note = derived and/or modified sequence opt4 from anti-HIV_CDR
  source 1..54: mol_type = other RNA
gccgaccccttcaaggtggcccaggacgagggcctgtacgtgatcttcgactac

SEQ ID NO: 36897 - RNA, 54 nt, synthetic construct
  misc_feature 1..54: note = derived and/or modified sequence opt4 from anti-HIV_CDR
  source 1..54: mol_type = other RNA
gccgacagattcaaggtggcccaggacgagggcctgttcgtgatcttcgactac

SEQ ID NO: 36898 - RNA, 54 nt, synthetic construct
  misc_feature 1..54: note = derived and/or modified sequence opt4 from anti-HIV_CDR
  source 1..54: mol_type = other RNA
ggcagacagaccttcagagccatctggagcggcccccccgccgtgttcgacatc

SEQ ID NO: 36899 - RNA, 54 nt, synthetic construct
  misc_feature 1..54: note = derived and/or modified sequence opt4 from anti-HIV_CDR
  source 1..54: mol_type = other RNA
ggcagacagaccttcagagccatctggagcggcccccccgtggtgttcgacatc

SEQ ID NO: 36900 - RNA, 54 nt, synthetic construct
  misc_feature 1..54: note = derived and/or modified sequence opt4 from anti-HIV_CDR
  source 1..54: mol_type = other RNA
agcagaggcgactacaacttctggagcggctaccccgagtaccacttcgacaga

SEQ ID NO: 36901 - RNA, 54 nt, synthetic construct
  misc_feature 1..54: note = derived and/or modified sequence opt4 from anti-HIV_CDR
  source 1..54: mol_type = other RNA
ctgcccaagagcagaatggtgggcggcgaccacctgcccttctaccccgacttc

SEQ ID NO: 36902 - RNA, 54 nt, synthetic construct
  misc_feature 1..54: note = derived and/or modified sequence opt4 from anti-HIV_CDR
  source 1..54: mol_type = other RNA
ctgaccggccccagcggctactgcgacagcagcggctgctactggttcgacccc

SEQ ID NO: 36903 - RNA, 54 nt, synthetic construct
  misc_feature 1..54: note = derived and/or modified sequence opt4 from anti-HIV_CDR
  source 1..54: mol_type = other RNA
ggcggcagcatgatcagaggcgtgcccagccccttctactacggcatggacgtg

SEQ ID NO: 36904 - RNA, 54 nt, synthetic construct
  misc_feature 1..54: note = derived and/or modified sequence opt4 from anti-HIV_CDR
  source 1..54: mol_type = other RNA
ctgttcggcgccaagagactgggcgtggcccccagcggctactacatggacgtg

SEQ ID NO: 36905 - RNA, 54 nt, synthetic construct
  misc_feature 1..54: note = derived and/or modified sequence opt4 from anti-HIV_CDR
  source 1..54: mol_type = other RNA
gacagatacgaggccgcctggttcggcgccgacaaggtgtacggcatggacgtg

SEQ ID NO: 36906 - RNA, 54 nt, synthetic construct
  misc_feature 1..54: note = derived and/or modified sequence opt4 from anti-HIV_CDR
  source 1..54: mol_type = other RNA
gagcacagactgcccccccccaccggcagaagaaccagaaactggttcgacccc

SEQ ID NO: 36907 - RNA, 54 nt, synthetic construct
  misc_feature 1..54: note = derived and/or modified sequence opt4 from anti-HIV_CDR
  source 1..54: mol_type = other RNA
ggcagaggcagcttccagggcttccagcagtacgagtactacggcatggacgtg

SEQ ID NO: 36908 - RNA, 54 nt, synthetic construct
  misc_feature 1..54: note = derived and/or modified sequence opt4 from anti-HIV_CDR
  source 1..54: mol_type = other RNA
ggcagaggctacagccacggcttccagcagtacaactactacggcatggacgtg

SEQ ID NO: 36909 - RNA, 54 nt, synthetic construct
  misc_feature 1..54: note = derived and/or modified sequence opt4 from anti-HIV_CDR
  source 1..54: mol_type = other RNA
ggcagaggcagcttcaccggcttcgaccagtaccactactacggcatggacgtg

SEQ ID NO: 36910 - RNA, 54 nt, synthetic construct
  misc_feature 1..54: note = derived and/or modified sequence opt4 from anti-HIV_CDR
  source 1..54: mol_type = other RNA
ggcagaggcagcaccttccccagcgcccagttcagctacttcggcctggacgtg

SEQ ID NO: 36911 - RNA, 54 nt, synthetic construct
  misc_feature 1..54: note = derived and/or modified sequence opt4 from anti-HIV_CDR
  source 1..54: mol_type = other RNA
gacctggccagatacggcgtgaccagcatcgtgcccgagttcggcttcgacttc

SEQ ID NO: 36912 - RNA, 54 nt, synthetic construct
  misc_feature 1..54: note = derived and/or modified sequence opt4 from anti-HIV_CDR
  source 1..54: mol_type = other RNA
agaggcagactgaacatccccagccccagcgccatcctgaccgccttcgacgtg

SEQ ID NO: 36913 - RNA, 54 nt, synthetic construct
  misc_feature 1..54: note = derived and/or modified sequence opt4 from anti-HIV_CDR
  source 1..54: mol_type = other RNA
ggccccggcagcatggtgagaggcctgatcgtgaccagctacggcatggacgtg

SEQ ID NO: 36914 - RNA, 54 nt, synthetic construct
  misc_feature 1..54: note = derived and/or modified sequence opt4 from anti-HIV_CDR
  source 1..54: mol_type = other RNA
aagagagtgaccatcttcggcgtggtggacacccccagaggctacttcgactac

SEQ ID NO: 36915 - RNA, 54 nt, synthetic construct
  misc_feature 1..54: note = derived and/or modified sequence opt4 from anti-HIV_CDR
  source 1..54: mol_type = other RNA
ggccagagaaacgtgctgcacttcctggagagaaagaacgacgccttcgacatc

SEQ ID NO: 36916 - RNA, 54 nt, synthetic construct
  misc_feature 1..54: note = derived and/or modified sequence opt4 from anti-HIV_CDR
  source 1..54: mol_type = other RNA
gagcagaaggactacgacttctggaacggcctgtacaagtacggcatggacgtg

SEQ ID NO: 36917 - RNA, 57 nt, synthetic construct; identical to SEQ ID NO: 21633
  misc_feature 1..57: note = derived and/or modified sequence opt4 from anti-HIV_CDR
  source 1..57: mol_type = other RNA

SEQ ID NO: 36918 - RNA, 57 nt, synthetic construct
  misc_feature 1..57: note = derived and/or modified sequence opt4 from anti-HIV_CDR
  source 1..57: mol_type = other RNA
gccggcctggactacaacttctggaacggcaagggcagaaagggcgccttcgacgtg

SEQ ID NO: 36919 - RNA, 57 nt, synthetic construct
  misc_feature 1..57: note = derived and/or modified sequence opt4 from anti-HIV_CDR
  source 1..57: mol_type = other RNA
aacgaggccgactaccacgacggcaacggccacagcctgagaggcatgttcgactac

SEQ ID NO: 36920 - RNA, 57 nt, synthetic construct
  misc_feature 1..57: note = derived and/or modified sequence opt4 from anti-HIV_CDR
  source 1..57: mol_type = other RNA
aacgagccccagtaccacgacggcaacggccacagcctgcccggcatgttcgacagc

SEQ ID NO: 36921 - RNA, 57 nt, synthetic construct
  misc_feature 1..57: note = derived and/or modified sequence opt4 from anti-HIV_CDR
  source 1..57: mol_type = other RNA
aacgagccccagtaccacgacgacaacggccacagcctgcccggcatgatcgactac

SEQ ID NO: 36922 - RNA, 57 nt, synthetic construct
  misc_feature 1..57: note = derived and/or modified sequence opt4 from anti-HIV_CDR
  source 1..57: mol_type = other RNA
aacgagccccagtaccacgacggcaacggccacagcctgcccggcatgttcgacttc

SEQ ID NO: 36923 - RNA, 57 nt, synthetic construct
  misc_feature 1..57: note = derived and/or modified sequence opt4 from anti-HIV_CDR
  source 1..57: mol_type = other RNA
aacgagccccagtacttcgacggcagcggccacagcctgcccggcatgttcgactac

SEQ ID NO: 36924 - RNA, 57 nt, synthetic construct
  misc_feature 1..57: note = derived and/or modified sequence opt4 from anti-HIV_CDR
  source 1..57: mol_type = other RNA
agagaggccgactaccacgacggcaacggccacaccctgcccggcatgttcgacttc

SEQ ID NO: 36925 - RNA, 57 nt, synthetic construct
  misc_feature 1..57: note = derived and/or modified sequence opt4 from anti-HIV_CDR
  source 1..57: mol_type = other RNA
aacgagccccagtactacgacggcagcggccacagcctgcccggcatgttcgactac

SEQ ID NO: 36926 - RNA, 57 nt, synthetic construct
  misc_feature 1..57: note = derived and/or modified sequence opt4 from anti-HIV_CDR
  source 1..57: mol_type = other RNA
aacgagccccagtaccacgacggcaacggccacagcctgcccggcatgttcgactac

SEQ ID NO: 36927 - RNA, 57 nt, synthetic construct
  misc_feature 1..57: note = derived and/or modified sequence opt4 from anti-HIV_CDR
  source 1..57: mol_type = other RNA
caggacagcgacttccacgacggccacggccacaccctgagaggcatgttcgacagc

SEQ ID NO: 36928 - RNA, 57 nt, synthetic construct
  misc_feature 1..57: note = derived and/or modified sequence opt4 from anti-HIV_CDR
  source 1..57: mol_type = other RNA
ctggactgggtgagaggcgtgatgaacctggtggagaaccactacgccatggacgtg

SEQ ID NO: 36929 - RNA, 57 nt, synthetic construct
  misc_feature 1..57: note = derived and/or modified sequence opt4 from anti-HIV_CDR
  source 1..57: mol_type = other RNA
accaacggcaccgagatcttcagacccggcggcggcgacatgagagacaactggaga

SEQ ID NO: 36930 - RNA, 57 nt, synthetic construct
  misc_feature 1..57: note = derived and/or modified sequence opt4 from anti-HIV_CDR
  source 1..57: mol_type = other RNA
gacggcagatacagcggcgacgaccagtactactaccactactactacatggacgtg

SEQ ID NO: 36931 - RNA, 57 nt, synthetic construct
  misc_feature 1..57: note = derived and/or modified sequence opt4 from anti-HIV_CDR
  source 1..57: mol_type = other RNA
ctgaccaagaaccccagccaggacttctggggcagctacctgtactacttcgaggac

SEQ ID NO: 36932 - RNA, 57 nt, synthetic construct
  misc_feature 1..57: note = derived and/or modified sequence opt4 from anti-HIV_CDR
  source 1..57: mol_type = other RNA
ggcgccacctactactacgacagcagcggccaccagagcagaagagccttcgacatc

SEQ ID NO: 36933 - RNA, 57 nt, synthetic construct
  misc_feature 1..57: note = derived and/or modified sequence opt4 from anti-HIV_CDR
  source 1..57: mol_type = other RNA
gccttccaggccagcatggtgagaggcgtgatcgtggacccctacggcatggacgtg

SEQ ID NO: 36934 - RNA, 57 nt, synthetic construct
  misc_feature 1..57: note = derived and/or modified sequence opt4 from anti-HIV_CDR
  source 1..57: mol_type = other RNA
cacagagccgactacgacttctggaacggcagcaacctgagaggctacttcgacccc

SEQ ID NO: 36935 - RNA, 57 nt, synthetic construct
  misc_feature 1..57: note = derived and/or modified sequence opt4 from anti-HIV_CDR
  source 1..57: mol_type = other RNA
cacagagccaactacgacttctggggcggcagcaacctgagaggctacttcgacccc

SEQ ID NO: 36936 - RNA, 57 nt, synthetic construct
  misc_feature 1..57: note = derived and/or modified sequence opt4 from anti-HIV_CDR
  source 1..57: mol_type = other RNA
ggcttccacttctggagcggcaccggcaccagacccagaaactggtacttcgacctg

SEQ ID NO: 36937 - RNA, 57 nt, synthetic construct
  misc_feature 1..57: note = derived and/or modified sequence opt4 from anti-HIV_CDR
  source 1..57: mol_type = other RNA
aactacctgatcgagagcagatacgacgagaaggactactactacgccatggacgtg

SEQ ID NO: 36938 - RNA, 57 nt, synthetic construct
  misc_feature 1..57: note = derived and/or modified sequence opt4 from anti-HIV_CDR
  source 1..57: mol_type = other RNA
agcagaggctacgcctacgacagcggcggccactacttccccacctggttcgacccc

SEQ ID NO: 36939 - RNA, 57 nt, synthetic construct
  misc_feature 1..57: note = derived and/or modified sequence opt4 from anti-HIV_CDR
  source 1..57: mol_type = other RNA
gacaccaccaccttcggcgccttcggcggcagccccaacatgggcggcctggacccc

SEQ ID NO: 36940 - RNA, 57 nt, synthetic construct
  misc_feature 1..57: note = derived and/or modified sequence opt4 from anti-HIV_CDR
  source 1..57: mol_type = other RNA
cacctggtggtggccgtggccgccggccccgactacttcagctacggcatggacgtg

SEQ ID NO: 36941 - RNA, 57 nt, synthetic construct
  misc_feature 1..57: note = derived and/or modified sequence opt4 from anti-HIV_CDR
  source 1..57: mol_type = other RNA
gacaccaccaccttcagcagcttcggcagcccccccaacatgggcggcctggacccc

SEQ ID NO: 36942 - RNA, 57 nt, synthetic construct
  misc_feature 1..57: note = derived and/or modified sequence opt4 from anti-HIV_CDR
  source 1..57: mol_type = other RNA
gacaccaccaccttcggcgccttcggcggcggcgccaacatgggcggcctggacccc

SEQ ID NO: 36943 - RNA, 57 nt, synthetic construct
  misc_feature 1..57: note = derived and/or modified sequence opt4 from anti-HIV_CDR
  source 1..57: mol_type = other RNA
gacaccaccaccttcaccagcttcggcagcccccccagaatgggcggcctggacccc

SEQ ID NO: 36944 - RNA, 57 nt, synthetic construct
  misc_feature 1..57: note = derived and/or modified sequence opt4 from anti-HIV_CDR
  source 1..57: mol_type = other RNA
gacaccaccaccttcagcagcttcggcagccccccccacatgggcggcctggacccc

SEQ ID NO: 36945 - RNA, 57 nt, synthetic construct
  misc_feature 1..57: note = derived and/or modified sequence opt4 from anti-HIV_CDR
  source 1..57: mol_type = other RNA
gacagagtgagcgactacgacttctggagcggcaagagaggctacggcatggacgtg

SEQ ID NO: 36946 - RNA, 57 nt, synthetic construct
  misc_feature 1..57: note = derived and/or modified sequence opt4 from anti-HIV_CDR
  source 1..57: mol_type = other RNA
gagctgagcggcgagtaccacttctggagcggcacctacagatacggcgtggacgtg

SEQ ID NO: 36947 - RNA, 57 nt, synthetic construct
  misc_feature 1..57: note = derived and/or modified sequence opt4 from anti-HIV_CDR
  source 1..57: mol_type = other RNA
cacggcgccagcgagaactacggccccggcagctacagcgccgagcacttccagcac

SEQ ID NO: 36948 - RNA, 57 nt, synthetic construct
  misc_feature 1..57: note = derived and/or modified sequence opt4 from anti-HIV_CDR
  source 1..57: mol_type = other RNA
cacggcgccagcgccaactacggccccggcagctacagcgccgagcacttccagcac

SEQ ID NO: 36949 - RNA, 60 nt, synthetic construct
  misc_feature 1..60: note = derived and/or modified sequence opt4 from anti-HIV_CDR
  source 1..60: mol_type = other RNA
cacgaggcccccagatacagctacgccttcagaagatactaccactacggcctggacgtg

SEQ ID NO: 36950 - RNA, 60 nt, synthetic construct
  misc_feature 1..60: note = derived and/or modified sequence opt4 from anti-HIV_CDR
  source 1..60: mol_type = other RNA
accagcacctacgaccagtggagcggcctgcaccacgacggcgtgatggccttcagcagc

SEQ ID NO: 36951 - RNA, 60 nt, synthetic construct
  misc_feature 1..60: note = derived and/or modified sequence opt4 from anti-HIV_CDR
  source 1..60: mol_type = other RNA
ggcgagttcgacagcagcggcttcgactacgagagctggtacccctactacatggacgtg

SEQ ID NO: 36952 - RNA, 60 nt, synthetic construct
  misc_feature 1..60: note = derived and/or modified sequence opt4 from anti-HIV_CDR
  source 1..60: mol_type = other RNA
ggccagaccgacctgaacgacgacttctggagcgagtacagcacccccggcttcgactac

SEQ ID NO: 36953 - RNA, 60 nt, synthetic construct
  misc_feature 1..60: note = derived and/or modified sequence opt4 from anti-HIV_CDR
  source 1..60: mol_type = other RNA
ggccagaccgacctgaacgacgacctgtggagcgactacagcacccccggcttcgactac

SEQ ID NO: 36954 - RNA, 60 nt, synthetic construct
  misc_feature 1..60: note = derived and/or modified sequence opt4 from anti-HIV_CDR
  source 1..60: mol_type = other RNA
aacctgatcgaggagagccagacccagcaggagatcaacgagagagacctgctggccctg

SEQ ID NO: 36955 - RNA, 60 nt, synthetic construct
  misc_feature 1..60: note = derived and/or modified sequence opt4 from anti-HIV_CDR
  source 1..60: mol_type = other RNA
aacctgatcgaggagagccagatccagcaggagaagaacgagaaggagctgctggagctg

SEQ ID NO: 36956 - RNA, 60 nt, synthetic construct
  misc_feature 1..60: note = derived and/or modified sequence opt4 from anti-HIV_CDR
  source 1..60: mol_type = other RNA
agcctgatcgagaacagccagatccagcaggagaagaacgagcaggacctgctgcagctg

SEQ ID NO: 36957 - RNA, 60 nt, synthetic construct
  misc_feature 1..60: note = derived and/or modified sequence opt4 from anti-HIV_CDR
  source 1..60: mol_type = other RNA
agcctgatcgaggagagccagatccagcaggagaagaacgagaaggagctgctggagctg

SEQ ID NO: 36958 - RNA, 60 nt, synthetic construct
  misc_feature 1..60: note = derived and/or modified sequence opt4 from anti-HIV_CDR
  source 1..60: mol_type = other RNA
agactgatcgaggagagccagacccagcaggagaagaacgagcaggagctgctggagctg

SEQ ID NO: 36959 - RNA, 60 nt, synthetic construct
  misc_feature 1..60: note = derived and/or modified sequence opt4 from anti-HIV_CDR
  source 1..60: mol_type = other RNA
agcctgatcgaggagagccagacccagcaggagaagaacgagaaggagctgctggagctg

SEQ ID NO: 36960 - RNA, 60 nt, synthetic construct
  misc_feature 1..60: note = derived and/or modified sequence opt4 from anti-HIV_CDR
  source 1..60: mol_type = other RNA
aacctgctggaggagagccagaaccagcaggagaagaacgagcaggagctgctggagctg

SEQ ID NO: 36961 - RNA, 60 nt, synthetic construct
  misc_feature 1..60: note = derived and/or modified sequence opt4 from anti-HIV_CDR
  source 1..60: mol_type = other RNA
accctgatcgaggagagccagaaccagcaggagaagaacgagctggagctgctggagctg

SEQ ID NO: 36962 - RNA, 60 nt, synthetic construct
  misc_feature 1..60: note = derived and/or modified sequence opt4 from anti-HIV_CDR
  source 1..60: mol_type = other RNA
accctgcaggaggagagccagaaccagcaggagaagaacgagcaggagctgctggagctg

SEQ ID NO: 36963 - RNA, 60 nt, synthetic construct
  misc_feature 1..60: note = derived and/or modified sequence opt4 from anti-HIV_CDR
  source 1..60: mol_type = other RNA
agcctgctggaggagagccagaaccagcaggagaagaacgagcaggagctgctggagctg

SEQ ID NO: 36964 - RNA, 60 nt, synthetic construct
  misc_feature 1..60: note = derived and/or modified sequence opt4 from anti-HIV_CDR
  source 1..60: mol_type = other RNA
accctgatcgaggagagccagaaccagcaggagaagaaccagcaggagctgctgcagctg

SEQ ID NO: 36965 - RNA, 60 nt, synthetic construct
  misc_feature 1..60: note = derived and/or modified sequence opt4 from anti-HIV_CDR
  source 1..60: mol_type = other RNA
accctgatcgaggagagccagaaccagcaggagaagaacgagcaggagctgctgggcctg

SEQ ID NO: 36966 - RNA, 60 nt, synthetic construct
  misc_feature 1..60: note = derived and/or modified sequence opt4 from anti-HIV_CDR
  source 1..60: mol_type = other RNA
accctgatcgaggagagccagaaccagcaggagaagaacgagcaggagctgctggagctg

SEQ ID NO: 36967 - RNA, 60 nt, synthetic construct
  misc_feature 1..60: note = derived and/or modified sequence opt4 from anti-HIV_CDR
  source 1..60: mol_type = other RNA
agcctgatcgaggacagccagatccagcaggagaagaacgagaaggagctgctggagctg

SEQ ID NO: 36968 - RNA, 60 nt, synthetic construct
  misc_feature 1..60: note = derived and/or modified sequence opt4 from anti-HIV_CDR
  source 1..60: mol_type = other RNA
agcctgctggagaagagccagacccagcaggagaagaacgagcaggagctgctggagctg

SEQ ID NO: 36969 - RNA, 60 nt, synthetic construct
  misc_feature 1..60: note = derived and/or modified sequence opt4 from anti-HIV_CDR
  source 1..60: mol_type = other RNA
agcctgatcgaggagagccagaaccagcaggagaagaacgagcaggagctgctggagctg

SEQ ID NO: 36970 - RNA, 60 nt, synthetic construct
  misc_feature 1..60: note = derived and/or modified sequence opt4 from anti-HIV_CDR
  source 1..60: mol_type = other RNA
ggcgacctgctgggctacaccgacagctggtacgagttcgactactactacatggacgtg

SEQ ID NO: 36971 - RNA, 60 nt, synthetic construct
  misc_feature 1..60: note = derived and/or modified sequence opt4 from anti-HIV_CDR
  source 1..60: mol_type = other RNA
gacaccaacggcaccgagatcttcagacccggcggcggcgacatgagagacaactggaga

SEQ ID NO: 36972 - RNA, 60 nt, synthetic construct
  misc_feature 1..60: note = derived and/or modified sequence opt4 from anti-HIV_CDR
  source 1..60: mol_type = other RNA
gacgtggtggagagacccggcttcggcgacttcagatacgactactacggcatggacgtg

SEQ ID NO: 36973 - RNA, 60 nt, synthetic construct
  misc_feature 1..60: note = derived and/or modified sequence opt4 from anti-HIV_CDR
  source 1..60: mol_type = other RNA
gaccagagagactgcagcaccaacagatgcttcggcgtgttcggctactacatggacgtg

SEQ ID NO: 36974 - RNA, 60 nt, synthetic construct
  misc_feature 1..60: note = derived and/or modified sequence opt4 from anti-HIV_CDR
  source 1..60: mol_type = other RNA
gacagatgggtgagaccccagttccccagcatggacttccagtacaacggcctggacgtg

SEQ ID NO: 36975 - RNA, 60 nt, synthetic construct
  misc_feature 1..60: note = derived and/or modified sequence opt4 from anti-HIV_CDR
  source 1..60: mol_type = other RNA
gacagcggcttcgacctggactactacgacaccaacgagctgtacttcggcttcgactac

SEQ ID NO: 36976 - RNA, 60 nt, synthetic construct
  misc_feature 1..60: note = derived and/or modified sequence opt4 from anti-HIV_CDR
  source 1..60: mol_type = other RNA
aagtaccccgcctactacgacatcctgaccgccaactacagaagctactacttcgactac

SEQ ID NO: 36977 - RNA, 60 nt, synthetic construct
  misc_feature 1..60: note = derived and/or modified sequence opt4 from anti-HIV_CDR
  source 1..60: mol_type = other RNA
aagtaccccgcctactacgacatcctgaccggctactacagaaactactacttcgactac

SEQ ID NO: 36978 - RNA, 60 nt, synthetic construct
  misc_feature 1..60: note = derived and/or modified sequence opt4 from anti-HIV_CDR
  source 1..60: mol_type = other RNA
agagtgaagttccccctgtggttcggcgagaccacctactactactacggcatggacgtg

SEQ ID NO: 36979 - RNA, 60 nt, synthetic construct
  misc_feature 1..60: note = derived and/or modified sequence opt4 from anti-HIV_CDR
  source 1..60: mol_type = other RNA
gagagaagcaccaagtacagcttctggagcgccgtgatgagacccgacgccttcgacctg

SEQ ID NO: 36980 - RNA, 60 nt, synthetic construct
  misc_feature 1..60: note = derived and/or modified sequence opt4 from anti-HIV_CDR
  source 1..60: mol_type = other RNA
cacgaggcccccagatacagctacgccttcagaaactactaccactacggcctggacgtg

SEQ ID NO: 36981 - RNA, 60 nt, synthetic construct
  misc_feature 1..60: note = derived and/or modified sequence opt4 from anti-HIV_CDR
  source 1..60: mol_type = other RNA
gagaacgtgctgatggagagcgacgactacaacgactactactactactacatggacgtg

SEQ ID NO: 36982 - RNA, 60 nt, synthetic construct
  misc_feature 1..60: note = derived and/or modified sequence opt4 from anti-HIV_CDR
  source 1..60: mol_type = other RNA
gagagagtgctggtgttccccgaccaggacgccgactactactactacttcttcgacgtg

SEQ ID NO: 36983 - RNA, 60 nt, synthetic construct
  misc_feature 1..60: note = derived and/or modified sequence opt4 from anti-HIV_CDR
  source 1..60: mol_type = other RNA
gagagagtgctggtggtgcccgaccaggacgccgactactactactacttcttcgacgtg

SEQ ID NO: 36984 - RNA, 63 nt, synthetic construct
  misc_feature 1..63: note = derived and/or modified sequence opt4 from anti-HIV_CDR
  source 1..63: mol_type = other RNA
gacagaagcagcgccatcggctactgcagcagcatcagctgctacaagggcagcttcgacatc

SEQ ID NO: 36985 - RNA, 63 nt, synthetic construct
  misc_feature 1..63: note = derived and/or modified sequence opt4 from anti-HIV_CDR
  source 1..63: mol_type = other RNA
gtggtgaagatcgagcccctgggcgtggcccccaccaaggccaagagagtggccagagagaag

SEQ ID NO: 36986 - RNA, 63 nt, synthetic construct
  misc_feature 1..63: note = derived and/or modified sequence opt4 from anti-HIV_CDR
  source 1..63: mol_type = other RNA
gtggtgagaatcgagcccctgggcgtggcccccaccaaggccaagagagtggagagagagaag

SEQ ID NO: 36987 - RNA, 63 nt, synthetic construct
  misc_feature 1..63: note = derived and/or modified sequence opt4 from anti-HIV_CDR
  source 1..63: mol_type = other RNA
gtggtgagaatcgagcccctgggcatcgcccccaccagagccaagagagtggagagagagaag

SEQ ID NO: 36988 - RNA, 63 nt, synthetic construct
  misc_feature 1..63: note = derived and/or modified sequence opt4 from anti-HIV_CDR
  source 1..63: mol_type = other RNA
gtggtgaagatcgagcccatcggcgtggcccccaccaaggccagaagagtggagagagagaag

SEQ ID NO: 36989 - RNA, 63 nt, synthetic construct
  misc_feature 1..63: note = derived and/or modified sequence opt4 from anti-HIV_CDR
  source 1..63: mol_type = other RNA
gtggtgaagatcgagcccctgggcgtggcccccaccagagccaagagagtggagagagagaag

SEQ ID NO: 36990 - RNA, 63 nt, synthetic construct
  misc_feature 1..63: note = derived and/or modified sequence opt4 from anti-HIV_CDR
  source 1..63: mol_type = other RNA
gtggtgcagatcgagcccctgggcgtggcccccaccagagccaagagagtggagagagagaag

SEQ ID NO: 36991 - RNA, 63 nt, synthetic construct
  misc_feature 1..63: note = derived and/or modified sequence opt4 from anti-HIV_CDR
  source 1..63: mol_type = other RNA
gtggtgagaatcgagcccctgggcgtggcccccaccaaggccaagagagtgcagagagagaag

SEQ ID NO: 36992 - RNA, 63 nt, synthetic construct
  misc_feature 1..63: note = derived and/or modified sequence opt4 from anti-HIV_CDR
  source 1..63: mol_type = other RNA
gtggtgaagatcgagcccctgggcgtggcccccaccaaggccaagagagtgcagagaaagaag

SEQ ID NO: 36993 - RNA, 63 nt, synthetic construct
  misc_feature 1..63: note = derived and/or modified sequence opt4 from anti-HIV_CDR
  source 1..63: mol_type = other RNA
gtgatcaagatcgagcccctgatcgtggcccccaccaaggccaagagagtgcagagagagaag

SEQ ID NO: 36994 - RNA, 63 nt, synthetic construct
  misc_feature 1..63: note = derived and/or modified sequence opt4 from anti-HIV_CDR
  source 1..63: mol_type = other RNA
gtggtgaagatcgagcccctgggcgtggcccccaccaaggccagaagagtgcagagagagaag

SEQ ID NO: 36995 - RNA, 63 nt, synthetic construct
  misc_feature 1..63: note = derived and/or modified sequence opt4 from anti-HIV_CDR
  source 1..63: mol_type = other RNA
gtggtgaagatcgagctgctgggcgtggcccccaccaaggccaagagagtgcagagagagaag

SEQ ID NO: 36996 - RNA, 63 nt, synthetic construct
  misc_feature 1..63: note = derived and/or modified sequence opt4 from anti-HIV_CDR
  source 1..63: mol_type = other RNA
gtggtgaccatcgagcccctgggcgtggcccccaccaaggccaagagagtgcagagagagaag

SEQ ID NO: 36997 - RNA, 63 nt, synthetic construct
  misc_feature 1..63: note = derived and/or modified sequence opt4 from anti-HIV_CDR
  source 1..63: mol_type = other RNA
gtggtgaagatcgagcccctgggcgtggcccccaccaaggccaagagagtgcagagagagaag

SEQ ID NO: 36998 - RNA, 63 nt, synthetic construct
  misc_feature 1..63: note = derived and/or modified sequence opt4 from anti-HIV_CDR
  source 1..63: mol_type = other RNA
gacctggtgagcgtgagccccccctacggcaactacggccccgacaacaactggttcgacttc

SEQ ID NO: 36999 - RNA, 63 nt, synthetic construct
  misc_feature 1..63: note = derived and/or modified sequence opt4 from anti-HIV_CDR
  source 1..63: mol_type = other RNA
atgaaccccccctggttcagaggcggcagcaacaacccctacagctactactacatggacgtg

SEQ ID NO: 37000 - RNA, 63 nt, synthetic construct
  misc_feature 1..63: note = derived and/or modified sequence opt4 from anti-HIV_CDR
  source 1..63: mol_type = other RNA
gactggatcggctacgactacgacggcagcggcagccacctgagagacgagagcttcgacatc

SEQ ID NO: 37001 - RNA, 63 nt, synthetic construct
  misc_feature 1..63: note = derived and/or modified sequence opt4 from anti-HIV_CDR
  source 1..63: mol_type = other RNA
tgcagcatcgtgggcaacggcgacttcctggaggaggacagccactaccccgccatggacgtg

SEQ ID NO: 37002 - RNA, 63 nt, synthetic construct
  misc_feature 1..63: note = derived and/or modified sequence opt4 from anti-HIV_CDR
  source 1..63: mol_type = other RNA
gacttcgtgagcatctacggcgtggcctacttcaccggcggcggccccagcagccccgacatc

SEQ ID NO: 37003 - RNA, 66 nt, synthetic construct
  misc_feature 1..66: note = derived and/or modified sequence opt4 from anti-HIV_CDR
  source 1..66: mol_type = other RNA
aaggccaaggactactactacgagagcagcgactacagcccctactactactactacatggacgtg

SEQ ID NO: 37004 - RNA, 66 nt, synthetic construct
  misc_feature 1..66: note = derived and/or modified sequence opt4 from anti-HIV_CDR
  source 1..66: mol_type = other RNA
gaccacggcatcaagcccgacaactactacgacatcagcggctacaacctggactacttcgactac

SEQ ID NO: 37005 - RNA, 66 nt, synthetic construct
  misc_feature 1..66: note = derived and/or modified sequence opt4 from anti-HIV_CDR
  source 1..66: mol_type = other RNA
ggcagcctgtacgactacagagacaacgccgacctgaagcccagctactactacgccatggacgtg

SEQ ID NO: 37006 - RNA, 66 nt, synthetic construct
  misc_feature 1..66: note = derived and/or modified sequence opt4 from anti-HIV_CDR
  source 1..66: mol_type = other RNA
gacgaggccagctgggtggaggccgccgacgagtgggacgagcacctgttcagagagatggccgtg

SEQ ID NO: 37007 - RNA, 66 nt, synthetic construct
  misc_feature 1..66: note = derived and/or modified sequence opt4 from anti-HIV_CDR
  source 1..66: mol_type = other RNA
gacgaggtgagctgggtggaggccgccgacgagtgggacgagcacctgttcagagagatggccgtg

SEQ ID NO: 37008 - RNA, 66 nt, synthetic construct
  misc_feature 1..66: note = derived and/or modified sequence opt4 from anti-HIV_CDR
  source 1..66: mol_type = other RNA
gacgagggcagctgggtggaggccgccgacgagtgggacgagcacctgttcagagagatggccgtg

SEQ ID NO: 37009 - RNA, 66 nt, synthetic construct
  misc_feature 1..66: note = derived and/or modified sequence opt4 from anti-HIV_CDR
  source 1..66: mol_type = other RNA
gaccagagaggcagatacagcttcggcttcgtgaccggccagaccaaggtgagcgccatcagcgac

SEQ ID NO: 37010 - RNA, 66 nt, synthetic construct
  misc_feature 1..66: note = derived and/or modified sequence opt4 from anti-HIV_CDR
  source 1..66: mol_type = other RNA
gaccagctgggcagatacagcttcggcttcgtgaccggccagaacaaggtgagcgccatcagcgac

SEQ ID NO: 37011 - RNA, 66 nt, synthetic construct
  misc_feature 1..66: note = derived and/or modified sequence opt4 from anti-HIV_CDR
  source 1..66: mol_type = other RNA
gaccaggtgggcagatacagcttcggcttcgccaccggccagcagagagtgagcgccatcagcgac

SEQ ID NO: 37012 - RNA, 69 nt, synthetic construct
  misc_feature 1..69: note = derived and/or modified sequence opt4 from anti-HIV_CDR
  source 1..69: mol_type = other RNA
gtggtgaagatcgagcccctgggcgtggcccccaccaaggccaagagaagagtggtgcagagagagaag

SEQ ID NO: 37013 - RNA, 69 nt, synthetic construct
  misc_feature 1..69: note = derived and/or modified sequence opt4 from anti-HIV_CDR
  source 1..69: mol_type = other RNA
agaatcagcagcagcagctggtacatggtggacaacagccacaccctgcacttctactacatggacgtg

SEQ ID NO: 37014 - RNA, 69 nt, synthetic construct
  misc_feature 1..69: note = derived and/or modified sequence opt4 from anti-HIV_CDR
  source 1..69: mol_type = other RNA
gacaagcccgcctacgacgagtacgccgaggagaccatcgccccccacaactaccacgccatggacctg

SEQ ID NO: 37015 - RNA, 69 nt, synthetic construct
  misc_feature 1..69: note = derived and/or modified sequence opt4 from anti-HIV_CDR
  source 1..69: mol_type = other RNA
cagaacatcgccgccagagccgccgagaagctgtacgagaacgactactacttctacggcatggacgtg

SEQ ID NO: 37016 - RNA, 69 nt, synthetic construct
  misc_feature 1..69: note = derived and/or modified sequence opt4 from anti-HIV_CDR
  source 1..69: mol_type = other RNA
cagaacatcgccgccagaaccgccgagagactgtacgagaacgactactacttctacggcatggacgtg

SEQ ID NO: 37017 - RNA, 72 nt, synthetic construct
  misc_feature 1..72: note = derived and/or modified sequence opt4 from anti-HIV_CDR
  source 1..72: mol_type = other RNA
gcccagcagggcaagagaatctacggcatcgtgagcttcggcgagttcttctactactactacatggacgcc

SEQ ID NO: 37018 - RNA, 72 nt, synthetic construct
  misc_feature 1..72: note = derived and/or modified sequence opt4 from anti-HIV_CDR
  source 1..72: mol_type = other RNA
acccagcagggcaagagaatctacggcgtggtgagcttcggcgagttcttccactactactacatggacgcc

SEQ ID NO: 37019 - RNA, 72 nt, synthetic construct
  misc_feature 1..72: note = derived and/or modified sequence opt4 from anti-HIV_CDR
  source 1..72: mol_type = other RNA
gccagaagaggccagagaatctacggcgtggtgagcttcggcgagttcttctactactacagcatggacgtg

SEQ ID NO: 37020 - RNA, 72 nt, synthetic construct
  misc_feature 1..72: note = derived and/or modified sequence opt4 from anti-HIV_CDR
  source 1..72: mol_type = other RNA
accctgcacggcagaagaatctacggcatcgtggccttcaacgagtggttcacctacttctacatggacgtg

SEQ ID NO: 37021 - RNA, 72 nt, synthetic construct
  misc_feature 1..72: note = derived and/or modified sequence opt4 from anti-HIV_CDR
  source 1..72: mol_type = other RNA
accaagcacggcagaagaatctacggcatcgtggccttcaacgagtggttcacctacttctacatggacgtg

SEQ ID NO: 37022 - RNA, 72 nt, synthetic construct
  misc_feature 1..72: note = derived and/or modified sequence opt4 from anti-HIV_CDR
  source 1..72: mol_type = other RNA
gccagacacggccagagaatctacggcgtggtgagcttcggcgagttcttcacctactacagcatggacgtg

SEQ ID NO: 37023 - RNA, 72 nt, synthetic construct
  misc_feature 1..72: note = derived and/or modified sequence opt4 from anti-HIV_CDR
  source 1..72: mol_type = other RNA
acccagcagggcaagagaatctacggcgtggtgagcttcggcgactactactactactactacatggacgtg

SEQ ID NO: 37024 - RNA, 72 nt, synthetic construct
  misc_feature 1..72: note = derived and/or modified sequence opt4 from anti-HIV_CDR
  source 1..72: mol_type = other RNA
accaagcacggcagaagaatctacggcgtggtggccttcggcgagtggttcacctacttctacatggacgtg

SEQ ID NO: 37025 - RNA, 72 nt, synthetic construct
  misc_feature 1..72: note = derived and/or modified sequence opt4 from anti-HIV_CDR
  source 1..72: mol_type = other RNA
gccgtgatcaccgacctgcacaccttcggcgactacgagctggaggaccccagctactactacatggacgtg

SEQ ID NO: 37026 - RNA, 72 nt, synthetic construct
  misc_feature 1..72: note = derived and/or modified sequence opt4 from anti-HIV_CDR
  source 1..72: mol_type = other RNA
gacagaggcgacaccagactgctggactacggcgactacgaggacgagagatactactacggcatggacgtg

SEQ ID NO: 37027 - RNA, 72 nt, synthetic construct
  misc_feature 1..72: note = derived and/or modified sequence opt4 from anti-HIV_CDR
  source 1..72: mol_type = other RNA
ggcaccagatacgacttctggagcggcttcagcaacagagacggcagagccctggccggctacttcgactac

SEQ ID NO: 37028 - RNA, 72 nt, synthetic construct
  misc_feature 1..72: note = derived and/or modified sequence opt4 from anti-HIV_CDR
  source 1..72: mol_type = other RNA
gacggcaagggcaaggcctactacgacttctggagcggctacagaaaccagaagtactacggcctggacgtg

SEQ ID NO: 37029 - RNA, 72 nt, synthetic construct
  misc_feature 1..72: note = derived and/or modified sequence opt4 from anti-HIV_CDR
  source 1..72: mol_type = other RNA
gccgtgatcaccgacctgcacaccttcgccgactacgagctgggcgaccccagctacttctacatggacgtg

SEQ ID NO: 37030 - RNA, 72 nt, synthetic construct
  misc_feature 1..72: note = derived and/or modified sequence opt4 from anti-HIV_CDR
  source 1..72: mol_type = other RNA
agcgtgatcaccgacctgcacaccttcggcgactacgagagcggcgaccccagctactactacatggacgtg

SEQ ID NO: 37031 - RNA, 81 nt, synthetic construct
  misc_feature 1..81: note = derived and/or modified sequence opt4 from anti-HIV_CDR
  source 1..81: mol_type = other RNA
gacttccccagattccacagactggtgggcaactacgacttctggagaggcaccctggacagattcagctacatggacctg

SEQ ID NO: 37032 - RNA, 105 nt, synthetic construct
  misc_feature 1..105: note = derived and/or modified sequence opt4 from anti-HIV_CDR
  source 1..105: mol_type = other RNA
agaatcctggccgtggagagatacctgaaggaccagcagctgctgggcatctggggctgcagcggcaagatcatctgccccaccatggtgccctggaacagcagc

SEQ ID NO: 37033 - RNA, 105 nt, synthetic construct
  misc_feature 1..105: note = derived and/or modified sequence opt4 from anti-HIV_CDR
  source 1..105: mol_type = other RNA
agagtgctggccgtggagagatacctgcaggaccagagactgctgggcatgtggggctgcagcggcaagcacatctgcaccaccttcgtgccctggaacagcagc

SEQ ID NO: 37034 - RNA, 105 nt, synthetic construct
  misc_feature 1..105: note = derived and/or modified sequence opt4 from anti-HIV_CDR
  source 1..105: mol_type = other RNA
agagtgctggccgtggagagctacctgaaggaccagcagctgctgggcatctggggctgcagcggcaagcacatctgcaccaccaccgtgccctggaacagcagc

SEQ ID NO: 37035 - RNA, 105 nt, synthetic construct
  misc_feature 1..105: note = derived and/or modified sequence opt4 from anti-HIV_CDR
  source 1..105: mol_type = other RNA
agagtgctggccgtggagagatacctgagagaccagcagctgctgggcatctggggctgcagcggcagacacatctgcaccaccaacgtgccctggaacagcagc

SEQ ID NO: 37036 - RNA, 105 nt, synthetic construct
  misc_feature 1..105: note = derived and/or modified sequence opt4 from anti-HIV_CDR
  source 1..105: mol_type = other RNA
agaatcctggccgtggagagatacctgaaggaccagcagctgctgggcatctggggctgcagcggcaagctgatctgcaccaccaccgtgccctggaacagcagc

SEQ ID NO: 37037 - RNA, 105 nt, synthetic construct
  misc_feature 1..105: note = derived and/or modified sequence opt4 from anti-HIV_CDR
  source 1..105: mol_type = other RNA
agaatcctggccgtggagagatacctgaaggaccagcagctgctgggcatctggggctgcagcggcaagcacatctgcaccaccaacgtgccctggaacagcagc

SEQ ID NO: 37038 - RNA, 105 nt, synthetic construct
  misc_feature 1..105: note = derived and/or modified sequence opt4 from anti-HIV_CDR
  source 1..105: mol_type = other RNA
agagtgctggccgtggagagatacctgagagaccagcagctgctgggcatctggggctgcagcggcaagctgatctgcaccaccaccgtgccctggaacgccagc

SEQ ID NO: 37039 - RNA, 105 nt, synthetic construct
  misc_feature 1..105: note = derived and/or modified sequence opt4 from anti-HIV_CDR
  source 1..105: mol_type = other RNA
agagtgctggccgtggagagatacctgagagaccagcagctgctgggcatctggggctgcagcggcaagctgatctgcaccaccgccgtgccctggaacgccagc

SEQ ID NO: 37040 - RNA, 105 nt, synthetic construct
  misc_feature 1..105: note = derived and/or modified sequence opt4 from anti-HIV_CDR
  source 1..105: mol_type = other RNA
agagtgctggccgtggagagatacctgaaggaccagcagctgctgggcatctggggctgcagcggcaagctgatctgcaccaccaccgtgccctggaacgccagc

SEQ ID NO: 37041 - RNA, 105 nt, synthetic construct
  misc_feature 1..105: note = derived and/or modified sequence opt4 from anti-HIV_CDR
  source 1..105: mol_type = other RNA
agaatcctggccgtggagagatacctgaaggaccagcagctgctgggcttctggggctgcagcggcaagctgatctgcaccaccgccgtgccctggaacgccagc

SEQ ID NO: 37042 - RNA, 105 nt, synthetic construct
  misc_feature 1..105: note = derived and/or modified sequence opt4 from anti-HIV_CDR
  source 1..105: mol_type = other RNA
agagtgctggccgtggagagatacctgagagaccagcagctgctgggcatctggggctgcagcggcaagctgatctgcaccaccaccgtgccctggaacaccagc

SEQ ID NO: 37043 - RNA, 105 nt, synthetic construct
  misc_feature 1..105: note = derived and/or modified sequence opt4 from anti-HIV_CDR
  source 1..105: mol_type = other RNA
agagtgctggccgtggagagatacctgaaggaccagcagctgctgggcatctggggctgcagcggcaagctgatctgcaccaccgccgtgccctggaacgccagc

SEQ ID NO: 37044 - RNA, 105 nt, synthetic construct
  misc_feature 1..105: note = derived and/or modified sequence opt4 from anti-HIV_CDR
  source 1..105: mol_type = other RNA
agagtgctggccgtggagagatacctgaaggaccagcagctgctgggcttctggggctgcagcggcaagctgatctgcaccaccaccgtgccctggaacgccagc

SEQ ID NO: 37045 - RNA, 105 nt, synthetic construct
  misc_feature 1..105: note = derived and/or modified sequence opt4 from anti-HIV_CDR
  source 1..105: mol_type = other RNA
agaatcctggccgtggagagatacctgaaggaccagcagctgctgggcatctggggctgcagcggcaagctgatctgcaccaccgccgtgccctggaacgccagc

SEQ ID NO: 37046-37071 - skipped (26 entries)

SEQ ID NO: 37072 - RNA, 12 nt, synthetic construct
  misc_feature 1..12: note = derived and/or modified sequence opt4 from anti-influenza_CDR
  source 1..12: mol_type = other RNA
gacgtgcccgac

SEQ ID NO: 37073 - RNA, 12 nt, synthetic construct
  misc_feature 1..12: note = derived and/or modified sequence opt4 from anti-influenza_CDR
  source 1..12: mol_type = other RNA
agactgagcggc

SEQ ID NO: 37074 - RNA, 12 nt, synthetic construct
  misc_feature 1..12: note = derived and/or modified sequence opt4 from anti-influenza_CDR
  source 1..12: mol_type = other RNA
ttctgggacctg

SEQ ID NO: 37075 - RNA, 15 nt, synthetic construct
  misc_feature 1..15: note = derived and/or modified sequence opt4 from anti-influenza_CDR
  source 1..15: mol_type = other RNA
accggcctgagaaac

SEQ ID NO: 37076 - RNA, 15 nt, synthetic construct
  misc_feature 1..15: note = derived and/or modified sequence opt4 from anti-influenza_CDR
  source 1..15: mol_type = other RNA
cagcagagcagaacc

SEQ ID NO: 37077 - RNA, 15 nt, synthetic construct
  misc_feature 1..15: note = derived and/or modified sequence opt4 from anti-influenza_CDR
  source 1..15: mol_type = other RNA
cagctgagcagaacc

SEQ ID NO: 37078 - RNA, 15 nt, synthetic construct
  misc_feature 1..15: note = derived and/or modified sequence opt4 from anti-influenza_CDR
  source 1..15: mol_type = other RNA
agcaactacatcacc

SEQ ID NO: 37079 - RNA, 15 nt, synthetic construct
  misc_feature 1..15: note = derived and/or modified sequence opt4 from anti-influenza_CDR
  source 1..15: mol_type = other RNA
gactacagctggaac

SEQ ID NO: 37080 - RNA, 15 nt, synthetic construct
  misc_feature 1..15: note = derived and/or modified sequence opt4 from anti-influenza_CDR
  source 1..15: mol_type = other RNA
aactacgccttcagc

SEQ ID NO: 37081 - RNA, 15 nt, synthetic construct
  misc_feature 1..15: note = derived and/or modified sequence opt4 from anti-influenza_CDR
  source 1..15: mol_type = other RNA
aagaacgccatcagc

SEQ ID NO: 37082 - RNA, 15 nt, synthetic construct
  misc_feature 1..15: note = derived and/or modified sequence opt4 from anti-influenza_CDR
  source 1..15: mol_type = other RNA
agccactggatgacc

SEQ ID NO: 37083 - RNA, 15 nt, synthetic construct
  misc_feature 1..15: note = derived and/or modified sequence opt4 from anti-influenza_CDR
  source 1..15: mol_type = other RNA
aactacgacatcaac

SEQ ID NO: 37084 - RNA, 15 nt, synthetic construct
  misc_feature 1..15: note = derived and/or modified sequence opt4 from anti-influenza_CDR
  source 1..15: mol_type = other RNA
gactacggcgtgacc

SEQ ID NO: 37085 - RNA, 15 nt, synthetic construct
  misc_feature 1..15: note = derived and/or modified sequence opt4 from anti-influenza_CDR
  source 1..15: mol_type = other RNA
aactacggcatcaac

SEQ ID NO: 37086 - RNA, 15 nt, synthetic construct
  misc_feature 1..15: note = derived and/or modified sequence opt4 from anti-influenza_CDR
  source 1..15: mol_type = other RNA
ggctacaccatcacc

SEQ ID NO: 37087 - RNA, 15 nt, synthetic construct
  misc_feature 1..15: note = derived and/or modified sequence opt4 from anti-influenza_CDR
  source 1..15: mol_type = other RNA
aactacggcatcagc

SEQ ID NO: 37088 - RNA, 15 nt, synthetic construct
  misc_feature 1..15: note = derived and/or modified sequence opt4 from anti-influenza_CDR
  source 1..15: mol_type = other RNA
gacgactactggacc

SEQ ID NO: 37089 - RNA, 15 nt, synthetic construct
  misc_feature 1..15: note = derived and/or modified sequence opt4 from anti-influenza_CDR
  source 1..15: mol_type = other RNA
acctacgccatgcac

SEQ ID NO: 37090 - RNA, 15 nt, synthetic construct
  misc_feature 1..15: note = derived and/or modified sequence opt4 from anti-influenza_CDR
  source 1..15: mol_type = other RNA
agctacgccatgcac

SEQ ID NO: 37091 - RNA, 15 nt, synthetic construct
  misc_feature 1..15: note = derived and/or modified sequence opt4 from anti-influenza_CDR
  source 1..15: mol_type = other RNA
agctactactggaac

SEQ ID NO: 37092 - RNA, 15 nt, synthetic construct
  misc_feature 1..15: note = derived and/or modified sequence opt4 from anti-influenza_CDR
  source 1..15: mol_type = other RNA
acctaccccgtggcc

SEQ ID NO: 37093 - RNA, 15 nt, synthetic construct
  misc_feature 1..15: note = derived and/or modified sequence opt4 from anti-influenza_CDR
  source 1..15: mol_type = other RNA
cactacttctggagc

SEQ ID NO: 37094 - RNA, 15 nt, synthetic construct
  misc_feature 1..15: note = derived and/or modified sequence opt4 from anti-influenza_CDR
  source 1..15: mol_type = other RNA
gactactactggacc

SEQ ID NO: 37095 - RNA, 15 nt, synthetic construct
  misc_feature 1..15: note = derived and/or modified sequence opt4 from anti-influenza_CDR
  source 1..15: mol_type = other RNA
gactactactggagc

SEQ ID NO: 37096 - RNA, 15 nt, synthetic construct
  misc_feature 1..15: note = derived and/or modified sequence opt4 from anti-influenza_CDR
  source 1..15: mol_type = other RNA
ggctactacatgcac

SEQ ID NO: 37097 - RNA, 15 nt, synthetic construct
  misc_feature 1..15: note = derived and/or modified sequence opt4 from anti-influenza_CDR
  source 1..15: mol_type = other RNA
agccactactggagc

SEQ ID NO: 37098 - RNA, 15 nt, synthetic construct
  misc_feature 1..15: note = derived and/or modified sequence opt4 from anti-influenza_CDR
  source 1..15: mol_type = other RNA
aactactggatcggc

SEQ ID NO: 37099 - RNA, 15 nt, synthetic construct
  misc_feature 1..15: note = derived and/or modified sequence opt4 from anti-influenza_CDR
  source 1..15: mol_type = other RNA
aactacgccatcatc

SEQ ID NO: 37100 - RNA, 15 nt, synthetic construct
  misc_feature 1..15: note = derived and/or modified sequence opt4 from anti-influenza_CDR
  source 1..15: mol_type = other RNA
gactactacatccac

SEQ ID NO: 37101 - RNA, 15 nt, synthetic construct
  misc_feature 1..15: note = derived and/or modified sequence opt4 from anti-influenza_CDR
  source 1..15: mol_type = other RNA
ggctacgacatgcac

SEQ ID NO: 37102 - RNA, 15 nt, synthetic construct
  misc_feature 1..15: note = derived and/or modified sequence opt4 from anti-influenza_CDR
  source 1..15: mol_type = other RNA
ggctactacatccac

SEQ ID NO: 37103 - RNA, 15 nt, synthetic construct
  misc_feature 1..15: note = derived and/or modified sequence opt4 from anti-influenza_CDR
  source 1..15: mol_type = other RNA
ggctactacgtgcac

SEQ ID NO: 37104 - RNA, 15 nt, synthetic construct
  misc_feature 1..15: note = derived and/or modified sequence opt4 from anti-influenza_CDR
  source 1..15: mol_type = other RNA
aactactggatgagc

SEQ ID NO: 37105 - RNA, 15 nt, synthetic construct
  misc_feature 1..15: note = derived and/or modified sequence opt4 from anti-influenza_CDR
  source 1..15: mol_type = other RNA
ggcgagagcaccctg

SEQ ID NO: 37106 - RNA, 15 nt, synthetic construct
  misc_feature 1..15: note = derived and/or modified sequence opt4 from anti-influenza_CDR
  source 1..15: mol_type = other RNA
aactactactggagc

SEQ ID NO: 37107 - RNA, 15 nt, synthetic construct
  misc_feature 1..15: note = derived and/or modified sequence opt4 from anti-influenza_CDR
  source 1..15: mol_type = other RNA
agcaactacatgagc

SEQ ID NO: 37108 - RNA, 15 nt, synthetic construct
  misc_feature 1..15: note = derived and/or modified sequence opt4 from anti-influenza_CDR
  source 1..15: mol_type = other RNA
agcgactactggagc

SEQ ID NO: 37109 - RNA, 15 nt, synthetic construct
  misc_feature 1..15: note = derived and/or modified sequence opt4 from anti-influenza_CDR
  source 1..15: mol_type = other RNA
agctacaactggatc

SEQ ID NO: 37110 - RNA, 15 nt, synthetic construct
  misc_feature 1..15: note = derived and/or modified sequence opt4 from anti-influenza_CDR
  source 1..15: mol_type = other RNA
agcacctacatgaac

SEQ ID NO: 37111 - RNA, 15 nt, synthetic construct
  misc_feature 1..15: note = derived and/or modified sequence opt4 from anti-influenza_CDR
  source 1..15: mol_type = other RNA
aactacgccatgagc

SEQ ID NO: 37112 - RNA, 15 nt, synthetic construct
  misc_feature 1..15: note = derived and/or modified sequence opt4 from anti-influenza_CDR
  source 1..15: mol_type = other RNA
agcgacttctggagc

SEQ ID NO: 37113 - RNA, 15 nt, synthetic construct
  misc_feature 1..15: note = derived and/or modified sequence opt4 from anti-influenza_CDR
  source 1..15: mol_type = other RNA
tactacgccatgagc

SEQ ID NO: 37114 - RNA, 15 nt, synthetic construct
  misc_feature 1..15: note = derived and/or modified sequence opt4 from anti-influenza_CDR
  source 1..15: mol_type = other RNA
ggctactacgtgtac

SEQ ID NO: 37115 - RNA, 15 nt, synthetic construct
  misc_feature 1..15: note = derived and/or modified sequence opt4 from anti-influenza_CDR
  source 1..15: mol_type = other RNA
agctacgccatcagc

SEQ ID NO: 37116 - RNA, 15 nt, synthetic construct
  misc_feature 1..15: note = derived and/or modified sequence opt4 from anti-influenza_CDR
  source 1..15: mol_type = other RNA
agctacagctggagc

SEQ ID NO: 37117 - RNA, 15 nt, synthetic construct
  misc_feature 1..15: note = derived and/or modified sequence opt4 from anti-influenza_CDR
  source 1..15: mol_type = other RNA
aacagcttctggggc

SEQ ID NO: 37118 - RNA, 15 nt, synthetic construct
  misc_feature 1..15: note = derived and/or modified sequence opt4 from anti-influenza_CDR
  source 1..15: mol_type = other RNA
gcctaccactggagc

SEQ ID NO: 37119 - RNA, 15 nt, synthetic construct
  misc_feature 1..15: note = derived and/or modified sequence opt4 from anti-influenza_CDR
  source 1..15: mol_type = other RNA
gacaactacatcaac

SEQ ID NO: 37120 - RNA, 15 nt, synthetic construct
  misc_feature 1..15: note = derived and/or modified sequence opt4 from anti-influenza_CDR
  source 1..15: mol_type = other RNA
agcggcttcagcgtg

SEQ ID NO: 37121 - RNA, 15 nt, synthetic construct
  misc_feature 1..15: note = derived and/or modified sequence opt4 from anti-influenza_CDR
  source 1..15: mol_type = other RNA
gcctacgccttcacc

SEQ ID NO: 37122 - RNA, 15 nt, synthetic construct
  misc_feature 1..15: note = derived and/or modified sequence opt4 from anti-influenza_CDR
  source 1..15: mol_type = other RNA
ggcagcgccatcagc

SEQ ID NO: 37123 - RNA, 15 nt, synthetic construct
  misc_feature 1..15: note = derived and/or modified sequence opt4 from anti-influenza_CDR
  source 1..15: mol_type = other RNA
agctacgccatcacc

SEQ ID NO: 37124 - RNA, 15 nt, synthetic construct
  misc_feature 1..15: note = derived and/or modified sequence opt4 from anti-influenza_CDR
  source 1..15: mol_type = other RNA
agctactacatgcac

SEQ ID NO: 37125 - RNA, 15 nt, synthetic construct
  misc_feature 1..15: note = derived and/or modified sequence opt4 from anti-influenza_CDR
  source 1..15: mol_type = other RNA
atctacgccatgagc

SEQ ID NO: 37126 - RNA, 15 nt, synthetic construct
  misc_feature 1..15: note = derived and/or modified sequence opt4 from anti-influenza_CDR
  source 1..15: mol_type = other RNA
agctacagcatgaac

SEQ ID NO: 37127 - RNA, 15 nt, synthetic construct
  misc_feature 1..15: note = derived and/or modified sequence opt4 from anti-influenza_CDR
  source 1..15: mol_type = other RNA
agctacggcatcagc

SEQ ID NO: 37128 - RNA, 15 nt, synthetic construct
  misc_feature 1..15: note = derived and/or modified sequence opt4 from anti-influenza_CDR
  source 1..15: mol_type = other RNA
ttctacagcatgagc

SEQ ID NO: 37129 - RNA, 15 nt, synthetic construct
  misc_feature 1..15: note = derived and/or modified sequence opt4 from anti-influenza_CDR
  source 1..15: mol_type = other RNA
acccacgccatcagc

SEQ ID NO: 37130 - RNA, 15 nt, synthetic construct
  misc_feature 1..15: note = derived and/or modified sequence opt4 from anti-influenza_CDR
  source 1..15: mol_type = other RNA
ggctacgccatcagc

SEQ ID NO: 37131 - RNA, 15 nt, synthetic construct
  misc_feature 1..15: note = derived and/or modified sequence opt4 from anti-influenza_CDR
  source 1..15: mol_type = other RNA
agcaacagcatcagc

SEQ ID NO: 37132 - RNA, 15 nt, synthetic construct
  misc_feature 1..15: note = derived and/or modified sequence opt4 from anti-influenza_CDR
  source 1..15: mol_type = other RNA
aacttcgccatcaac

SEQ ID NO: 37133 - RNA, 15 nt, synthetic construct
  misc_feature 1..15: note = derived and/or modified sequence opt4 from anti-influenza_CDR
  source 1..15: mol_type = other RNA
agcaacgccgtgagc

SEQ ID NO: 37134 - RNA, 15 nt, synthetic construct
  misc_feature 1..15: note = derived and/or modified sequence opt4 from anti-influenza_CDR
  source 1..15: mol_type = other RNA
gacaacgccatcagc

SEQ ID NO: 37135 - RNA, 15 nt, synthetic construct
  misc_feature 1..15: note = derived and/or modified sequence opt4 from anti-influenza_CDR
  source 1..15: mol_type = other RNA
ttcagcgaggtggag

SEQ ID NO: 37136 - RNA, 15 nt, synthetic construct
  misc_feature 1..15: note = derived and/or modified sequence opt4 from anti-influenza_CDR
  source 1..15: mol_type = other RNA
gcccaccacatgcac

SEQ ID NO: 37137 - RNA, 15 nt, synthetic construct
  misc_feature 1..15: note = derived and/or modified sequence opt4 from anti-influenza_CDR
  source 1..15: mol_type = other RNA
agccagtggatcggc

SEQ ID NO: 37138 - RNA, 15 nt, synthetic construct
  misc_feature 1..15: note = derived and/or modified sequence opt4 from anti-influenza_CDR
  source 1..15: mol_type = other RNA
gactacgccatgaac

SEQ ID NO: 37139 - RNA, 15 nt, synthetic construct
  misc_feature 1..15: note = derived and/or modified sequence opt4 from anti-influenza_CDR
  source 1..15: mol_type = other RNA
aacgcctggatgagc

SEQ ID NO: 37140 - RNA, 15 nt, synthetic construct
  misc_feature 1..15: note = derived and/or modified sequence opt4 from anti-influenza_CDR
  source 1..15: mol_type = other RNA
gactacgccatcaac

SEQ ID NO: 37141 - RNA, 15 nt, synthetic construct
  misc_feature 1..15: note = derived and/or modified sequence opt4 from anti-influenza_CDR
  source 1..15: mol_type = other RNA
agacacggcatcagc

SEQ ID NO: 37142 - RNA, 15 nt, synthetic construct
  misc_feature 1..15: note = derived and/or modified sequence opt4 from anti-influenza_CDR
  source 1..15: mol_type = other RNA
gagctgagcatccac

SEQ ID NO: 37143 - RNA, 15 nt, synthetic construct
  misc_feature 1..15: note = derived and/or modified sequence opt4 from anti-influenza_CDR
  source 1..15: mol_type = other RNA
agcagcaactactac

SEQ ID NO: 37144 - RNA, 15 nt, synthetic construct
  misc_feature 1..15: note = derived and/or modified sequence opt4 from anti-influenza_CDR
  source 1..15: mol_type = other RNA
acctacgccatgagc

SEQ ID NO: 37145 - RNA, 15 nt, synthetic construct
  misc_feature 1..15: note = derived and/or modified sequence opt4 from anti-influenza_CDR
  source 1..15: mol_type = other RNA
aactacgccatcagc

SEQ ID NO: 37146 - RNA, 18 nt, synthetic construct
  misc_feature 1..18: note = derived and/or modified sequence opt4 from anti-influenza_CDR
  source 1..18: mol_type = other RNA
ttcggcgccatcgccggc

SEQ ID NO: 37147 - RNA, 18 nt, synthetic construct
  misc_feature 1..18: note = derived and/or modified sequence opt4 from anti-influenza_CDR
  source 1..18: mol_type = other RNA
caggacatcagcagatac

SEQ ID NO: 37148 - RNA, 18 nt, synthetic construct
  misc_feature 1..18: note = derived and/or modified sequence opt4 from anti-influenza_CDR
  source 1..18: mol_type = other RNA
cagaacatcggcccctgg

SEQ ID NO: 37149 - RNA, 18 nt, synthetic construct
  misc_feature 1..18: note = derived and/or modified sequence opt4 from anti-influenza_CDR
  source 1..18: mol_type = other RNA
cagagcgtgaacagaaga

SEQ ID NO: 37150 - RNA, 18 nt, synthetic construct
  misc_feature 1..18: note = derived and/or modified sequence opt4 from anti-influenza_CDR
  source 1..18: mol_type = other RNA
cagagcatcagcacctac

SEQ ID NO: 37151 - RNA, 18 nt, synthetic construct
  misc_feature 1..18: note = derived and/or modified sequence opt4 from anti-influenza_CDR
  source 1..18: mol_type = other RNA
cagggcatcatcacctac

SEQ ID NO: 37152 - RNA, 18 nt, synthetic construct
  misc_feature 1..18: note = derived and/or modified sequence opt4 from anti-influenza_CDR
  source 1..18: mol_type = other RNA
cagggcatcagcagctac

SEQ ID NO: 37153 - RNA, 18 nt, synthetic construct
  misc_feature 1..18: note = derived and/or modified sequence opt4 from anti-influenza_CDR
  source 1..18: mol_type = other RNA
caggacgtgagcacctgg

SEQ ID NO: 37154 - RNA, 18 nt, synthetic construct
  misc_feature 1..18: note = derived and/or modified sequence opt4 from anti-influenza_CDR
  source 1..18: mol_type = other RNA
caggacatctacatctac

SEQ ID NO: 37155 - RNA, 18 nt, synthetic construct
  misc_feature 1..18: note = derived and/or modified sequence opt4 from anti-influenza_CDR
  source 1..18: mol_type = other RNA
gagaacatctggaacaac

SEQ ID NO: 37156 - RNA, 18 nt, synthetic construct
  misc_feature 1..18: note = derived and/or modified sequence opt4 from anti-influenza_CDR
  source 1..18: mol_type = other RNA
ggcttcaccgtgaccagc

SEQ ID NO: 37157 - RNA, 18 nt, synthetic construct
  misc_feature 1..18: note = derived and/or modified sequence opt4 from anti-influenza_CDR
  source 1..18: mol_type = other RNA
caggacatcagcggccac

SEQ ID NO: 37158 - RNA, 18 nt, synthetic construct
  misc_feature 1..18: note = derived and/or modified sequence opt4 from anti-influenza_CDR
  source 1..18: mol_type = other RNA
agcctgctgaccgaggtg

SEQ ID NO: 37159 - RNA, 18 nt, synthetic construct
  misc_feature 1..18: note = derived and/or modified sequence opt4 from anti-influenza_CDR
  source 1..18: mol_type = other RNA
ggcagcagcatcagcaac

SEQ ID NO: 37160 - RNA, 18 nt, synthetic construct
  misc_feature 1..18: note = derived and/or modified sequence opt4 from anti-influenza_CDR
  source 1..18: mol_type = other RNA
ggcggcagcatcaccagc

SEQ ID NO: 37161 - RNA, 18 nt, synthetic construct
  misc_feature 1..18: note = derived and/or modified sequence opt4 from anti-influenza_CDR
  source 1..18: mol_type = other RNA
ggcggcagcatcagcagc

SEQ ID NO: 37162 - RNA, 18 nt, synthetic construct
  misc_feature 1..18: note = derived and/or modified sequence opt4 from anti-influenza_CDR
  source 1..18: mol_type = other RNA
ggcctgagcgtgagcagc

SEQ ID NO: 37163 - RNA, 18 nt, synthetic construct
  misc_feature 1..18: note = derived and/or modified sequence opt4 from anti-influenza_CDR
  source 1..18: mol_type = other RNA
ggcgccagcatcagcagc

SEQ ID NO: 37164 - RNA, 18 nt, synthetic construct
  misc_feature 1..18: note = derived and/or modified sequence opt4 from anti-influenza_CDR
  source 1..18: mol_type = other RNA
ggcgacagcatcagcagc

SEQ ID NO: 37165 - RNA, 18 nt, synthetic construct
  misc_feature 1..18: note = derived and/or modified sequence opt4 from anti-influenza_CDR
  source 1..18: mol_type = other RNA
ggcggcagcatcagcaac

SEQ ID NO: 37166 - RNA, 18 nt, synthetic construct
  misc_feature 1..18: note = derived and/or modified sequence opt4 from anti-influenza_CDR
  source 1..18: mol_type = other RNA
ggcggcagcatcagcgcc

SEQ ID NO: 37167 - RNA, 18 nt, synthetic construct
  misc_feature 1..18: note = derived and/or modified sequence opt4 from anti-influenza_CDR
  source 1..18: mol_type = other RNA
ggcttcagcgtgagcgac

SEQ ID NO: 37168 - RNA, 18 nt, synthetic construct
  misc_feature 1..18: note = derived and/or modified sequence opt4 from anti-influenza_CDR
  source 1..18: mol_type = other RNA
agcagaagcctggacgtg

SEQ ID NO: 37169 - RNA, 18 nt, synthetic construct
  misc_feature 1..18: note = derived and/or modified sequence opt4 from anti-influenza_CDR
  source 1..18: mol_type = other RNA
agaagccagcagaccgtg

SEQ ID NO: 37170 - RNA, 18 nt, synthetic construct
  misc_feature 1..18: note = derived and/or modified sequence opt4 from anti-influenza_CDR
  source 1..18: mol_type = other RNA
cagaccatcaacaactac

SEQ ID NO: 37171 - RNA, 18 nt, synthetic construct
  misc_feature 1..18: note = derived and/or modified sequence opt4 from anti-influenza_CDR
  source 1..18: mol_type = other RNA
aacatgggccccaccagc

SEQ ID NO: 37172 - RNA, 18 nt, synthetic construct
  misc_feature 1..18: note = derived and/or modified sequence opt4 from anti-influenza_CDR
  source 1..18: mol_type = other RNA
caggtggtgggcaccaac

SEQ ID NO: 37173 - RNA, 18 nt, synthetic construct
  misc_feature 1..18: note = derived and/or modified sequence opt4 from anti-influenza_CDR
  source 1..18: mol_type = other RNA
cagggcatcaacacccac

SEQ ID NO: 37174 - RNA, 18 nt, synthetic construct
  misc_feature 1..18: note = derived and/or modified sequence opt4 from anti-influenza_CDR
  source 1..18: mol_type = other RNA
caggacatcagaaacaga

SEQ ID NO: 37175 - RNA, 18 nt, synthetic construct
  misc_feature 1..18: note = derived and/or modified sequence opt4 from anti-influenza_CDR
  source 1..18: mol_type = other RNA
cagggcatcggcagcaac

SEQ ID NO: 37176 - RNA, 18 nt, synthetic construct
  misc_feature 1..18: note = derived and/or modified sequence opt4 from anti-influenza_CDR
  source 1..18: mol_type = other RNA
cagaccatctacagatgg

SEQ ID NO: 37177 - RNA, 18 nt, synthetic construct
  misc_feature 1..18: note = derived and/or modified sequence opt4 from anti-influenza_CDR
  source 1..18: mol_type = other RNA
cagaccatcaccagattc

SEQ ID NO: 37178 - RNA, 18 nt, synthetic construct
  misc_feature 1..18: note = derived and/or modified sequence opt4 from anti-influenza_CDR
  source 1..18: mol_type = other RNA
agactgggcgagaagttc

SEQ ID NO: 37179 - RNA, 18 nt, synthetic construct
  misc_feature 1..18: note = derived and/or modified sequence opt4 from anti-influenza_CDR
  source 1..18: mol_type = other RNA
aagctgggcgacaagttc

SEQ ID NO: 37180 - RNA, 18 nt, synthetic construct
  misc_feature 1..18: note = derived and/or modified sequence opt4 from anti-influenza_CDR
  source 1..18: mol_type = other RNA
cagggcctgggcagcaac

SEQ ID NO: 37181 - RNA, 18 nt, synthetic construct
  misc_feature 1..18: note = derived and/or modified sequence opt4 from anti-influenza_CDR
  source 1..18: mol_type = other RNA
tacatcggcagcaagagc

SEQ ID NO: 37182 - RNA, 18 nt, synthetic construct
  misc_feature 1..18: note = derived and/or modified sequence opt4 from anti-influenza_CDR
  source 1..18: mol_type = other RNA
cagctgatcagcagctac

SEQ ID NO: 37183 - RNA, 18 nt, synthetic construct
  misc_feature 1..18: note = derived and/or modified sequence opt4 from anti-influenza_CDR
  source 1..18: mol_type = other RNA
cagagcgtgagcagcaac

SEQ ID NO: 37184 - RNA, 18 nt, synthetic construct
  misc_feature 1..18: note = derived and/or modified sequence opt4 from anti-influenza_CDR
  source 1..18: mol_type = other RNA
caggtgatcagcagctac

SEQ ID NO: 37185 - RNA, 18 nt, synthetic construct
  misc_feature 1..18: note = derived and/or modified sequence opt4 from anti-influenza_CDR
  source 1..18: mol_type = other RNA
cagagcgtgaacagaaac

SEQ ID NO: 37186 - RNA, 18 nt, synthetic construct
  misc_feature 1..18: note = derived and/or modified sequence opt4 from anti-influenza_CDR
  source 1..18: mol_type = other RNA
gacatcggcagcaagagc

SEQ ID NO: 37187 - RNA, 18 nt, synthetic construct
  misc_feature 1..18: note = derived and/or modified sequence opt4 from anti-influenza_CDR
  source 1..18: mol_type = other RNA
cagagcgtgagcaccaac

SEQ ID NO: 37188 - RNA, 18 nt, synthetic construct
  misc_feature 1..18: note = derived and/or modified sequence opt4 from anti-influenza_CDR
  source 1..18: mol_type = other RNA
atgatcgccggctggcac

SEQ ID NO: 37189 - RNA, 18 nt, synthetic construct
  misc_feature 1..18: note = derived and/or modified sequence opt4 from anti-influenza_CDR
  source 1..18: mol_type = other RNA
caggacatcagcacctgg

SEQ ID NO: 37190 - RNA, 18 nt, synthetic construct
  misc_feature 1..18: note = derived and/or modified sequence opt4 from anti-influenza_CDR
  source 1..18: mol_type = other RNA
gagaagatctacagcaac

SEQ ID NO: 37191 - RNA, 21 nt, synthetic construct
  misc_feature 1..21: note = derived and/or modified sequence opt4 from anti-influenza_CDR
  source 1..21: mol_type = other RNA
atctactacaactacaacatc

SEQ ID NO: 37192 - RNA, 21 nt, synthetic construct
  misc_feature 1..21: note = derived and/or modified sequence opt4 from anti-influenza_CDR
  source 1..21: mol_type = other RNA
cagagcatcagcagcggctac

SEQ ID NO: 37193 - RNA, 21 nt, synthetic construct
  misc_feature 1..21: note = derived and/or modified sequence opt4 from anti-influenza_CDR
  source 1..21: mol_type = other RNA
cagagcgtgagcagcagctac

SEQ ID NO: 37194 - RNA, 21 nt, synthetic construct
  misc_feature 1..21: note = derived and/or modified sequence opt4 from anti-influenza_CDR
  source 1..21: mol_type = other RNA
cagaccgtgagcagcagctac

SEQ ID NO: 37195 - RNA, 21 nt, synthetic construct
  misc_feature 1..21: note = derived and/or modified sequence opt4 from anti-influenza_CDR
  source 1..21: mol_type = other RNA
agcaacaacgccgtgtggaac

SEQ ID NO: 37196 - RNA, 21 nt, synthetic construct
  misc_feature 1..21: note = derived and/or modified sequence opt4 from anti-influenza_CDR
  source 1..21: mol_type = other RNA
agcaacagcgccgtgtggaac

SEQ ID NO: 37197 - RNA, 21 nt, synthetic construct
  misc_feature 1..21: note = derived and/or modified sequence opt4 from anti-influenza_CDR
  source 1..21: mol_type = other RNA
gccgccaccaccctgcagagc

SEQ ID NO: 37198 - RNA, 21 nt, synthetic construct
  misc_feature 1..21: note = derived and/or modified sequence opt4 from anti-influenza_CDR
  source 1..21: mol_type = other RNA
agcaacagagccacctggaac

SEQ ID NO: 37199 - RNA, 21 nt, synthetic construct
  misc_feature 1..21: note = derived and/or modified sequence opt4 from anti-influenza_CDR
  source 1..21: mol_type = other RNA
gccaccagcaccctgcagagc

SEQ ID NO: 37200 - RNA, 21 nt, synthetic construct
  misc_feature 1..21: note = derived and/or modified sequence opt4 from anti-influenza_CDR
  source 1..21: mol_type = other RNA
agcaacagcgccacctggaac

SEQ ID NO: 37201 - RNA, 21 nt, synthetic construct
  misc_feature 1..21: note = derived and/or modified sequence opt4 from anti-influenza_CDR
  source 1..21: mol_type = other RNA
gccagcagcaccctgcagagc

SEQ ID NO: 37202 - RNA, 21 nt, synthetic construct
  misc_feature 1..21: note = derived and/or modified sequence opt4 from anti-influenza_CDR
  source 1..21: mol_type = other RNA
agctacaacgccgtgtggaac

SEQ ID NO: 37203 - RNA, 21 nt, synthetic construct
  misc_feature 1..21: note = derived and/or modified sequence opt4 from anti-influenza_CDR
  source 1..21: mol_type = other RNA
gccgccagcagcagactgagc

SEQ ID NO: 37204 - RNA, 21 nt, synthetic construct
  misc_feature 1..21: note = derived and/or modified sequence opt4 from anti-influenza_CDR
  source 1..21: mol_type = other RNA
gccgccagcagcagaggcagc

SEQ ID NO: 37205 - RNA, 21 nt, synthetic construct
  misc_feature 1..21: note = derived and/or modified sequence opt4 from anti-influenza_CDR
  source 1..21: mol_type = other RNA
atctaccacagcggcagcgcc

SEQ ID NO: 37206 - RNA, 21 nt, synthetic construct
  misc_feature 1..21: note = derived and/or modified sequence opt4 from anti-influenza_CDR
  source 1..21: mol_type = other RNA
atctactacagcggcgtgacc

SEQ ID NO: 37207 - RNA, 21 nt, synthetic construct
  misc_feature 1..21: note = derived and/or modified sequence opt4 from anti-influenza_CDR
  source 1..21: mol_type = other RNA
agcagctacctggcctggtac

SEQ ID NO: 37208 - RNA, 21 nt, synthetic construct
  misc_feature 1..21: note = derived and/or modified sequence opt4 from anti-influenza_CDR
  source 1..21: mol_type = other RNA
cagagcctgagcagcagcagc

SEQ ID NO: 37209 - RNA, 21 nt, synthetic construct
  misc_feature 1..21: note = derived and/or modified sequence opt4 from anti-influenza_CDR
  source 1..21: mol_type = other RNA
cagagcgtgagcatcagctac

SEQ ID NO: 37210 - RNA, 21 nt, synthetic construct
  misc_feature 1..21: note = derived and/or modified sequence opt4 from anti-influenza_CDR
  source 1..21: mol_type = other RNA
gacgtgaccgagagacccagc

SEQ ID NO: 37211 - RNA, 21 nt, synthetic construct
  misc_feature 1..21: note = derived and/or modified sequence opt4 from anti-influenza_CDR
  source 1..21: mol_type = other RNA
gccgccagcaccctgctggac

SEQ ID NO: 37212 - RNA, 21 nt, synthetic construct
  misc_feature 1..21: note = derived and/or modified sequence opt4 from anti-influenza_CDR
  source 1..21: mol_type = other RNA
gccgccagcaccctgcacagc

SEQ ID NO: 37213 - RNA, 21 nt, synthetic construct
  misc_feature 1..21: note = derived and/or modified sequence opt4 from anti-influenza_CDR
  source 1..21: mol_type = other RNA
ggcgccagcagcctgcagggc

SEQ ID NO: 37214 - RNA, 21 nt, synthetic construct
  misc_feature 1..21: note = derived and/or modified sequence opt4 from anti-influenza_CDR
  source 1..21: mol_type = other RNA
accaacggcgtgaacgtgggc

SEQ ID NO: 37215 - RNA, 21 nt, synthetic construct
  misc_feature 1..21: note = derived and/or modified sequence opt4 from anti-influenza_CDR
  source 1..21: mol_type = other RNA
gacgccagcaccagagccacc

SEQ ID NO: 37216 - RNA, 21 nt, synthetic construct
  misc_feature 1..21: note = derived and/or modified sequence opt4 from anti-influenza_CDR
  source 1..21: mol_type = other RNA
agcgagacctactactggagc

SEQ ID NO: 37217 - RNA, 21 nt, synthetic construct
  misc_feature 1..21: note = derived and/or modified sequence opt4 from anti-influenza_CDR
  source 1..21: mol_type = other RNA
gaggccgtgaacctggagagc

SEQ ID NO: 37218 - RNA, 21 nt, synthetic construct
  misc_feature 1..21: note = derived and/or modified sequence opt4 from anti-influenza_CDR
  source 1..21: mol_type = other RNA
ggcgccagcaccagagccacc

SEQ ID NO: 37219 - RNA, 21 nt, synthetic construct
  misc_feature 1..21: note = derived and/or modified sequence opt4 from anti-influenza_CDR
  source 1..21: mol_type = other RNA
gtgagcggctactactggagc

SEQ ID NO: 37220 - RNA, 21 nt, synthetic construct
  misc_feature 1..21: note = derived and/or modified sequence opt4 from anti-influenza_CDR
  source 1..21: mol_type = other RNA
atcaccggcgtgagagtgggc

SEQ ID NO: 37221 - RNA, 21 nt, synthetic construct
  misc_feature 1..21: note = derived and/or modified sequence opt4 from anti-influenza_CDR
  source 1..21: mol_type = other RNA
gacgccagcaacagagccacc

SEQ ID NO: 37222 - RNA, 21 nt, synthetic construct
  misc_feature 1..21: note = derived and/or modified sequence opt4 from anti-influenza_CDR
  source 1..21: mol_type = other RNA
gaggtgaccaactggcccagc

SEQ ID NO: 37223 - RNA, 21 nt, synthetic construct
  misc_feature 1..21: note = derived and/or modified sequence opt4 from anti-influenza_CDR
  source 1..21: mol_type = other RNA
aaggacagcgagagacccagc

SEQ ID NO: 37224 - RNA, 21 nt, synthetic construct
  misc_feature 1..21: note = derived and/or modified sequence opt4 from anti-influenza_CDR
  source 1..21: mol_type = other RNA
agcggcaactactactggaac

SEQ ID NO: 37225 - RNA, 21 nt, synthetic construct
  misc_feature 1..21: note = derived and/or modified sequence opt4 from anti-influenza_CDR
  source 1..21: mol_type = other RNA
agcaccaccatcagacacagc

SEQ ID NO: 37226 - RNA, 21 nt, synthetic construct
  misc_feature 1..21: note = derived and/or modified sequence opt4 from anti-influenza_CDR
  source 1..21: mol_type = other RNA
gacgacagcggcagacccagc

SEQ ID NO: 37227 - RNA, 21 nt, synthetic construct
  misc_feature 1..21: note = derived and/or modified sequence opt4 from anti-influenza_CDR
  source 1..21: mol_type = other RNA
agaaacgacctgagacccagc

SEQ ID NO: 37228 - RNA, 21 nt, synthetic construct
  misc_feature 1..21: note = derived and/or modified sequence opt4 from anti-influenza_CDR
  source 1..21: mol_type = other RNA
agcgtggaccactactggagc

SEQ ID NO: 37229 - RNA, 21 nt, synthetic construct
  misc_feature 1..21: note = derived and/or modified sequence opt4 from anti-influenza_CDR
  source 1..21: mol_type = other RNA
gccgtgagcatcctgcagagc

SEQ ID NO: 37230 - RNA, 21 nt, synthetic construct
  misc_feature 1..21: note = derived and/or modified sequence opt4 from anti-influenza_CDR
  source 1..21: mol_type = other RNA
gacgacaccgacagacccagc

SEQ ID NO: 37231 - RNA, 21 nt, synthetic construct
  misc_feature 1..21: note = derived and/or modified sequence opt4 from anti-influenza_CDR
  source 1..21: mol_type = other RNA
gagaacaacaagagacccagc

SEQ ID NO: 37232 - RNA, 21 nt, synthetic construct
  misc_feature 1..21: note = derived and/or modified sequence opt4 from anti-influenza_CDR
  source 1..21: mol_type = other RNA
gacagcagcaacagagccccc

SEQ ID NO: 37233 - RNA, 21 nt, synthetic construct
  misc_feature 1..21: note = derived and/or modified sequence opt4 from anti-influenza_CDR
  source 1..21: mol_type = other RNA
gaggtgaccaagagacccagc

SEQ ID NO: 37234 - RNA, 21 nt, synthetic construct
  misc_feature 1..21: note = derived and/or modified sequence opt4 from anti-influenza_CDR
  source 1..21: mol_type = other RNA
gccaccagcaacacccacagc

SEQ ID NO: 37235 - RNA, 21 nt, synthetic construct
  misc_feature 1..21: note = derived and/or modified sequence opt4 from anti-influenza_CDR
  source 1..21: mol_type = other RNA
gccgccagcaacctggagaac

SEQ ID NO: 37236 - RNA, 21 nt, synthetic construct
  misc_feature 1..21: note = derived and/or modified sequence opt4 from anti-influenza_CDR
  source 1..21: mol_type = other RNA
gccgccagcggcctgcagagc

SEQ ID NO: 37237 - RNA, 21 nt, synthetic construct
  misc_feature 1..21: note = derived and/or modified sequence opt4 from anti-influenza_CDR
  source 1..21: mol_type = other RNA
ggcttcaccgtgagcagcaac

SEQ ID NO: 37238 - RNA, 21 nt, synthetic construct
  misc_feature 1..21: note = derived and/or modified sequence opt4 from anti-influenza_CDR
  source 1..21: mol_type = other RNA
ggcggcggctacagctggaac

SEQ ID NO: 37239 - RNA, 21 nt, synthetic construct
  misc_feature 1..21: note = derived and/or modified sequence opt4 from anti-influenza_CDR
  source 1..21: mol_type = other RNA
ggcgccagcaacctgcagagc

SEQ ID NO: 37240 - RNA, 21 nt, synthetic construct
  misc_feature 1..21: note = derived and/or modified sequence opt4 from anti-influenza_CDR
  source 1..21: mol_type = other RNA
ggcgccaccaacctgcagagc

SEQ ID NO: 37241 - RNA, 21 nt, synthetic construct
  misc_feature 1..21: note = derived and/or modified sequence opt4 from anti-influenza_CDR
  source 1..21: mol_type = other RNA
ggcgccagcaacctgcacagc

SEQ ID NO: 37242 - RNA, 21 nt, synthetic construct
  misc_feature 1..21: note = derived and/or modified sequence opt4 from anti-influenza_CDR
  source 1..21: mol_type = other RNA
ggcgccagcaccctgcagagc

SEQ ID NO: 37243 - RNA, 21 nt, synthetic construct
  misc_feature 1..21: note = derived and/or modified sequence opt4 from anti-influenza_CDR
  source 1..21: mol_type = other RNA
gacaacagcgacagacccagc

SEQ ID NO: 37244 - RNA, 21 nt, synthetic construct
  misc_feature 1..21: note = derived and/or modified sequence opt4 from anti-influenza_CDR
  source 1..21: mol_type = other RNA
ggcgccagcagcctgcagagc

SEQ ID NO: 37245 - RNA, 21 nt, synthetic construct
  misc_feature 1..21: note = derived and/or modified sequence opt4 from anti-influenza_CDR
  source 1..21: mol_type = other RNA
ggcaacagcaacagacccagc

SEQ ID NO: 37246 - RNA, 21 nt, synthetic construct
  misc_feature 1..21: note = derived and/or modified sequence opt4 from anti-influenza_CDR
  source 1..21: mol_type = other RNA
gccgccagcagcctgcagagc

SEQ ID NO: 37247 - RNA, 21 nt, synthetic construct
  misc_feature 1..21: note = derived and/or modified sequence opt4 from anti-influenza_CDR
  source 1..21: mol_type = other RNA
gccgccagcagcctgcacagc

SEQ ID NO: 37248 - RNA, 21 nt, synthetic construct
  misc_feature 1..21: note = derived and/or modified sequence opt4 from anti-influenza_CDR
  source 1..21: mol_type = other RNA
ggcgccagcaccctgcagaac

SEQ ID NO: 37249 - RNA, 21 nt, synthetic construct
  misc_feature 1..21: note = derived and/or modified sequence opt4 from anti-influenza_CDR
  source 1..21: mol_type = other RNA
ggcgccaccgacctgcagagc

SEQ ID NO: 37250 - RNA, 21 nt, synthetic construct
  misc_feature 1..21: note = derived and/or modified sequence opt4 from anti-influenza_CDR
  source 1..21: mol_type = other RNA
agcggcgcctactactggacc

SEQ ID NO: 37251 - RNA, 21 nt, synthetic construct
  misc_feature 1..21: note = derived and/or modified sequence opt4 from anti-influenza_CDR
  source 1..21: mol_type = other RNA
gtgagcgacaactacatcaac

SEQ ID NO: 37252 - RNA, 21 nt, synthetic construct
  misc_feature 1..21: note = derived and/or modified sequence opt4 from anti-influenza_CDR
  source 1..21: mol_type = other RNA
tgggccagcaccagagagagc

SEQ ID NO: 37253 - RNA, 21 nt, synthetic construct
  misc_feature 1..21: note = derived and/or modified sequence opt4 from anti-influenza_CDR
  source 1..21: mol_type = other RNA
agcaacaaccagagacccagc

SEQ ID NO: 37254 - RNA, 21 nt, synthetic construct
  misc_feature 1..21: note = derived and/or modified sequence opt4 from anti-influenza_CDR
  source 1..21: mol_type = other RNA
gaggtgagcaacagacccagc

SEQ ID NO: 37255 - RNA, 21 nt, synthetic construct
  misc_feature 1..21: note = derived and/or modified sequence opt4 from anti-influenza_CDR
  source 1..21: mol_type = other RNA
aagaacacccagagacccagc

SEQ ID NO: 37256 - RNA, 21 nt, synthetic construct
  misc_feature 1..21: note = derived and/or modified sequence opt4 from anti-influenza_CDR
  source 1..21: mol_type = other RNA
gacaacaacaagagacccagc

SEQ ID NO: 37257 - RNA, 21 nt, synthetic construct
  misc_feature 1..21: note = derived and/or modified sequence opt4 from anti-influenza_CDR
  source 1..21: mol_type = other RNA
gacgccagcaccctgagaagc

SEQ ID NO: 37258 - RNA, 21 nt, synthetic construct
  misc_feature 1..21: note = derived and/or modified sequence opt4 from anti-influenza_CDR
  source 1..21: mol_type = other RNA
caggacaacagaagacccagc

SEQ ID NO: 37259 - RNA, 21 nt, synthetic construct
  misc_feature 1..21: note = derived and/or modified sequence opt4 from anti-influenza_CDR
  source 1..21: mol_type = other RNA
gacgtgagcaagagacccagc

SEQ ID NO: 37260 - RNA, 21 nt, synthetic construct
  misc_feature 1..21: note = derived and/or modified sequence opt4 from anti-influenza_CDR
  source 1..21: mol_type = other RNA
gacgccagcagcagagccacc

SEQ ID NO: 37261 - RNA, 21 nt, synthetic construct
  misc_feature 1..21: note = derived and/or modified sequence opt4 from anti-influenza_CDR
  source 1..21: mol_type = other RNA
ctgggcagcaacagagccagc

SEQ ID NO: 37262 - RNA, 21 nt, synthetic construct
  misc_feature 1..21: note = derived and/or modified sequence opt4 from anti-influenza_CDR
  source 1..21: mol_type = other RNA
ggcgccagcaccagagccgcc

SEQ ID NO: 37263 - RNA, 21 nt, synthetic construct
  misc_feature 1..21: note = derived and/or modified sequence opt4 from anti-influenza_CDR
  source 1..21: mol_type = other RNA
gacgacagcgacagacccagc

SEQ ID NO: 37264 - RNA, 21 nt, synthetic construct
  misc_feature 1..21: note = derived and/or modified sequence opt4 from anti-influenza_CDR
  source 1..21: mol_type = other RNA
agagacggccagagacccagc

SEQ ID NO: 37265 - RNA, 21 nt, synthetic construct
  misc_feature 1..21: note = derived and/or modified sequence opt4 from anti-influenza_CDR
  source 1..21: mol_type = other RNA
ggcgccagcagcagagccacc

SEQ ID NO: 37266 - RNA, 21 nt, synthetic construct
  misc_feature 1..21: note = derived and/or modified sequence opt4 from anti-influenza_CDR
  source 1..21: mol_type = other RNA
ggcgccagcagcagagccagc

SEQ ID NO: 37267 - RNA, 21 nt, synthetic construct
  misc_feature 1..21: note = derived and/or modified sequence opt4 from anti-influenza_CDR
  source 1..21: mol_type = other RNA
gccgccagcaccctgcagagc

SEQ ID NO: 37268 - RNA, 21 nt, synthetic construct
  misc_feature 1..21: note = derived and/or modified sequence opt4 from anti-influenza_CDR
  source 1..21: mol_type = other RNA
ctggtgagcaagagagccagc

SEQ ID NO: 37269 - RNA, 21 nt, synthetic construct
  misc_feature 1..21: note = derived and/or modified sequence opt4 from anti-influenza_CDR
  source 1..21: mol_type = other RNA
gacgtgacctacagacccagc

SEQ ID NO: 37270 - RNA, 21 nt, synthetic construct
  misc_feature 1..21: note = derived and/or modified sequence opt4 from anti-influenza_CDR
  source 1..21: mol_type = other RNA
atgcaggccctggagaccccc

SEQ ID NO: 37271 - RNA, 21 nt, synthetic construct
  misc_feature 1..21: note = derived and/or modified sequence opt4 from anti-influenza_CDR
  source 1..21: mol_type = other RNA
cagaactacggcagccccttc

SEQ ID NO: 37272 - RNA, 21 nt, synthetic construct
  misc_feature 1..21: note = derived and/or modified sequence opt4 from anti-influenza_CDR
  source 1..21: mol_type = other RNA
cagcagtacggcagcctgccc

SEQ ID NO: 37273 - RNA, 21 nt, synthetic construct
  misc_feature 1..21: note = derived and/or modified sequence opt4 from anti-influenza_CDR
  source 1..21: mol_type = other RNA
tggggcagctacctggagagc

SEQ ID NO: 37274 - RNA, 21 nt, synthetic construct
  misc_feature 1..21: note = derived and/or modified sequence opt4 from anti-influenza_CDR
  source 1..21: mol_type = other RNA
agcgccagcaccagagccacc

SEQ ID NO: 37275 - RNA, 21 nt, synthetic construct
  misc_feature 1..21: note = derived and/or modified sequence opt4 from anti-influenza_CDR
  source 1..21: mol_type = other RNA
ggcgccagcaccagagccagc

SEQ ID NO: 37276 - RNA, 21 nt, synthetic construct
  misc_feature 1..21: note = derived and/or modified sequence opt4 from anti-influenza_CDR
  source 1..21: mol_type = other RNA
ggcgccagcaccagagacacc

SEQ ID NO: 37277 - RNA, 21 nt, synthetic construct
  misc_feature 1..21: note = derived and/or modified sequence opt4 from anti-influenza_CDR
  source 1..21: mol_type = other RNA
aaggtgagcaccctggagagc

SEQ ID NO: 37278 - RNA, 21 nt, synthetic construct
  misc_feature 1..21: note = derived and/or modified sequence opt4 from anti-influenza_CDR
  source 1..21: mol_type = other RNA
agcaacaccgagagacccagc

SEQ ID NO: 37279 - RNA, 21 nt, synthetic construct
  misc_feature 1..21: note = derived and/or modified sequence opt4 from anti-influenza_CDR
  source 1..21: mol_type = other RNA
aagatcagcaacagagacagc

SEQ ID NO: 37280 - RNA, 21 nt, synthetic construct
  misc_feature 1..21: note = derived and/or modified sequence opt4 from anti-influenza_CDR
  source 1..21: mol_type = other RNA
agcgccagccacagatacagc

SEQ ID NO: 37281 - RNA, 21 nt, synthetic construct
  misc_feature 1..21: note = derived and/or modified sequence opt4 from anti-influenza_CDR
  source 1..21: mol_type = other RNA
cagagcgtgagaagcaacaac

SEQ ID NO: 37282 - RNA, 21 nt, synthetic construct
  misc_feature 1..21: note = derived and/or modified sequence opt4 from anti-influenza_CDR
  source 1..21: mol_type = other RNA
cagagcgtgagaagcggctac

SEQ ID NO: 37283 - RNA, 21 nt, synthetic construct
  misc_feature 1..21: note = derived and/or modified sequence opt4 from anti-influenza_CDR
  source 1..21: mol_type = other RNA
atctactacagaggcagcacc

SEQ ID NO: 37284 - RNA, 21 nt, synthetic construct
  misc_feature 1..21: note = derived and/or modified sequence opt4 from anti-influenza_CDR
  source 1..21: mol_type = other RNA
gtgtactacagcggcatcacc

SEQ ID NO: 37285 - RNA, 21 nt, synthetic construct
  misc_feature 1..21: note = derived and/or modified sequence opt4 from anti-influenza_CDR
  source 1..21: mol_type = other RNA
agccacttcgccaacctgaag

SEQ ID NO: 37286 - RNA, 21 nt, synthetic construct
  misc_feature 1..21: note = derived and/or modified sequence opt4 from anti-influenza_CDR
  source 1..21: mol_type = other RNA
ctgaacaagagcaagccctac

SEQ ID NO: 37287 - RNA, 21 nt, synthetic construct
  misc_feature 1..21: note = derived and/or modified sequence opt4 from anti-influenza_CDR
  source 1..21: mol_type = other RNA
aagctggccaacaccggcacc

SEQ ID NO: 37288 - RNA, 21 nt, synthetic construct
  misc_feature 1..21: note = derived and/or modified sequence opt4 from anti-influenza_CDR
  source 1..21: mol_type = other RNA
gccgccagcaccctgaccagc

SEQ ID NO: 37289 - RNA, 21 nt, synthetic construct
  misc_feature 1..21: note = derived and/or modified sequence opt4 from anti-influenza_CDR
  source 1..21: mol_type = other RNA
gacgccagcaagctggccagc

SEQ ID NO: 37290 - RNA, 21 nt, synthetic construct
  misc_feature 1..21: note = derived and/or modified sequence opt4 from anti-influenza_CDR
  source 1..21: mol_type = other RNA
ttcgccagcagactggccagc

SEQ ID NO: 37291 - RNA, 21 nt, synthetic construct
  misc_feature 1..21: note = derived and/or modified sequence opt4 from anti-influenza_CDR
  source 1..21: mol_type = other RNA
agcgccagcaccctggccagc

SEQ ID NO: 37292 - RNA, 21 nt, synthetic construct
  misc_feature 1..21: note = derived and/or modified sequence opt4 from anti-influenza_CDR
  source 1..21: mol_type = other RNA
gaggtgagccagagacccagc

SEQ ID NO: 37293 - RNA, 21 nt, synthetic construct
  misc_feature 1..21: note = derived and/or modified sequence opt4 from anti-influenza_CDR
  source 1..21: mol_type = other RNA
ggcggcaccctgaacaactac

SEQ ID NO: 37294 - RNA, 21 nt, synthetic construct
  misc_feature 1..21: note = derived and/or modified sequence opt4 from anti-influenza_CDR
  source 1..21: mol_type = other RNA
gacatcgtgatgacccagagc

SEQ ID NO: 37295 - RNA, 24 nt, synthetic construct
  misc_feature 1..24: note = derived and/or modified sequence opt4 from anti-influenza_CDR
  source 1..24: mol_type = other RNA
ggcttcaccttcagcaactacgcc

SEQ ID NO: 37296 - RNA, 24 nt, synthetic construct
  misc_feature 1..24: note = derived and/or modified sequence opt4 from anti-influenza_CDR
  source 1..24: mol_type = other RNA
ggcttcaccttcagcaactacggc

SEQ ID NO: 37297 - RNA, 24 nt, synthetic construct
  misc_feature 1..24: note = derived and/or modified sequence opt4 from anti-influenza_CDR
  source 1..24: mol_type = other RNA
ggcttcaccttcagcagctacgcc

SEQ ID NO: 37298 - RNA, 24 nt, synthetic construct
  misc_feature 1..24: note = derived and/or modified sequence opt4 from anti-influenza_CDR
  source 1..24: mol_type = other RNA
ggcttcaccttcagcacctacgcc

SEQ ID NO: 37299 - RNA, 24 nt, synthetic construct
  misc_feature 1..24: note = derived and/or modified sequence opt4 from anti-influenza_CDR
  source 1..24: mol_type = other RNA
ggcggcatcttcatcagccaggcc

SEQ ID NO: 37300 - RNA, 24 nt, synthetic construct
  misc_feature 1..24: note = derived and/or modified sequence opt4 from anti-influenza_CDR
  source 1..24: mol_type = other RNA
ggcggcatcttcagcccctacgcc

SEQ ID NO: 37301 - RNA, 24 nt, synthetic construct
  misc_feature 1..24: note = derived and/or modified sequence opt4 from anti-influenza_CDR
  source 1..24: mol_type = other RNA
ggcggccccttcagcggcttcgcc

SEQ ID NO: 37302 - RNA, 24 nt, synthetic construct
  misc_feature 1..24: note = derived and/or modified sequence opt4 from anti-influenza_CDR
  source 1..24: mol_type = other RNA
ggcggcaccttcaacagccacgcc

SEQ ID NO: 37303 - RNA, 24 nt, synthetic construct
  misc_feature 1..24: note = derived and/or modified sequence opt4 from anti-influenza_CDR
  source 1..24: mol_type = other RNA
ggcagcaacatcggcagcaacacc

SEQ ID NO: 37304 - RNA, 24 nt, synthetic construct
  misc_feature 1..24: note = derived and/or modified sequence opt4 from anti-influenza_CDR
  source 1..24: mol_type = other RNA
ggcgtgaccttcagcatgtacgcc

SEQ ID NO: 37305 - RNA, 24 nt, synthetic construct
  misc_feature 1..24: note = derived and/or modified sequence opt4 from anti-influenza_CDR
  source 1..24: mol_type = other RNA
ggcgtgaccttcagcatgtacacc

SEQ ID NO: 37306 - RNA, 24 nt, synthetic construct
  misc_feature 1..24: note = derived and/or modified sequence opt4 from anti-influenza_CDR
  source 1..24: mol_type = other RNA
ggcgtgaccagcagcaactacccc

SEQ ID NO: 37307 - RNA, 24 nt, synthetic construct
  misc_feature 1..24: note = derived and/or modified sequence opt4 from anti-influenza_CDR
  source 1..24: mol_type = other RNA
atcatcgccatcttcggcaccacc

SEQ ID NO: 37308 - RNA, 24 nt, synthetic construct
  misc_feature 1..24: note = derived and/or modified sequence opt4 from anti-influenza_CDR
  source 1..24: mol_type = other RNA
atcatccccctgttcggcaccgcc

SEQ ID NO: 37309 - RNA, 24 nt, synthetic construct
  misc_feature 1..24: note = derived and/or modified sequence opt4 from anti-influenza_CDR
  source 1..24: mol_type = other RNA
atcatccccctgttcggcaccacc

SEQ ID NO: 37310 - RNA, 24 nt, synthetic construct
  misc_feature 1..24: note = derived and/or modified sequence opt4 from anti-influenza_CDR
  source 1..24: mol_type = other RNA
atcatccccatgttcggcgccacc

SEQ ID NO: 37311 - RNA, 24 nt, synthetic construct
  misc_feature 1..24: note = derived and/or modified sequence opt4 from anti-influenza_CDR
  source 1..24: mol_type = other RNA
atcatccccatgttcggcaccacc

SEQ ID NO: 37312 - RNA, 24 nt, synthetic construct
  misc_feature 1..24: note = derived and/or modified sequence opt4 from anti-influenza_CDR
  source 1..24: mol_type = other RNA
atcaacagcggcggcggcgccacc

SEQ ID NO: 37313 - RNA, 24 nt, synthetic construct
  misc_feature 1..24: note = derived and/or modified sequence opt4 from anti-influenza_CDR
  source 1..24: mol_type = other RNA
atcagcgccgtgttcggcaccgcc

SEQ ID NO: 37314 - RNA, 24 nt, synthetic construct
  misc_feature 1..24: note = derived and/or modified sequence opt4 from anti-influenza_CDR
  source 1..24: mol_type = other RNA
atcagctacgacgccaactacaag

SEQ ID NO: 37315 - RNA, 24 nt, synthetic construct
  misc_feature 1..24: note = derived and/or modified sequence opt4 from anti-influenza_CDR
  source 1..24: mol_type = other RNA
atcagctacgacggcaactacaag

SEQ ID NO: 37316 - RNA, 24 nt, synthetic construct
  misc_feature 1..24: note = derived and/or modified sequence opt4 from anti-influenza_CDR
  source 1..24: mol_type = other RNA
atcagctacgacggcagcaacaag

SEQ ID NO: 37317 - RNA, 24 nt, synthetic construct
  misc_feature 1..24: note = derived and/or modified sequence opt4 from anti-influenza_CDR
  source 1..24: mol_type = other RNA
atcagctacgacggcagcaaccag

SEQ ID NO: 37318 - RNA, 24 nt, synthetic construct
  misc_feature 1..24: note = derived and/or modified sequence opt4 from anti-influenza_CDR
  source 1..24: mol_type = other RNA
cagcagtactacagaagccccagc

SEQ ID NO: 37319 - RNA, 24 nt, synthetic construct
  misc_feature 1..24: note = derived and/or modified sequence opt4 from anti-influenza_CDR
  source 1..24: mol_type = other RNA
gtgctgcccctgttcggcgtgacc

SEQ ID NO: 37320 - RNA, 24 nt, synthetic construct
  misc_feature 1..24: note = derived and/or modified sequence opt4 from anti-influenza_CDR
  source 1..24: mol_type = other RNA
ggcggcaccttcagcagcgacgcc

SEQ ID NO: 37321 - RNA, 24 nt, synthetic construct
  misc_feature 1..24: note = derived and/or modified sequence opt4 from anti-influenza_CDR
  source 1..24: mol_type = other RNA
atcatccccgtgttccagaccgcc

SEQ ID NO: 37322 - RNA, 24 nt, synthetic construct
  misc_feature 1..24: note = derived and/or modified sequence opt4 from anti-influenza_CDR
  source 1..24: mol_type = other RNA
accagcaacatcggcagcaacgcc

SEQ ID NO: 37323 - RNA, 24 nt, synthetic construct
  misc_feature 1..24: note = derived and/or modified sequence opt4 from anti-influenza_CDR
  source 1..24: mol_type = other RNA
ggctacagcttcaccagcagatgg

SEQ ID NO: 37324 - RNA, 24 nt, synthetic construct
  misc_feature 1..24: note = derived and/or modified sequence opt4 from anti-influenza_CDR
  source 1..24: mol_type = other RNA
atctaccccagcgacagcgacgtg

SEQ ID NO: 37325 - RNA, 24 nt, synthetic construct
  misc_feature 1..24: note = derived and/or modified sequence opt4 from anti-influenza_CDR
  source 1..24: mol_type = other RNA
cagcagtacgacaactggctgagc

SEQ ID NO: 37326 - RNA, 24 nt, synthetic construct
  misc_feature 1..24: note = derived and/or modified sequence opt4 from anti-influenza_CDR
  source 1..24: mol_type = other RNA
ggcggcaccttcagcaactacggc

SEQ ID NO: 37327 - RNA, 24 nt, synthetic construct
  misc_feature 1..24: note = derived and/or modified sequence opt4 from anti-influenza_CDR
  source 1..24: mol_type = other RNA
ggcgccagcatcagcagcagctac

SEQ ID NO: 37328 - RNA, 24 nt, synthetic construct
  misc_feature 1..24: note = derived and/or modified sequence opt4 from anti-influenza_CDR
  source 1..24: mol_type = other RNA
ggcggcaccttcagcagctacgac

SEQ ID NO: 37329 - RNA, 24 nt, synthetic construct
  misc_feature 1..24: note = derived and/or modified sequence opt4 from anti-influenza_CDR
  source 1..24: mol_type = other RNA
atcatccccatctacggcaccgcc

SEQ ID NO: 37330 - RNA, 24 nt, synthetic construct
  misc_feature 1..24: note = derived and/or modified sequence opt4 from anti-influenza_CDR
  source 1..24: mol_type = other RNA
ggctacaccagcaccacctacggc

SEQ ID NO: 37331 - RNA, 24 nt, synthetic construct
  misc_feature 1..24: note = derived and/or modified sequence opt4 from anti-influenza_CDR
  source 1..24: mol_type = other RNA
atcaacccctacaacggcaacccc

SEQ ID NO: 37332 - RNA, 24 nt, synthetic construct
  misc_feature 1..24: note = derived and/or modified sequence opt4 from anti-influenza_CDR
  source 1..24: mol_type = other RNA
atctggtacgacggcgacaacaag

SEQ ID NO: 37333 - RNA, 24 nt, synthetic construct
  misc_feature 1..24: note = derived and/or modified sequence opt4 from anti-influenza_CDR
  source 1..24: mol_type = other RNA
ggcttcaccttcagcgacttctgg

SEQ ID NO: 37334 - RNA, 24 nt, synthetic construct
  misc_feature 1..24: note = derived and/or modified sequence opt4 from anti-influenza_CDR
  source 1..24: mol_type = other RNA
atcgaccaggacggcaacgagaga

SEQ ID NO: 37335 - RNA, 24 nt, synthetic construct
  misc_feature 1..24: note = derived and/or modified sequence opt4 from anti-influenza_CDR
  source 1..24: mol_type = other RNA
agcagcaacatcggcaagaactac

SEQ ID NO: 37336 - RNA, 24 nt, synthetic construct
  misc_feature 1..24: note = derived and/or modified sequence opt4 from anti-influenza_CDR
  source 1..24: mol_type = other RNA
ggctacaccttcaccaactactgg

SEQ ID NO: 37337 - RNA, 24 nt, synthetic construct
  misc_feature 1..24: note = derived and/or modified sequence opt4 from anti-influenza_CDR
  source 1..24: mol_type = other RNA
atcttcccccccgacagccagacc

SEQ ID NO: 37338 - RNA, 24 nt, synthetic construct
  misc_feature 1..24: note = derived and/or modified sequence opt4 from anti-influenza_CDR
  source 1..24: mol_type = other RNA
ggctacagcttcagcgactactgg

SEQ ID NO: 37339 - RNA, 24 nt, synthetic construct
  misc_feature 1..24: note = derived and/or modified sequence opt4 from anti-influenza_CDR
  source 1..24: mol_type = other RNA
atctaccccgccagcagcgagatc

SEQ ID NO: 37340 - RNA, 24 nt, synthetic construct
  misc_feature 1..24: note = derived and/or modified sequence opt4 from anti-influenza_CDR
  source 1..24: mol_type = other RNA
agcggcgacagcggcacctggaac

SEQ ID NO: 37341 - RNA, 24 nt, synthetic construct
  misc_feature 1..24: note = derived and/or modified sequence opt4 from anti-influenza_CDR
  source 1..24: mol_type = other RNA
ggcggcaccctgaacaactacgcc

SEQ ID NO: 37342 - RNA, 24 nt, synthetic construct
  misc_feature 1..24: note = derived and/or modified sequence opt4 from anti-influenza_CDR
  source 1..24: mol_type = other RNA
atcagccccatcttcggcaccctg

SEQ ID NO: 37343 - RNA, 24 nt, synthetic construct
  misc_feature 1..24: note = derived and/or modified sequence opt4 from anti-influenza_CDR
  source 1..24: mol_type = other RNA
ggcgtgttcttcagcagccacgcc

SEQ ID NO: 37344 - RNA, 24 nt, synthetic construct
  misc_feature 1..24: note = derived and/or modified sequence opt4 from anti-influenza_CDR
  source 1..24: mol_type = other RNA
atcagccccatgttcggcaccacc

SEQ ID NO: 37345 - RNA, 24 nt, synthetic construct
  misc_feature 1..24: note = derived and/or modified sequence opt4 from anti-influenza_CDR
  source 1..24: mol_type = other RNA
ggcttcaccttcagcagattcggc

SEQ ID NO: 37346 - RNA, 24 nt, synthetic construct
  misc_feature 1..24: note = derived and/or modified sequence opt4 from anti-influenza_CDR
  source 1..24: mol_type = other RNA
atctggtacgacggcagcaacaag

SEQ ID NO: 37347 - RNA, 24 nt, synthetic construct
  misc_feature 1..24: note = derived and/or modified sequence opt4 from anti-influenza_CDR
  source 1..24: mol_type = other RNA
cagacctacggcggcgtgagcacc

SEQ ID NO: 37348 - RNA, 24 nt, synthetic construct
  misc_feature 1..24: note = derived and/or modified sequence opt4 from anti-influenza_CDR
  source 1..24: mol_type = other RNA
gacagcgccggcaacagacacagc

SEQ ID NO: 37349 - RNA, 24 nt, synthetic construct
  misc_feature 1..24: note = derived and/or modified sequence opt4 from anti-influenza_CDR
  source 1..24: mol_type = other RNA
ttcagaggcggcaacagcctgagc

SEQ ID NO: 37350 - RNA, 24 nt, synthetic construct
  misc_feature 1..24: note = derived and/or modified sequence opt4 from anti-influenza_CDR
  source 1..24: mol_type = other RNA
ggctacaccttcaccacctactgg

SEQ ID NO: 37351 - RNA, 24 nt, synthetic construct
  misc_feature 1..24: note = derived and/or modified sequence opt4 from anti-influenza_CDR
  source 1..24: mol_type = other RNA
atcgacccctacgacagcgagacc

SEQ ID NO: 37352 - RNA, 24 nt, synthetic construct
  misc_feature 1..24: note = derived and/or modified sequence opt4 from anti-influenza_CDR
  source 1..24: mol_type = other RNA
atcagaaagttcctgaactggtac

SEQ ID NO: 37353 - RNA, 24 nt, synthetic construct
  misc_feature 1..24: note = derived and/or modified sequence opt4 from anti-influenza_CDR
  source 1..24: mol_type = other RNA
cagcagtacgacggcctgcccttc

SEQ ID NO: 37354 - RNA, 24 nt, synthetic construct
  misc_feature 1..24: note = derived and/or modified sequence opt4 from anti-influenza_CDR
  source 1..24: mol_type = other RNA
atcagaaacagcctgaactggtac

SEQ ID NO: 37355 - RNA, 24 nt, synthetic construct
  misc_feature 1..24: note = derived and/or modified sequence opt4 from anti-influenza_CDR
  source 1..24: mol_type = other RNA
cagcaggccaacagcttccccctg

SEQ ID NO: 37356 - RNA, 24 nt, synthetic construct
  misc_feature 1..24: note = derived and/or modified sequence opt4 from anti-influenza_CDR
  source 1..24: mol_type = other RNA
agcctgctgaccgaggtggagacc

SEQ ID NO: 37357 - RNA, 24 nt, synthetic construct
  misc_feature 1..24: note = derived and/or modified sequence opt4 from anti-influenza_CDR
  source 1..24: mol_type = other RNA
cagcagagctacagcatgcccgcc

SEQ ID NO: 37358 - RNA, 24 nt, synthetic construct
  misc_feature 1..24: note = derived and/or modified sequence opt4 from anti-influenza_CDR
  source 1..24: mol_type = other RNA
ggcggccccgtgagcggcggcggc

SEQ ID NO: 37359 - RNA, 24 nt, synthetic construct
  misc_feature 1..24: note = derived and/or modified sequence opt4 from anti-influenza_CDR
  source 1..24: mol_type = other RNA
cagcagagcttcagcgtgcccgcc

SEQ ID NO: 37360 - RNA, 24 nt, synthetic construct
  misc_feature 1..24: note = derived and/or modified sequence opt4 from anti-influenza_CDR
  source 1..24: mol_type = other RNA
cagcagacctacagcatccccctg

SEQ ID NO: 37361 - RNA, 24 nt, synthetic construct
  misc_feature 1..24: note = derived and/or modified sequence opt4 from anti-influenza_CDR
  source 1..24: mol_type = other RNA
cagcagagctacagcgtgcccgcc

SEQ ID NO: 37362 - RNA, 24 nt, synthetic construct
  misc_feature 1..24: note = derived and/or modified sequence opt4 from anti-influenza_CDR
  source 1..24: mol_type = other RNA
cagcagaccttcagcatccccctg

SEQ ID NO: 37363 - RNA, 24 nt, synthetic construct
  misc_feature 1..24: note = derived and/or modified sequence opt4 from anti-influenza_CDR
  source 1..24: mol_type = other RNA
ggcgacagcatcaccagcggcgcc

SEQ ID NO: 37364 - RNA, 24 nt, synthetic construct
  misc_feature 1..24: note = derived and/or modified sequence opt4 from anti-influenza_CDR
  source 1..24: mol_type = other RNA
caggcctgggacagcagcaccgcc

SEQ ID NO: 37365 - RNA, 24 nt, synthetic construct
  misc_feature 1..24: note = derived and/or modified sequence opt4 from anti-influenza_CDR
  source 1..24: mol_type = other RNA
cagcagtacggcagcagcctgtgg

SEQ ID NO: 37366 - RNA, 24 nt, synthetic construct
  misc_feature 1..24: note = derived and/or modified sequence opt4 from anti-influenza_CDR
  source 1..24: mol_type = other RNA
gcctacggctacaccttcgacccc

SEQ ID NO: 37367 - RNA, 24 nt, synthetic construct
  misc_feature 1..24: note = derived and/or modified sequence opt4 from anti-influenza_CDR
  source 1..24: mol_type = other RNA
atgcaggccctgcagacccccctg

SEQ ID NO: 37368 - RNA, 24 nt, synthetic construct
  misc_feature 1..24: note = derived and/or modified sequence opt4 from anti-influenza_CDR
  source 1..24: mol_type = other RNA
cagcagtacggcagcagcctgacc

SEQ ID NO: 37369 - RNA, 24 nt, synthetic construct
  misc_feature 1..24: note = derived and/or modified sequence opt4 from anti-influenza_CDR
  source 1..24: mol_type = other RNA
cagaagtacaacagcgcccccagc

SEQ ID NO: 37370 - RNA, 24 nt, synthetic construct
  misc_feature 1..24: note = derived and/or modified sequence opt4 from anti-influenza_CDR
  source 1..24: mol_type = other RNA
cagcagagaagcaactggctgaag

SEQ ID NO: 37371 - RNA, 24 nt, synthetic construct
  misc_feature 1..24: note = derived and/or modified sequence opt4 from anti-influenza_CDR
  source 1..24: mol_type = other RNA
agcagccagagcagaagcagcacc

SEQ ID NO: 37372 - RNA, 24 nt, synthetic construct
  misc_feature 1..24: note = derived and/or modified sequence opt4 from anti-influenza_CDR
  source 1..24: mol_type = other RNA
ccctacgacgtgcccgactacgag

SEQ ID NO: 37373 - RNA, 24 nt, synthetic construct
  misc_feature 1..24: note = derived and/or modified sequence opt4 from anti-influenza_CDR
  source 1..24: mol_type = other RNA
ccctacgacgtgcccgactacgcc

SEQ ID NO: 37374 - RNA, 24 nt, synthetic construct
  misc_feature 1..24: note = derived and/or modified sequence opt4 from anti-influenza_CDR
  source 1..24: mol_type = other RNA
cccggcgacttcaacgactacgag

SEQ ID NO: 37375 - RNA, 24 nt, synthetic construct
  misc_feature 1..24: note = derived and/or modified sequence opt4 from anti-influenza_CDR
  source 1..24: mol_type = other RNA
cccaaggtgagagaccaggagagc

SEQ ID NO: 37376 - RNA, 24 nt, synthetic construct
  misc_feature 1..24: note = derived and/or modified sequence opt4 from anti-influenza_CDR
  source 1..24: mol_type = other RNA
accagctacaccagcagcaacacc

SEQ ID NO: 37377 - RNA, 24 nt, synthetic construct
  misc_feature 1..24: note = derived and/or modified sequence opt4 from anti-influenza_CDR
  source 1..24: mol_type = other RNA
ggcggcaacttcaacaactacgcc

SEQ ID NO: 37378 - RNA, 24 nt, synthetic construct
  misc_feature 1..24: note = derived and/or modified sequence opt4 from anti-influenza_CDR
  source 1..24: mol_type = other RNA
atcagccccatcttcggcagcacc

SEQ ID NO: 37379 - RNA, 24 nt, synthetic construct
  misc_feature 1..24: note = derived and/or modified sequence opt4 from anti-influenza_CDR
  source 1..24: mol_type = other RNA
agcagctacaccagcagcaacacc

SEQ ID NO: 37380 - RNA, 24 nt, synthetic construct
  misc_feature 1..24: note = derived and/or modified sequence opt4 from anti-influenza_CDR
  source 1..24: mol_type = other RNA
ggcggcaccttcaacaactacgcc

SEQ ID NO: 37381 - RNA, 24 nt, synthetic construct
  misc_feature 1..24: note = derived and/or modified sequence opt4 from anti-influenza_CDR
  source 1..24: mol_type = other RNA
atcagccccatcttcggcagcgtg

SEQ ID NO: 37382 - RNA, 24 nt, synthetic construct
  misc_feature 1..24: note = derived and/or modified sequence opt4 from anti-influenza_CDR
  source 1..24: mol_type = other RNA
agcagcaacatcggccacaacttc

SEQ ID NO: 37383 - RNA, 24 nt, synthetic construct
  misc_feature 1..24: note = derived and/or modified sequence opt4 from anti-influenza_CDR
  source 1..24: mol_type = other RNA
ggcacctgggacagcagcctgagc

SEQ ID NO: 37384 - RNA, 24 nt, synthetic construct
  misc_feature 1..24: note = derived and/or modified sequence opt4 from anti-influenza_CDR
  source 1..24: mol_type = other RNA
ggcggcatcatcagaaagtacgcc

SEQ ID NO: 37385 - RNA, 24 nt, synthetic construct
  misc_feature 1..24: note = derived and/or modified sequence opt4 from anti-influenza_CDR
  source 1..24: mol_type = other RNA
atcatcgccatcttcaacaccgcc

SEQ ID NO: 37386 - RNA, 24 nt, synthetic construct
  misc_feature 1..24: note = derived and/or modified sequence opt4 from anti-influenza_CDR
  source 1..24: mol_type = other RNA
ggctacaccttcaccgcctacacc

SEQ ID NO: 37387 - RNA, 24 nt, synthetic construct
  misc_feature 1..24: note = derived and/or modified sequence opt4 from anti-influenza_CDR
  source 1..24: mol_type = other RNA
atcaacgccggcaacggccacacc

SEQ ID NO: 37388 - RNA, 24 nt, synthetic construct
  misc_feature 1..24: note = derived and/or modified sequence opt4 from anti-influenza_CDR
  source 1..24: mol_type = other RNA
ggcggcaccttcatcaactacgcc

SEQ ID NO: 37389 - RNA, 24 nt, synthetic construct
  misc_feature 1..24: note = derived and/or modified sequence opt4 from anti-influenza_CDR
  source 1..24: mol_type = other RNA
atcatccccgtgtacggcaccagc

SEQ ID NO: 37390 - RNA, 24 nt, synthetic construct
  misc_feature 1..24: note = derived and/or modified sequence opt4 from anti-influenza_CDR
  source 1..24: mol_type = other RNA
ggcttcaccttcagaagccacgcc

SEQ ID NO: 37391 - RNA, 24 nt, synthetic construct
  misc_feature 1..24: note = derived and/or modified sequence opt4 from anti-influenza_CDR
  source 1..24: mol_type = other RNA
atcagctacgacgaggtgaacaag

SEQ ID NO: 37392 - RNA, 24 nt, synthetic construct
  misc_feature 1..24: note = derived and/or modified sequence opt4 from anti-influenza_CDR
  source 1..24: mol_type = other RNA
ggctacaacttcgccgcctactac

SEQ ID NO: 37393 - RNA, 24 nt, synthetic construct
  misc_feature 1..24: note = derived and/or modified sequence opt4 from anti-influenza_CDR
  source 1..24: mol_type = other RNA
agcaaccccaacaccggcggcgcc

SEQ ID NO: 37394 - RNA, 24 nt, synthetic construct
  misc_feature 1..24: note = derived and/or modified sequence opt4 from anti-influenza_CDR
  source 1..24: mol_type = other RNA
ggctacaccctgatcgactactac

SEQ ID NO: 37395 - RNA, 24 nt, synthetic construct
  misc_feature 1..24: note = derived and/or modified sequence opt4 from anti-influenza_CDR
  source 1..24: mol_type = other RNA
atcaaccccatcaacggcggcacc

SEQ ID NO: 37396 - RNA, 24 nt, synthetic construct
  misc_feature 1..24: note = derived and/or modified sequence opt4 from anti-influenza_CDR
  source 1..24: mol_type = other RNA
ggcttcaccttcagcgcctacgcc

SEQ ID NO: 37397 - RNA, 24 nt, synthetic construct
  misc_feature 1..24: note = derived and/or modified sequence opt4 from anti-influenza_CDR
  source 1..24: mol_type = other RNA
accagctacgacggcagagacagc

SEQ ID NO: 37398 - RNA, 24 nt, synthetic construct
  misc_feature 1..24: note = derived and/or modified sequence opt4 from anti-influenza_CDR
  source 1..24: mol_type = other RNA
ggcttcaccttcaccaactacgcc

SEQ ID NO: 37399 - RNA, 24 nt, synthetic construct
  misc_feature 1..24: note = derived and/or modified sequence opt4 from anti-influenza_CDR
  source 1..24: mol_type = other RNA
atcagcttcgacgaggacaacaag

SEQ ID NO: 37400 - RNA, 24 nt, synthetic construct
  misc_feature 1..24: note = derived and/or modified sequence opt4 from anti-influenza_CDR
  source 1..24: mol_type = other RNA
ggcttcaacttcagcagctacggc

SEQ ID NO: 37401 - RNA, 24 nt, synthetic construct
  misc_feature 1..24: note = derived and/or modified sequence opt4 from anti-influenza_CDR
  source 1..24: mol_type = other RNA
atctggagcggcggcagcaacaag

SEQ ID NO: 37402 - RNA, 24 nt, synthetic construct
  misc_feature 1..24: note = derived and/or modified sequence opt4 from anti-influenza_CDR
  source 1..24: mol_type = other RNA
ggcttcatcttcggcgacttcgcc

SEQ ID NO: 37403 - RNA, 24 nt, synthetic construct
  misc_feature 1..24: note = derived and/or modified sequence opt4 from anti-influenza_CDR
  source 1..24: mol_type = other RNA
ggcttcaacttcgacgagtacgtg

SEQ ID NO: 37404 - RNA, 24 nt, synthetic construct
  misc_feature 1..24: note = derived and/or modified sequence opt4 from anti-influenza_CDR
  source 1..24: mol_type = other RNA
atcggcgccgacggcagaggcacc

SEQ ID NO: 37405 - RNA, 24 nt, synthetic construct
  misc_feature 1..24: note = derived and/or modified sequence opt4 from anti-influenza_CDR
  source 1..24: mol_type = other RNA
ggcggcagcgtgagcaactactac

SEQ ID NO: 37406 - RNA, 24 nt, synthetic construct
  misc_feature 1..24: note = derived and/or modified sequence opt4 from anti-influenza_CDR
  source 1..24: mol_type = other RNA
ggcggcaccttcagctactacgcc

SEQ ID NO: 37407 - RNA, 24 nt, synthetic construct
  misc_feature 1..24: note = derived and/or modified sequence opt4 from anti-influenza_CDR
  source 1..24: mol_type = other RNA
atcatccccatcgtgggcaccgcc

SEQ ID NO: 37408 - RNA, 24 nt, synthetic construct
  misc_feature 1..24: note = derived and/or modified sequence opt4 from anti-influenza_CDR
  source 1..24: mol_type = other RNA
accagcaacatcggcagcaacacc

SEQ ID NO: 37409 - RNA, 24 nt, synthetic construct
  misc_feature 1..24: note = derived and/or modified sequence opt4 from anti-influenza_CDR
  source 1..24: mol_type = other RNA
ggctacaacttccccaagtactgg

SEQ ID NO: 37410 - RNA, 24 nt, synthetic construct
  misc_feature 1..24: note = derived and/or modified sequence opt4 from anti-influenza_CDR
  source 1..24: mol_type = other RNA
atctaccccggcgacagcgacgtg

SEQ ID NO: 37411 - RNA, 24 nt, synthetic construct
  misc_feature 1..24: note = derived and/or modified sequence opt4 from anti-influenza_CDR
  source 1..24: mol_type = other RNA
ggccacaccttcatcagctacgcc

SEQ ID NO: 37412 - RNA, 24 nt, synthetic construct
  misc_feature 1..24: note = derived and/or modified sequence opt4 from anti-influenza_CDR
  source 1..24: mol_type = other RNA
atcgtgcccatcttcggcaccgtg

SEQ ID NO: 37413 - RNA, 24 nt, synthetic construct
  misc_feature 1..24: note = derived and/or modified sequence opt4 from anti-influenza_CDR
  source 1..24: mol_type = other RNA
ggcttcaccttcagaacctacggc

SEQ ID NO: 37414 - RNA, 24 nt, synthetic construct
  misc_feature 1..24: note = derived and/or modified sequence opt4 from anti-influenza_CDR
  source 1..24: mol_type = other RNA
atcagctacgacggcaccaacaag

SEQ ID NO: 37415 - RNA, 24 nt, synthetic construct
  misc_feature 1..24: note = derived and/or modified sequence opt4 from anti-influenza_CDR
  source 1..24: mol_type = other RNA
ggcttcaccttcagcagctacggc

SEQ ID NO: 37416 - RNA, 24 nt, synthetic construct
  misc_feature 1..24: note = derived and/or modified sequence opt4 from anti-influenza_CDR
  source 1..24: mol_type = other RNA
atcagctacgacgagatcaacaag

SEQ ID NO: 37417 - RNA, 24 nt, synthetic construct
  misc_feature 1..24: note = derived and/or modified sequence opt4 from anti-influenza_CDR
  source 1..24: mol_type = other RNA
ggcttcagcctgtggaccagcggc

SEQ ID NO: 37418 - RNA, 24 nt, synthetic construct
  misc_feature 1..24: note = derived and/or modified sequence opt4 from anti-influenza_CDR
  source 1..24: mol_type = other RNA
atgagctacgacgagaccaagaag

SEQ ID NO: 37419 - RNA, 24 nt, synthetic construct
  misc_feature 1..24: note = derived and/or modified sequence opt4 from anti-influenza_CDR
  source 1..24: mol_type = other RNA
ggcttcaccttcagcagatacagc

SEQ ID NO: 37420 - RNA, 24 nt, synthetic construct
  misc_feature 1..24: note = derived and/or modified sequence opt4 from anti-influenza_CDR
  source 1..24: mol_type = other RNA
atcagcgacaccagcagaaccatc

SEQ ID NO: 37421 - RNA, 24 nt, synthetic construct
  misc_feature 1..24: note = derived and/or modified sequence opt4 from anti-influenza_CDR
  source 1..24: mol_type = other RNA
ggcttcaccttcaacagctacgcc

SEQ ID NO: 37422 - RNA, 24 nt, synthetic construct
  misc_feature 1..24: note = derived and/or modified sequence opt4 from anti-influenza_CDR
  source 1..24: mol_type = other RNA
atcagaggcagcggcgagaacacc

SEQ ID NO: 37423 - RNA, 24 nt, synthetic construct
  misc_feature 1..24: note = derived and/or modified sequence opt4 from anti-influenza_CDR
  source 1..24: mol_type = other RNA
ggcttcaccttcagcagattcagc

SEQ ID NO: 37424 - RNA, 24 nt, synthetic construct
  misc_feature 1..24: note = derived and/or modified sequence opt4 from anti-influenza_CDR
  source 1..24: mol_type = other RNA
atcagcgacaccggcagaaccatc

SEQ ID NO: 37425 - RNA, 24 nt, synthetic construct
  misc_feature 1..24: note = derived and/or modified sequence opt4 from anti-influenza_CDR
  source 1..24: mol_type = other RNA
ggcgacagcttcaccagctactgg

SEQ ID NO: 37426 - RNA, 24 nt, synthetic construct
  misc_feature 1..24: note = derived and/or modified sequence opt4 from anti-influenza_CDR
  source 1..24: mol_type = other RNA
atctaccccagagacagcgagacc

SEQ ID NO: 37427 - RNA, 24 nt, synthetic construct
  misc_feature 1..24: note = derived and/or modified sequence opt4 from anti-influenza_CDR
  source 1..24: mol_type = other RNA
ggctacaccttcaccgcctaccac

SEQ ID NO: 37428 - RNA, 24 nt, synthetic construct
  misc_feature 1..24: note = derived and/or modified sequence opt4 from anti-influenza_CDR
  source 1..24: mol_type = other RNA
atcaaccccaacagcggcgccacc

SEQ ID NO: 37429 - RNA, 24 nt, synthetic construct
  misc_feature 1..24: note = derived and/or modified sequence opt4 from anti-influenza_CDR
  source 1..24: mol_type = other RNA
ggcttcaccttcagcgactactgg

SEQ ID NO: 37430 - RNA, 24 nt, synthetic construct
  misc_feature 1..24: note = derived and/or modified sequence opt4 from anti-influenza_CDR
  source 1..24: mol_type = other RNA
atcagcagcgacggcagcaccacc

SEQ ID NO: 37431 - RNA, 24 nt, synthetic construct
  misc_feature 1..24: note = derived and/or modified sequence opt4 from anti-influenza_CDR
  source 1..24: mol_type = other RNA
ggcttcagcttcagcaacgcctgg

SEQ ID NO: 37432 - RNA, 24 nt, synthetic construct
  misc_feature 1..24: note = derived and/or modified sequence opt4 from anti-influenza_CDR
  source 1..24: mol_type = other RNA
ggcctgaccttcagcaacgcctgg

SEQ ID NO: 37433 - RNA, 24 nt, synthetic construct
  misc_feature 1..24: note = derived and/or modified sequence opt4 from anti-influenza_CDR
  source 1..24: mol_type = other RNA
ggcttcaccttcagcaacgcctgg

SEQ ID NO: 37434 - RNA, 24 nt, synthetic construct
  misc_feature 1..24: note = derived and/or modified sequence opt4 from anti-influenza_CDR
  source 1..24: mol_type = other RNA
ggcctgagcttcctgaacgcctgg

SEQ ID NO: 37435 - RNA, 24 nt, synthetic construct
  misc_feature 1..24: note = derived and/or modified sequence opt4 from anti-influenza_CDR
  source 1..24: mol_type = other RNA
ggcttcagcttcctgaacgcctgg

SEQ ID NO: 37436 - RNA, 24 nt, synthetic construct
  misc_feature 1..24: note = derived and/or modified sequence opt4 from anti-influenza_CDR
  source 1..24: mol_type = other RNA
ggcctgaccttcctgaacgcctgg

SEQ ID NO: 37437 - RNA, 24 nt, synthetic construct
  misc_feature 1..24: note = derived and/or modified sequence opt4 from anti-influenza_CDR
  source 1..24: mol_type = other RNA
ggcttcaccttcctgaacgcctgg

SEQ ID NO: 37438 - RNA, 24 nt, synthetic construct
  misc_feature 1..24: note = derived and/or modified sequence opt4 from anti-influenza_CDR
  source 1..24: mol_type = other RNA
ggctacaccttcaccgactactac

SEQ ID NO: 37439 - RNA, 24 nt, synthetic construct
  misc_feature 1..24: note = derived and/or modified sequence opt4 from anti-influenza_CDR
  source 1..24: mol_type = other RNA
gtgaacccctacagcggcggcacc

SEQ ID NO: 37440 - RNA, 24 nt, synthetic construct
  misc_feature 1..24: note = derived and/or modified sequence opt4 from anti-influenza_CDR
  source 1..24: mol_type = other RNA
ggctacaccttcaccgactacaac

SEQ ID NO: 37441 - RNA, 24 nt, synthetic construct
  misc_feature 1..24: note = derived and/or modified sequence opt4 from anti-influenza_CDR
  source 1..24: mol_type = other RNA
atctaccccaacaacggcggcacc

SEQ ID NO: 37442 - RNA, 24 nt, synthetic construct
  misc_feature 1..24: note = derived and/or modified sequence opt4 from anti-influenza_CDR
  source 1..24: mol_type = other RNA
ggctacaccttcaccggctacaac

SEQ ID NO: 37443 - RNA, 24 nt, synthetic construct
  misc_feature 1..24: note = derived and/or modified sequence opt4 from anti-influenza_CDR
  source 1..24: mol_type = other RNA
atctaccccaacaacggcgtgacc

SEQ ID NO: 37444 - RNA, 24 nt, synthetic construct
  misc_feature 1..24: note = derived and/or modified sequence opt4 from anti-influenza_CDR
  source 1..24: mol_type = other RNA
atggagaccgacaccctgctgctg

SEQ ID NO: 37445 - RNA, 27 nt, synthetic construct
  misc_feature 1..27: note = derived and/or modified sequence opt4 from anti-influenza_CDR
  source 1..27: mol_type = other RNA
gacggcgtgaccaacaaggtgaacagc

SEQ ID NO: 37446 - RNA, 27 nt, synthetic construct
  misc_feature 1..27: note = derived and/or modified sequence opt4 from anti-influenza_CDR
  source 1..27: mol_type = other RNA
ggcagcgacgtgggcagcagcaacctg

SEQ ID NO: 37447 - RNA, 27 nt, synthetic construct
  misc_feature 1..27: note = derived and/or modified sequence opt4 from anti-influenza_CDR
  source 1..27: mol_type = other RNA
atgcagaacatcctgctgcccctgacc

SEQ ID NO: 37448 - RNA, 27 nt, synthetic construct
  misc_feature 1..27: note = derived and/or modified sequence opt4 from anti-influenza_CDR
  source 1..27: mol_type = other RNA
atgcagagcctgcagctgcccctgacc

SEQ ID NO: 37449 - RNA, 27 nt, synthetic construct
  misc_feature 1..27: note = derived and/or modified sequence opt4 from anti-influenza_CDR
  source 1..27: mol_type = other RNA
cagcagcactacagaaccccccccacc

SEQ ID NO: 37450 - RNA, 27 nt, synthetic construct
  misc_feature 1..27: note = derived and/or modified sequence opt4 from anti-influenza_CDR
  source 1..27: mol_type = other RNA
cagcagtacggcaacagcccctacacc

SEQ ID NO: 37451 - RNA, 27 nt, synthetic construct
  misc_feature 1..27: note = derived and/or modified sequence opt4 from anti-influenza_CDR
  source 1..27: mol_type = other RNA
cagcagtacggcagcagcccctacacc

SEQ ID NO: 37452 - RNA, 27 nt, synthetic construct
  misc_feature 1..27: note = derived and/or modified sequence opt4 from anti-influenza_CDR
  source 1..27: mol_type = other RNA
cagcagtacggcaccagcccccagacc

SEQ ID NO: 37453 - RNA, 27 nt, synthetic construct
  misc_feature 1..27: note = derived and/or modified sequence opt4 from anti-influenza_CDR
  source 1..27: mol_type = other RNA
cagcagtacggctacctgcccctgacc

SEQ ID NO: 37454 - RNA, 27 nt, synthetic construct
  misc_feature 1..27: note = derived and/or modified sequence opt4 from anti-influenza_CDR
  source 1..27: mol_type = other RNA
caggcctgggacagcagcaccgccgtg

SEQ ID NO: 37455 - RNA, 27 nt, synthetic construct
  misc_feature 1..27: note = derived and/or modified sequence opt4 from anti-influenza_CDR
  source 1..27: mol_type = other RNA
cagcactacaacgcctactggggcacc

SEQ ID NO: 37456 - RNA, 27 nt, synthetic construct
  misc_feature 1..27: note = derived and/or modified sequence opt4 from anti-influenza_CDR
  source 1..27: mol_type = other RNA
cagcagacctacagcagcccccccacc

SEQ ID NO: 37457 - RNA, 27 nt, synthetic construct
  misc_feature 1..27: note = derived and/or modified sequence opt4 from anti-influenza_CDR
  source 1..27: mol_type = other RNA
cagcagtactacagcttcccctacacc

SEQ ID NO: 37458 - RNA, 27 nt, synthetic construct
  misc_feature 1..27: note = derived and/or modified sequence opt4 from anti-influenza_CDR
  source 1..27: mol_type = other RNA
atgcaggccctgcagctgcccctggcc

SEQ ID NO: 37459 - RNA, 27 nt, synthetic construct
  misc_feature 1..27: note = derived and/or modified sequence opt4 from anti-influenza_CDR
  source 1..27: mol_type = other RNA
cagcaggccaacagcttccccttcacc

SEQ ID NO: 37460 - RNA, 27 nt, synthetic construct
  misc_feature 1..27: note = derived and/or modified sequence opt4 from anti-influenza_CDR
  source 1..27: mol_type = other RNA
cagcagctgaacggctaccccctgacc

SEQ ID NO: 37461 - RNA, 27 nt, synthetic construct
  misc_feature 1..27: note = derived and/or modified sequence opt4 from anti-influenza_CDR
  source 1..27: mol_type = other RNA
atgcaggccctgcagacccccctgacc

SEQ ID NO: 37462 - RNA, 27 nt, synthetic construct
  misc_feature 1..27: note = derived and/or modified sequence opt4 from anti-influenza_CDR
  source 1..27: mol_type = other RNA
cagcagaactacaactggcccctgacc

SEQ ID NO: 37463 - RNA, 27 nt, synthetic construct
  misc_feature 1..27: note = derived and/or modified sequence opt4 from anti-influenza_CDR
  source 1..27: mol_type = other RNA
cagcagtacgacaccagcagcggcctg

SEQ ID NO: 37464 - RNA, 27 nt, synthetic construct
  misc_feature 1..27: note = derived and/or modified sequence opt4 from anti-influenza_CDR
  source 1..27: mol_type = other RNA
cagcagtacaacagctggcccagaacc

SEQ ID NO: 37465 - RNA, 27 nt, synthetic construct
  misc_feature 1..27: note = derived and/or modified sequence opt4 from anti-influenza_CDR
  source 1..27: mol_type = other RNA
gtgatctacagccacggcagagcctac

SEQ ID NO: 37466 - RNA, 27 nt, synthetic construct
  misc_feature 1..27: note = derived and/or modified sequence opt4 from anti-influenza_CDR
  source 1..27: mol_type = other RNA
cagcagtacggcgacagcagatacacc

SEQ ID NO: 37467 - RNA, 27 nt, synthetic construct
  misc_feature 1..27: note = derived and/or modified sequence opt4 from anti-influenza_CDR
  source 1..27: mol_type = other RNA
ctgcagcacaacagctacccctacacc

SEQ ID NO: 37468 - RNA, 27 nt, synthetic construct
  misc_feature 1..27: note = derived and/or modified sequence opt4 from anti-influenza_CDR
  source 1..27: mol_type = other RNA
agaaagatgaccaccgccttcgacagc

SEQ ID NO: 37469 - RNA, 27 nt, synthetic construct
  misc_feature 1..27: note = derived and/or modified sequence opt4 from anti-influenza_CDR
  source 1..27: mol_type = other RNA
cagagaaaccacagccccagctggacc

SEQ ID NO: 37470 - RNA, 27 nt, synthetic construct
  misc_feature 1..27: note = derived and/or modified sequence opt4 from anti-influenza_CDR
  source 1..27: mol_type = other RNA
cagcagagctacgacaacccccagacc

SEQ ID NO: 37471 - RNA, 27 nt, synthetic construct
  misc_feature 1..27: note = derived and/or modified sequence opt4 from anti-influenza_CDR
  source 1..27: mol_type = other RNA
cagcagagcagaagactgccctacacc

SEQ ID NO: 37472 - RNA, 27 nt, synthetic construct
  misc_feature 1..27: note = derived and/or modified sequence opt4 from anti-influenza_CDR
  source 1..27: mol_type = other RNA
agaaagatgaccaccgccatcgactac

SEQ ID NO: 37473 - RNA, 27 nt, synthetic construct
  misc_feature 1..27: note = derived and/or modified sequence opt4 from anti-influenza_CDR
  source 1..27: mol_type = other RNA
atcagatacaccggccagcagctgctg

SEQ ID NO: 37474 - RNA, 27 nt, synthetic construct
  misc_feature 1..27: note = derived and/or modified sequence opt4 from anti-influenza_CDR
  source 1..27: mol_type = other RNA
cagcactacggcaccatcagccagacc

SEQ ID NO: 37475 - RNA, 27 nt, synthetic construct
  misc_feature 1..27: note = derived and/or modified sequence opt4 from anti-influenza_CDR
  source 1..27: mol_type = other RNA
cagcagtacagcaccagcccccccacc

SEQ ID NO: 37476 - RNA, 27 nt, synthetic construct
  misc_feature 1..27: note = derived and/or modified sequence opt4 from anti-influenza_CDR
  source 1..27: mol_type = other RNA
cagcagtacggcaacagccccatcacc

SEQ ID NO: 37477 - RNA, 27 nt, synthetic construct
  misc_feature 1..27: note = derived and/or modified sequence opt4 from anti-influenza_CDR
  source 1..27: mol_type = other RNA
cagcagtactacagcagaccctacacc

SEQ ID NO: 37478 - RNA, 27 nt, synthetic construct
  misc_feature 1..27: note = derived and/or modified sequence opt4 from anti-influenza_CDR
  source 1..27: mol_type = other RNA
caggtgtgggacaacttcggcggcgtg

SEQ ID NO: 37479 - RNA, 27 nt, synthetic construct
  misc_feature 1..27: note = derived and/or modified sequence opt4 from anti-influenza_CDR
  source 1..27: mol_type = other RNA
cagcagagctacagcagccccctgacc

SEQ ID NO: 37480 - RNA, 27 nt, synthetic construct
  misc_feature 1..27: note = derived and/or modified sequence opt4 from anti-influenza_CDR
  source 1..27: mol_type = other RNA
cagcagtacttcgccacccccagaacc

SEQ ID NO: 37481 - RNA, 27 nt, synthetic construct
  misc_feature 1..27: note = derived and/or modified sequence opt4 from anti-influenza_CDR
  source 1..27: mol_type = other RNA
cagcagtactacttcagccccctgacc

SEQ ID NO: 37482 - RNA, 27 nt, synthetic construct
  misc_feature 1..27: note = derived and/or modified sequence opt4 from anti-influenza_CDR
  source 1..27: mol_type = other RNA
cagcacttcggcaccagcgtgttcacc

SEQ ID NO: 37483 - RNA, 27 nt, synthetic construct
  misc_feature 1..27: note = derived and/or modified sequence opt4 from anti-influenza_CDR
  source 1..27: mol_type = other RNA
cagcagtactacaacgcccccctgacc

SEQ ID NO: 37484 - RNA, 27 nt, synthetic construct
  misc_feature 1..27: note = derived and/or modified sequence opt4 from anti-influenza_CDR
  source 1..27: mol_type = other RNA
gtgctgttcaccagccccttcgacttc

SEQ ID NO: 37485 - RNA, 27 nt, synthetic construct
  misc_feature 1..27: note = derived and/or modified sequence opt4 from anti-influenza_CDR
  source 1..27: mol_type = other RNA
ctgctgagctacagcggcgtgtgggtg

SEQ ID NO: 37486 - RNA, 27 nt, synthetic construct
  misc_feature 1..27: note = derived and/or modified sequence opt4 from anti-influenza_CDR
  source 1..27: mol_type = other RNA
ttcctgagctacagcggcgcctgggtg

SEQ ID NO: 37487 - RNA, 27 nt, synthetic construct
  misc_feature 1..27: note = derived and/or modified sequence opt4 from anti-influenza_CDR
  source 1..27: mol_type = other RNA
cagcagagcttcagcaagagctggacc

SEQ ID NO: 37488 - RNA, 27 nt, synthetic construct
  misc_feature 1..27: note = derived and/or modified sequence opt4 from anti-influenza_CDR
  source 1..27: mol_type = other RNA
gtgcagtacgtgcagttcccctggacc

SEQ ID NO: 37489 - RNA, 27 nt, synthetic construct
  misc_feature 1..27: note = derived and/or modified sequence opt4 from anti-influenza_CDR
  source 1..27: mol_type = other RNA
cagcagagctacagcccccccctgacc

SEQ ID NO: 37490 - RNA, 27 nt, synthetic construct
  misc_feature 1..27: note = derived and/or modified sequence opt4 from anti-influenza_CDR
  source 1..27: mol_type = other RNA
ttcatctactacggcggcaacaccaag

SEQ ID NO: 37491 - RNA, 27 nt, synthetic construct
  misc_feature 1..27: note = derived and/or modified sequence opt4 from anti-influenza_CDR
  source 1..27: mol_type = other RNA
gtgatctacagcggcggcagcacctac

SEQ ID NO: 37492 - RNA, 27 nt, synthetic construct
  misc_feature 1..27: note = derived and/or modified sequence opt4 from anti-influenza_CDR
  source 1..27: mol_type = other RNA
ttcatgttccacagcggcagccccaga

SEQ ID NO: 37493 - RNA, 27 nt, synthetic construct
  misc_feature 1..27: note = derived and/or modified sequence opt4 from anti-influenza_CDR
  source 1..27: mol_type = other RNA
cagcagacctacagcacccccatcacc

SEQ ID NO: 37494 - RNA, 27 nt, synthetic construct
  misc_feature 1..27: note = derived and/or modified sequence opt4 from anti-influenza_CDR
  source 1..27: mol_type = other RNA
ttcttctacaacggcggcagcaccaag

SEQ ID NO: 37495 - RNA, 27 nt, synthetic construct
  misc_feature 1..27: note = derived and/or modified sequence opt4 from anti-influenza_CDR
  source 1..27: mol_type = other RNA
cagcagagctacaacacccccctgatc

SEQ ID NO: 37496 - RNA, 27 nt, synthetic construct
  misc_feature 1..27: note = derived and/or modified sequence opt4 from anti-influenza_CDR
  source 1..27: mol_type = other RNA
cacatctacgactacggcagaaccttc

SEQ ID NO: 37497 - RNA, 27 nt, synthetic construct
  misc_feature 1..27: note = derived and/or modified sequence opt4 from anti-influenza_CDR
  source 1..27: mol_type = other RNA
gtgttctacagcgagaccagaacctac

SEQ ID NO: 37498 - RNA, 27 nt, synthetic construct
  misc_feature 1..27: note = derived and/or modified sequence opt4 from anti-influenza_CDR
  source 1..27: mol_type = other RNA
caggtgtggggcagcagcagcgaccac

SEQ ID NO: 37499 - RNA, 27 nt, synthetic construct
  misc_feature 1..27: note = derived and/or modified sequence opt4 from anti-influenza_CDR
  source 1..27: mol_type = other RNA
tacgtgtacaacagaggcagcaccaag

SEQ ID NO: 37500 - RNA, 27 nt, synthetic construct
  misc_feature 1..27: note = derived and/or modified sequence opt4 from anti-influenza_CDR
  source 1..27: mol_type = other RNA
tacatctacaacagaggcagcaccaag

SEQ ID NO: 37501 - RNA, 27 nt, synthetic construct
  misc_feature 1..27: note = derived and/or modified sequence opt4 from anti-influenza_CDR
  source 1..27: mol_type = other RNA
cagcagagctacaacacccccatcacc

SEQ ID NO: 37502 - RNA, 27 nt, synthetic construct
  misc_feature 1..27: note = derived and/or modified sequence opt4 from anti-influenza_CDR
  source 1..27: mol_type = other RNA
cagcagtactacagcagcccccccacc

SEQ ID NO: 37503 - RNA, 27 nt, synthetic construct
  misc_feature 1..27: note = derived and/or modified sequence opt4 from anti-influenza_CDR
  source 1..27: mol_type = other RNA
tacctgtactacagcggcagcaccaag

SEQ ID NO: 37504 - RNA, 27 nt, synthetic construct
  misc_feature 1..27: note = derived and/or modified sequence opt4 from anti-influenza_CDR
  source 1..27: mol_type = other RNA
cagcagagctacagcccccccatcacc

SEQ ID NO: 37505 - RNA, 27 nt, synthetic construct
  misc_feature 1..27: note = derived and/or modified sequence opt4 from anti-influenza_CDR
  source 1..27: mol_type = other RNA
tacgtgtacaacagcggcaacaccaag

SEQ ID NO: 37506 - RNA, 27 nt, synthetic construct
  misc_feature 1..27: note = derived and/or modified sequence opt4 from anti-influenza_CDR
  source 1..27: mol_type = other RNA
cagcagagctacaacacccccctgacc

SEQ ID NO: 37507 - RNA, 27 nt, synthetic construct
  misc_feature 1..27: note = derived and/or modified sequence opt4 from anti-influenza_CDR
  source 1..27: mol_type = other RNA
cacatcttcgacagcggcagcacctac

SEQ ID NO: 37508 - RNA, 27 nt, synthetic construct
  misc_feature 1..27: note = derived and/or modified sequence opt4 from anti-influenza_CDR
  source 1..27: mol_type = other RNA
gtgttctacagcgccgacagaaccagc

SEQ ID NO: 37509 - RNA, 27 nt, synthetic construct
  misc_feature 1..27: note = derived and/or modified sequence opt4 from anti-influenza_CDR
  source 1..27: mol_type = other RNA
cagcagtactacagcacccccctgacc

SEQ ID NO: 37510 - RNA, 27 nt, synthetic construct
  misc_feature 1..27: note = derived and/or modified sequence opt4 from anti-influenza_CDR
  source 1..27: mol_type = other RNA
tacatctactacagcggcaacacctac

SEQ ID NO: 37511 - RNA, 27 nt, synthetic construct
  misc_feature 1..27: note = derived and/or modified sequence opt4 from anti-influenza_CDR
  source 1..27: mol_type = other RNA
cagcagagctacagcacccccctgacc

SEQ ID NO: 37512 - RNA, 27 nt, synthetic construct
  misc_feature 1..27: note = derived and/or modified sequence opt4 from anti-influenza_CDR
  source 1..27: mol_type = other RNA
cagcagtacggcagcagcagcctgacc

SEQ ID NO: 37513 - RNA, 27 nt, synthetic construct
  misc_feature 1..27: note = derived and/or modified sequence opt4 from anti-influenza_CDR
  source 1..27: mol_type = other RNA
agcagctacaccagcagcagcacctac

SEQ ID NO: 37514 - RNA, 27 nt, synthetic construct
  misc_feature 1..27: note = derived and/or modified sequence opt4 from anti-influenza_CDR
  source 1..27: mol_type = other RNA
cagagatacaacagcgccccccccatc

SEQ ID NO: 37515 - RNA, 27 nt, synthetic construct
  misc_feature 1..27: note = derived and/or modified sequence opt4 from anti-influenza_CDR
  source 1..27: mol_type = other RNA
cagcagtacggcagaacccccctgacc

SEQ ID NO: 37516 - RNA, 27 nt, synthetic construct
  misc_feature 1..27: note = derived and/or modified sequence opt4 from anti-influenza_CDR
  source 1..27: mol_type = other RNA
cagcagtacggcagcagccccagaacc

SEQ ID NO: 37517 - RNA, 27 nt, synthetic construct
  misc_feature 1..27: note = derived and/or modified sequence opt4 from anti-influenza_CDR
  source 1..27: mol_type = other RNA
cagcagtacggcagcagccccctgacc

SEQ ID NO: 37518 - RNA, 27 nt, synthetic construct
  misc_feature 1..27: note = derived and/or modified sequence opt4 from anti-influenza_CDR
  source 1..27: mol_type = other RNA
caggtgtgggacagcagcagcgaccac

SEQ ID NO: 37519 - RNA, 27 nt, synthetic construct
  misc_feature 1..27: note = derived and/or modified sequence opt4 from anti-influenza_CDR
  source 1..27: mol_type = other RNA
aaggagttcagcgaggtggagggcaga

SEQ ID NO: 37520 - RNA, 27 nt, synthetic construct
  misc_feature 1..27: note = derived and/or modified sequence opt4 from anti-influenza_CDR
  source 1..27: mol_type = other RNA
aaggagttcaacaacctggagaagaga

SEQ ID NO: 37521 - RNA, 27 nt, synthetic construct
  misc_feature 1..27: note = derived and/or modified sequence opt4 from anti-influenza_CDR
  source 1..27: mol_type = other RNA
cagcagcactacagaaccccccccagc

SEQ ID NO: 37522 - RNA, 27 nt, synthetic construct
  misc_feature 1..27: note = derived and/or modified sequence opt4 from anti-influenza_CDR
  source 1..27: mol_type = other RNA
atgcaggccacccactggcccctgacc

SEQ ID NO: 37523 - RNA, 27 nt, synthetic construct
  misc_feature 1..27: note = derived and/or modified sequence opt4 from anti-influenza_CDR
  source 1..27: mol_type = other RNA
cagcagtactacagctacccctacacc

SEQ ID NO: 37524 - RNA, 27 nt, synthetic construct
  misc_feature 1..27: note = derived and/or modified sequence opt4 from anti-influenza_CDR
  source 1..27: mol_type = other RNA
agcagcgacgtgggcggctacaactac

SEQ ID NO: 37525 - RNA, 27 nt, synthetic construct
  misc_feature 1..27: note = derived and/or modified sequence opt4 from anti-influenza_CDR
  source 1..27: mol_type = other RNA
agcagcgacgtgggcgactacaactac

SEQ ID NO: 37526 - RNA, 27 nt, synthetic construct
  misc_feature 1..27: note = derived and/or modified sequence opt4 from anti-influenza_CDR
  source 1..27: mol_type = other RNA
cagcagtacaacaactggcccctgagc

SEQ ID NO: 37527 - RNA, 27 nt, synthetic construct
  misc_feature 1..27: note = derived and/or modified sequence opt4 from anti-influenza_CDR
  source 1..27: mol_type = other RNA
cagcagagctacaactaccccagaacc

SEQ ID NO: 37528 - RNA, 27 nt, synthetic construct
  misc_feature 1..27: note = derived and/or modified sequence opt4 from anti-influenza_CDR
  source 1..27: mol_type = other RNA
atgcagggcctgcagaccccctacacc

SEQ ID NO: 37529 - RNA, 27 nt, synthetic construct
  misc_feature 1..27: note = derived and/or modified sequence opt4 from anti-influenza_CDR
  source 1..27: mol_type = other RNA
cagcagcactacagcatccccctgacc

SEQ ID NO: 37530 - RNA, 27 nt, synthetic construct
  misc_feature 1..27: note = derived and/or modified sequence opt4 from anti-influenza_CDR
  source 1..27: mol_type = other RNA
ctgcagcacaacagctacccctggacc

SEQ ID NO: 37531 - RNA, 27 nt, synthetic construct
  misc_feature 1..27: note = derived and/or modified sequence opt4 from anti-influenza_CDR
  source 1..27: mol_type = other RNA
cagcagtacaacacctggcccctgacc

SEQ ID NO: 37532 - RNA, 27 nt, synthetic construct
  misc_feature 1..27: note = derived and/or modified sequence opt4 from anti-influenza_CDR
  source 1..27: mol_type = other RNA
cagcagtacaacagcttcccctacaga

SEQ ID NO: 37533 - RNA, 27 nt, synthetic construct
  misc_feature 1..27: note = derived and/or modified sequence opt4 from anti-influenza_CDR
  source 1..27: mol_type = other RNA
cagcagagctacagcgcccccttcacc

SEQ ID NO: 37534 - RNA, 27 nt, synthetic construct
  misc_feature 1..27: note = derived and/or modified sequence opt4 from anti-influenza_CDR
  source 1..27: mol_type = other RNA
caggcctgggacagcagcaccgtggtg

SEQ ID NO: 37535 - RNA, 27 nt, synthetic construct
  misc_feature 1..27: note = derived and/or modified sequence opt4 from anti-influenza_CDR
  source 1..27: mol_type = other RNA
caggcctgggacagcaccaccgtggtg

SEQ ID NO: 37536 - RNA, 27 nt, synthetic construct
  misc_feature 1..27: note = derived and/or modified sequence opt4 from anti-influenza_CDR
  source 1..27: mol_type = other RNA
ctgcagtacggcagcagccccagaacc

SEQ ID NO: 37537 - RNA, 27 nt, synthetic construct
  misc_feature 1..27: note = derived and/or modified sequence opt4 from anti-influenza_CDR
  source 1..27: mol_type = other RNA
agcagcgacgtgggcggctacgactac

SEQ ID NO: 37538 - RNA, 27 nt, synthetic construct
  misc_feature 1..27: note = derived and/or modified sequence opt4 from anti-influenza_CDR
  source 1..27: mol_type = other RNA
cagcagtacacctactggcccctgacc

SEQ ID NO: 37539 - RNA, 27 nt, synthetic construct
  misc_feature 1..27: note = derived and/or modified sequence opt4 from anti-influenza_CDR
  source 1..27: mol_type = other RNA
cagcagtacgacaagtggccccccggc

SEQ ID NO: 37540 - RNA, 27 nt, synthetic construct
  misc_feature 1..27: note = derived and/or modified sequence opt4 from anti-influenza_CDR
  source 1..27: mol_type = other RNA
atgcagagcctgcagaccagcatcacc

SEQ ID NO: 37541 - RNA, 27 nt, synthetic construct
  misc_feature 1..27: note = derived and/or modified sequence opt4 from anti-influenza_CDR
  source 1..27: mol_type = other RNA
agccagatcgagctggccgtgctgctg

SEQ ID NO: 37542 - RNA, 27 nt, synthetic construct
  misc_feature 1..27: note = derived and/or modified sequence opt4 from anti-influenza_CDR
  source 1..27: mol_type = other RNA
atgcaggccctgcagaccccctacacc

SEQ ID NO: 37543 - RNA, 27 nt, synthetic construct
  misc_feature 1..27: note = derived and/or modified sequence opt4 from anti-influenza_CDR
  source 1..27: mol_type = other RNA
cagcagagaagccactggccccccatc

SEQ ID NO: 37544 - RNA, 27 nt, synthetic construct
  misc_feature 1..27: note = derived and/or modified sequence opt4 from anti-influenza_CDR
  source 1..27: mol_type = other RNA
cagcacttctggggcacccccctgacc

SEQ ID NO: 37545 - RNA, 27 nt, synthetic construct
  misc_feature 1..27: note = derived and/or modified sequence opt4 from anti-influenza_CDR
  source 1..27: mol_type = other RNA
cagcagaactacgaggacccctggacc

SEQ ID NO: 37546 - RNA, 27 nt, synthetic construct
  misc_feature 1..27: note = derived and/or modified sequence opt4 from anti-influenza_CDR
  source 1..27: mol_type = other RNA
cagcaggccaacagcttcccccccacc

SEQ ID NO: 37547 - RNA, 27 nt, synthetic construct
  misc_feature 1..27: note = derived and/or modified sequence opt4 from anti-influenza_CDR
  source 1..27: mol_type = other RNA
cagcagagagaccactggccccccatc

SEQ ID NO: 37548 - RNA, 27 nt, synthetic construct
  misc_feature 1..27: note = derived and/or modified sequence opt4 from anti-influenza_CDR
  source 1..27: mol_type = other RNA
atggacagcagactgaacctggtgttc

SEQ ID NO: 37549 - RNA, 27 nt, synthetic construct
  misc_feature 1..27: note = derived and/or modified sequence opt4 from anti-influenza_CDR
  source 1..27: mol_type = other RNA
atgaagctgcccgtgagactgctggtg

SEQ ID NO: 37550 - RNA, 30 nt, synthetic construct
  misc_feature 1..30: note = derived and/or modified sequence opt4 from anti-influenza_CDR
  source 1..30: mol_type = other RNA
ggcgacagcgtgaccagaggcggcttctac

SEQ ID NO: 37551 - RNA, 30 nt, synthetic construct; identical to SEQ ID NO: 14625
  misc_feature 1..30: note = derived and/or modified sequence opt4 from anti-influenza_CDR
  source 1..30: mol_type = other RNA

SEQ ID NO: 37552 - RNA, 30 nt, synthetic construct; identical to SEQ ID NO: 14626
  misc_feature 1..30: note = derived and/or modified sequence opt4 from anti-influenza_CDR
  source 1..30: mol_type = other RNA

SEQ ID NO: 37553 - RNA, 30 nt, synthetic construct
  misc_feature 1..30: note = derived and/or modified sequence opt4 from anti-influenza_CDR
  source 1..30: mol_type = other RNA
agagcccagagcctgagcagctacctgcac

SEQ ID NO: 37554 - RNA, 30 nt, synthetic construct
  misc_feature 1..30: note = derived and/or modified sequence opt4 from anti-influenza_CDR
  source 1..30: mol_type = other RNA
agcagctacaccagcagcagcacctacgtg

SEQ ID NO: 37555 - RNA, 30 nt, synthetic construct
  misc_feature 1..30: note = derived and/or modified sequence opt4 from anti-influenza_CDR
  source 1..30: mol_type = other RNA
cagagatacaacagcgccccccccatcacc

SEQ ID NO: 37556 - RNA, 30 nt, synthetic construct
  misc_feature 1..30: note = derived and/or modified sequence opt4 from anti-influenza_CDR
  source 1..30: mol_type = other RNA
ggcggcagcatcagcagcggcacctactac

SEQ ID NO: 37557 - RNA, 30 nt, synthetic construct
  misc_feature 1..30: note = derived and/or modified sequence opt4 from anti-influenza_CDR
  source 1..30: mol_type = other RNA
cagcagagctacagcagcctgatgttcacc

SEQ ID NO: 37558 - RNA, 30 nt, synthetic construct
  misc_feature 1..30: note = derived and/or modified sequence opt4 from anti-influenza_CDR
  source 1..30: mol_type = other RNA
ctgctgatctacggcgccagcaccagagcc

SEQ ID NO: 37559 - RNA, 30 nt, synthetic construct
  misc_feature 1..30: note = derived and/or modified sequence opt4 from anti-influenza_CDR
  source 1..30: mol_type = other RNA
tgcgcctacggcggcaagtacctggtggtg

SEQ ID NO: 37560 - RNA, 30 nt, synthetic construct
  misc_feature 1..30: note = derived and/or modified sequence opt4 from anti-influenza_CDR
  source 1..30: mol_type = other RNA
agacccgacttctacggcgacttcgagtac

SEQ ID NO: 37561 - RNA, 30 nt, synthetic construct
  misc_feature 1..30: note = derived and/or modified sequence opt4 from anti-influenza_CDR
  source 1..30: mol_type = other RNA
cagcactacggctacagccccagatacgcc

SEQ ID NO: 37562 - RNA, 30 nt, synthetic construct
  misc_feature 1..30: note = derived and/or modified sequence opt4 from anti-influenza_CDR
  source 1..30: mol_type = other RNA
cagcagagaagccactggccccccatcacc

SEQ ID NO: 37563 - RNA, 30 nt, synthetic construct
  misc_feature 1..30: note = derived and/or modified sequence opt4 from anti-influenza_CDR
  source 1..30: mol_type = other RNA
agcagctacgccggcagcagcacctgggtg

SEQ ID NO: 37564 - RNA, 30 nt, synthetic construct
  misc_feature 1..30: note = derived and/or modified sequence opt4 from anti-influenza_CDR
  source 1..30: mol_type = other RNA
ctgctgtacagcggcggcgaccccgtggcc

SEQ ID NO: 37565 - RNA, 30 nt, synthetic construct
  misc_feature 1..30: note = derived and/or modified sequence opt4 from anti-influenza_CDR
  source 1..30: mol_type = other RNA
cagcagtacggcggcagccccagatacacc

SEQ ID NO: 37566 - RNA, 30 nt, synthetic construct
  misc_feature 1..30: note = derived and/or modified sequence opt4 from anti-influenza_CDR
  source 1..30: mol_type = other RNA
agatacggcagcggctacggcttcgacagc

SEQ ID NO: 37567 - RNA, 30 nt, synthetic construct
  misc_feature 1..30: note = derived and/or modified sequence opt4 from anti-influenza_CDR
  source 1..30: mol_type = other RNA
agcagctacgccggcaactacaaccacgtg

SEQ ID NO: 37568 - RNA, 30 nt, synthetic construct
  misc_feature 1..30: note = derived and/or modified sequence opt4 from anti-influenza_CDR
  source 1..30: mol_type = other RNA
cagcagtacatcaactggagacccctgagc

SEQ ID NO: 37569 - RNA, 30 nt, synthetic construct
  misc_feature 1..30: note = derived and/or modified sequence opt4 from anti-influenza_CDR
  source 1..30: mol_type = other RNA
atcggcgccggctacgacgtgcactggtac

SEQ ID NO: 37570 - RNA, 30 nt, synthetic construct
  misc_feature 1..30: note = derived and/or modified sequence opt4 from anti-influenza_CDR
  source 1..30: mol_type = other RNA
ctgctgatctacgacaacaacaacagaccc

SEQ ID NO: 37571 - RNA, 30 nt, synthetic construct
  misc_feature 1..30: note = derived and/or modified sequence opt4 from anti-influenza_CDR
  source 1..30: mol_type = other RNA
cagagctacgacaacagcctgagcggcagc

SEQ ID NO: 37572 - RNA, 30 nt, synthetic construct
  misc_feature 1..30: note = derived and/or modified sequence opt4 from anti-influenza_CDR
  source 1..30: mol_type = other RNA
ctgctgatctacgacgccagcaacctgcag

SEQ ID NO: 37573 - RNA, 30 nt, synthetic construct
  misc_feature 1..30: note = derived and/or modified sequence opt4 from anti-influenza_CDR
  source 1..30: mol_type = other RNA
ctgctgatccacgacgccagcaacctggag

SEQ ID NO: 37574 - RNA, 30 nt, synthetic construct
  misc_feature 1..30: note = derived and/or modified sequence opt4 from anti-influenza_CDR
  source 1..30: mol_type = other RNA
gtgcagagactgagctacggcatggacgtg

SEQ ID NO: 37575 - RNA, 30 nt, synthetic construct
  misc_feature 1..30: note = derived and/or modified sequence opt4 from anti-influenza_CDR
  source 1..30: mol_type = other RNA
gtgcagaagagctactacggcatggacgtg

SEQ ID NO: 37576 - RNA, 30 nt, synthetic construct
  misc_feature 1..30: note = derived and/or modified sequence opt4 from anti-influenza_CDR
  source 1..30: mol_type = other RNA
agcagctacaccagcagcagcacccacgtg

SEQ ID NO: 37577 - RNA, 30 nt, synthetic construct
  misc_feature 1..30: note = derived and/or modified sequence opt4 from anti-influenza_CDR
  source 1..30: mol_type = other RNA
agcagctacaccagcagcagcaccctggtg

SEQ ID NO: 37578 - RNA, 30 nt, synthetic construct
  misc_feature 1..30: note = derived and/or modified sequence opt4 from anti-influenza_CDR
  source 1..30: mol_type = other RNA
accaagagaagccagcagaccgtgatcccc

SEQ ID NO: 37579 - RNA, 30 nt, synthetic construct
  misc_feature 1..30: note = derived and/or modified sequence opt4 from anti-influenza_CDR
  source 1..30: mol_type = other RNA
accagcagaagccagcagaccgtgatcccc

SEQ ID NO: 37580 - RNA, 30 nt, synthetic construct
  misc_feature 1..30: note = derived and/or modified sequence opt4 from anti-influenza_CDR
  source 1..30: mol_type = other RNA
agcagcaactacaacagaagattcaccccc

SEQ ID NO: 37581 - RNA, 30 nt, synthetic construct
  misc_feature 1..30: note = derived and/or modified sequence opt4 from anti-influenza_CDR
  source 1..30: mol_type = other RNA
agacccaaggtgagagaccaggagagcaga

SEQ ID NO: 37582 - RNA, 30 nt, synthetic construct
  misc_feature 1..30: note = derived and/or modified sequence opt4 from anti-influenza_CDR
  source 1..30: mol_type = other RNA
agaccctgggtgagaggcgtgagcagcaga

SEQ ID NO: 37583 - RNA, 30 nt, synthetic construct
  misc_feature 1..30: note = derived and/or modified sequence opt4 from anti-influenza_CDR
  source 1..30: mol_type = other RNA
agaccctgggtgagaggcctgagcagcaga

SEQ ID NO: 37584 - RNA, 30 nt, synthetic construct
  misc_feature 1..30: note = derived and/or modified sequence opt4 from anti-influenza_CDR
  source 1..30: mol_type = other RNA
agacccaaggtgagaggccaggccggcaga

SEQ ID NO: 37585 - RNA, 30 nt, synthetic construct
  misc_feature 1..30: note = derived and/or modified sequence opt4 from anti-influenza_CDR
  source 1..30: mol_type = other RNA
gcccccgccgtggccgcccaggccagcgcc

SEQ ID NO: 37586 - RNA, 30 nt, synthetic construct; identical to SEQ ID NO: 14660
  misc_feature 1..30: note = derived and/or modified sequence opt4 from anti-influenza_CDR
  source 1..30: mol_type = other RNA

SEQ ID NO: 37587 - RNA, 30 nt, synthetic construct
  misc_feature 1..30: note = derived and/or modified sequence opt4 from anti-influenza_CDR
  source 1..30: mol_type = other RNA
ttcggccagggcaccaaggtggagatcaag

SEQ ID NO: 37588 - RNA, 30 nt, synthetic construct
  misc_feature 1..30: note = derived and/or modified sequence opt4 from anti-influenza_CDR
  source 1..30: mol_type = other RNA
ggcttcgccttccacaacagagccatgcac

SEQ ID NO: 37589 - RNA, 30 nt, synthetic construct
  misc_feature 1..30: note = derived and/or modified sequence opt4 from anti-influenza_CDR
  source 1..30: mol_type = other RNA
ggcctgaccttcagcagctacgccgtgcac

SEQ ID NO: 37590 - RNA, 30 nt, synthetic construct
  misc_feature 1..30: note = derived and/or modified sequence opt4 from anti-influenza_CDR
  source 1..30: mol_type = other RNA
ggccccaccttcagcagctacgccgtgcac

SEQ ID NO: 37591 - RNA, 30 nt, synthetic construct
  misc_feature 1..30: note = derived and/or modified sequence opt4 from anti-influenza_CDR
  source 1..30: mol_type = other RNA
ggcagcatcttcagcaactacggcatcagc

SEQ ID NO: 37592 - RNA, 30 nt, synthetic construct
  misc_feature 1..30: note = derived and/or modified sequence opt4 from anti-influenza_CDR
  source 1..30: mol_type = other RNA
ggctacagcttcaacaactacggcatcaac

SEQ ID NO: 37593 - RNA, 30 nt, synthetic construct; identical to SEQ ID NO: 14667
  misc_feature 1..30: note = derived and/or modified sequence opt4 from anti-influenza_CDR
  source 1..30: mol_type = other RNA

SEQ ID NO: 37594 - RNA, 30 nt, synthetic construct; identical to SEQ ID NO: 14668
  misc_feature 1..30: note = derived and/or modified sequence opt4 from anti-influenza_CDR
  source 1..30: mol_type = other RNA

SEQ ID NO: 37595 - RNA, 30 nt, synthetic construct
  misc_feature 1..30: note = derived and/or modified sequence opt4 from anti-influenza_CDR
  source 1..30: mol_type = other RNA
agaggcaactacggcaacggcttcgcctac

SEQ ID NO: 37596 - RNA, 30 nt, synthetic construct
  misc_feature 1..30: note = derived and/or modified sequence opt4 from anti-influenza_CDR
  source 1..30: mol_type = other RNA
cagcagtacggcagcagccccgccctgacc

SEQ ID NO: 37597 - RNA, 30 nt, synthetic construct; identical to SEQ ID NO: 14671
  misc_feature 1..30: note = derived and/or modified sequence opt4 from anti-influenza_CDR
  source 1..30: mol_type = other RNA

SEQ ID NO: 37598 - RNA, 30 nt, synthetic construct
  misc_feature 1..30: note = derived and/or modified sequence opt4 from anti-influenza_CDR
  source 1..30: mol_type = other RNA
atcagaagcggcctgaacagattcgagacc

SEQ ID NO: 37599 - RNA, 30 nt, synthetic construct
  misc_feature 1..30: note = derived and/or modified sequence opt4 from anti-influenza_CDR
  source 1..30: mol_type = other RNA
gtgttctacagcggcagcagcaactacaac

SEQ ID NO: 37600 - RNA, 30 nt, synthetic construct
  misc_feature 1..30: note = derived and/or modified sequence opt4 from anti-influenza_CDR
  source 1..30: mol_type = other RNA
ggcgccagcatcagcaccggcggcaactac

SEQ ID NO: 37601 - RNA, 30 nt, synthetic construct; identical to SEQ ID NO: 14675
  misc_feature 1..30: note = derived and/or modified sequence opt4 from anti-influenza_CDR
  source 1..30: mol_type = other RNA

SEQ ID NO: 37602 - RNA, 30 nt, synthetic construct; identical to SEQ ID NO: 14676
  misc_feature 1..30: note = derived and/or modified sequence opt4 from anti-influenza_CDR
  source 1..30: mol_type = other RNA

SEQ ID NO: 37603 - RNA, 30 nt, synthetic construct
  misc_feature 1..30: note = derived and/or modified sequence opt4 from anti-influenza_CDR
  source 1..30: mol_type = other RNA
cagcagctgaacagctacccccccatcacc

SEQ ID NO: 37604 - RNA, 30 nt, synthetic construct; identical to SEQ ID NO: 14678
  misc_feature 1..30: note = derived and/or modified sequence opt4 from anti-influenza_CDR
  source 1..30: mol_type = other RNA

SEQ ID NO: 37605 - RNA, 30 nt, synthetic construct
  misc_feature 1..30: note = derived and/or modified sequence opt4 from anti-influenza_CDR
  source 1..30: mol_type = other RNA
cagcagctgaccacctacccccccatcacc

SEQ ID NO: 37606 - RNA, 30 nt, synthetic construct
  misc_feature 1..30: note = derived and/or modified sequence opt4 from anti-influenza_CDR
  source 1..30: mol_type = other RNA
ggcggcagcatcagcaacggcggctaccac

SEQ ID NO: 37607 - RNA, 30 nt, synthetic construct
  misc_feature 1..30: note = derived and/or modified sequence opt4 from anti-influenza_CDR
  source 1..30: mol_type = other RNA
ggcgacagcgtgatcaacagcgcctactac

SEQ ID NO: 37608 - RNA, 30 nt, synthetic construct; identical to SEQ ID NO: 14682
  misc_feature 1..30: note = derived and/or modified sequence opt4 from anti-influenza_CDR
  source 1..30: mol_type = other RNA

SEQ ID NO: 37609 - RNA, 30 nt, synthetic construct
  misc_feature 1..30: note = derived and/or modified sequence opt4 from anti-influenza_CDR
  source 1..30: mol_type = other RNA
gccggcgactacagcggcggcatctacgcc

SEQ ID NO: 37610 - RNA, 30 nt, synthetic construct
  misc_feature 1..30: note = derived and/or modified sequence opt4 from anti-influenza_CDR
  source 1..30: mol_type = other RNA
gccggcgactacagcggcagcaactacgcc

SEQ ID NO: 37611 - RNA, 30 nt, synthetic construct
  misc_feature 1..30: note = derived and/or modified sequence opt4 from anti-influenza_CDR
  source 1..30: mol_type = other RNA
gccggcgactacagcggcgccaactacgcc

SEQ ID NO: 37612 - RNA, 30 nt, synthetic construct
  misc_feature 1..30: note = derived and/or modified sequence opt4 from anti-influenza_CDR
  source 1..30: mol_type = other RNA
ggcctgagcctgtacagcaacgagatcaac

SEQ ID NO: 37613 - RNA, 30 nt, synthetic construct; identical to SEQ ID NO: 14687
  misc_feature 1..30: note = derived and/or modified sequence opt4 from anti-influenza_CDR
  source 1..30: mol_type = other RNA

SEQ ID NO: 37614 - RNA, 30 nt, synthetic construct
  misc_feature 1..30: note = derived and/or modified sequence opt4 from anti-influenza_CDR
  source 1..30: mol_type = other RNA
gccagccagagcgtgagcaccttcctggcc

SEQ ID NO: 37615 - RNA, 30 nt, synthetic construct
  misc_feature 1..30: note = derived and/or modified sequence opt4 from anti-influenza_CDR
  source 1..30: mol_type = other RNA
atcaagagcaacaccgacggcggcaccacc

SEQ ID NO: 37616 - RNA, 30 nt, synthetic construct
  misc_feature 1..30: note = derived and/or modified sequence opt4 from anti-influenza_CDR
  source 1..30: mol_type = other RNA
gagagcgtggacatctacggcaacagcttc

SEQ ID NO: 37617 - RNA, 30 nt, synthetic construct
  misc_feature 1..30: note = derived and/or modified sequence opt4 from anti-influenza_CDR
  source 1..30: mol_type = other RNA
gagagcatcgacatctacggcaacagcttc

SEQ ID NO: 37618 - RNA, 30 nt, synthetic construct
  misc_feature 1..30: note = derived and/or modified sequence opt4 from anti-influenza_CDR
  source 1..30: mol_type = other RNA
gccggcgactacagcggcgtgaactacgcc

SEQ ID NO: 37619 - RNA, 33 nt, synthetic construct
  misc_feature 1..33: note = derived and/or modified sequence opt4 from anti-influenza_CDR
  source 1..33: mol_type = other RNA
gccgcctgggacgacagcctgaacggccagctg

SEQ ID NO: 37620 - RNA, 33 nt, synthetic construct
  misc_feature 1..33: note = derived and/or modified sequence opt4 from anti-influenza_CDR
  source 1..33: mol_type = other RNA
tgcagctacgccggcagcagcagcagcagagtg

SEQ ID NO: 37621 - RNA, 33 nt, synthetic construct
  misc_feature 1..33: note = derived and/or modified sequence opt4 from anti-influenza_CDR
  source 1..33: mol_type = other RNA
ctggtgctggccaccggcctgagaaacagcccc

SEQ ID NO: 37622 - RNA, 33 nt, synthetic construct
  misc_feature 1..33: note = derived and/or modified sequence opt4 from anti-influenza_CDR
  source 1..33: mol_type = other RNA
cagagcctgctgcacagcgacggcaagacctac

SEQ ID NO: 37623 - RNA, 33 nt, synthetic construct
  misc_feature 1..33: note = derived and/or modified sequence opt4 from anti-influenza_CDR
  source 1..33: mol_type = other RNA
agaaccagccagagcctgagcagctacctgcac

SEQ ID NO: 37624 - RNA, 33 nt, synthetic construct
  misc_feature 1..33: note = derived and/or modified sequence opt4 from anti-influenza_CDR
  source 1..33: mol_type = other RNA
agagccagccagagactgaacagctacctgcac

SEQ ID NO: 37625 - RNA, 33 nt, synthetic construct
  misc_feature 1..33: note = derived and/or modified sequence opt4 from anti-influenza_CDR
  source 1..33: mol_type = other RNA
agaaccagccagagcctgagaagctacctgcac

SEQ ID NO: 37626 - RNA, 33 nt, synthetic construct
  misc_feature 1..33: note = derived and/or modified sequence opt4 from anti-influenza_CDR
  source 1..33: mol_type = other RNA
agaaccagccagagcctgagcagctacacccac

SEQ ID NO: 37627 - RNA, 33 nt, synthetic construct
  misc_feature 1..33: note = derived and/or modified sequence opt4 from anti-influenza_CDR
  source 1..33: mol_type = other RNA
agaaccagccagagcctgagcagctacgaccac

SEQ ID NO: 37628 - RNA, 33 nt, synthetic construct
  misc_feature 1..33: note = derived and/or modified sequence opt4 from anti-influenza_CDR
  source 1..33: mol_type = other RNA
caggtgtgggacagcagcagcgaccactacgtg

SEQ ID NO: 37629 - RNA, 33 nt, synthetic construct
  misc_feature 1..33: note = derived and/or modified sequence opt4 from anti-influenza_CDR
  source 1..33: mol_type = other RNA
caggtgtggggcagcagcagcgaccactacgtg

SEQ ID NO: 37630 - RNA, 33 nt, synthetic construct
  misc_feature 1..33: note = derived and/or modified sequence opt4 from anti-influenza_CDR
  source 1..33: mol_type = other RNA
ggcacctgggacagcagcctgagcgtgggcatg

SEQ ID NO: 37631 - RNA, 33 nt, synthetic construct
  misc_feature 1..33: note = derived and/or modified sequence opt4 from anti-influenza_CDR
  source 1..33: mol_type = other RNA
cagagcctgctgcacggcaacggctacaactac

SEQ ID NO: 37632 - RNA, 33 nt, synthetic construct
  misc_feature 1..33: note = derived and/or modified sequence opt4 from anti-influenza_CDR
  source 1..33: mol_type = other RNA
agagccagccagggcatcagaaacgacctgggc

SEQ ID NO: 37633 - RNA, 33 nt, synthetic construct
  misc_feature 1..33: note = derived and/or modified sequence opt4 from anti-influenza_CDR
  source 1..33: mol_type = other RNA
agagccagccagaacatcagaagctacctgaac

SEQ ID NO: 37634 - RNA, 33 nt, synthetic construct
  misc_feature 1..33: note = derived and/or modified sequence opt4 from anti-influenza_CDR
  source 1..33: mol_type = other RNA
agagccaaccaggacatcggcatctacctgaac

SEQ ID NO: 37635 - RNA, 33 nt, synthetic construct
  misc_feature 1..33: note = derived and/or modified sequence opt4 from anti-influenza_CDR
  source 1..33: mol_type = other RNA
agagccagccagagcgtgagcaacaacctggcc

SEQ ID NO: 37636 - RNA, 33 nt, synthetic construct
  misc_feature 1..33: note = derived and/or modified sequence opt4 from anti-influenza_CDR
  source 1..33: mol_type = other RNA
cagcagtaccacaactggccccccagctacagc

SEQ ID NO: 37637 - RNA, 33 nt, synthetic construct
  misc_feature 1..33: note = derived and/or modified sequence opt4 from anti-influenza_CDR
  source 1..33: mol_type = other RNA
agagccagccagggcatcctgaactgcctggcc

SEQ ID NO: 37638 - RNA, 33 nt, synthetic construct
  misc_feature 1..33: note = derived and/or modified sequence opt4 from anti-influenza_CDR
  source 1..33: mol_type = other RNA
agagccagccagagcatcgccagctggctggcc

SEQ ID NO: 37639 - RNA, 33 nt, synthetic construct
  misc_feature 1..33: note = derived and/or modified sequence opt4 from anti-influenza_CDR
  source 1..33: mol_type = other RNA
gcccccagagtgtacgagtactacttcgaccag

SEQ ID NO: 37640 - RNA, 33 nt, synthetic construct
  misc_feature 1..33: note = derived and/or modified sequence opt4 from anti-influenza_CDR
  source 1..33: mol_type = other RNA
agagccagccagagcgtgagcagctacctggcc

SEQ ID NO: 37641 - RNA, 33 nt, synthetic construct; identical to SEQ ID NO: 14715
  misc_feature 1..33: note = derived and/or modified sequence opt4 from anti-influenza_CDR
  source 1..33: mol_type = other RNA

SEQ ID NO: 37642 - RNA, 33 nt, synthetic construct
  misc_feature 1..33: note = derived and/or modified sequence opt4 from anti-influenza_CDR
  source 1..33: mol_type = other RNA
cagagcgccgacagcagcggcaccagctgggtg

SEQ ID NO: 37643 - RNA, 33 nt, synthetic construct
  misc_feature 1..33: note = derived and/or modified sequence opt4 from anti-influenza_CDR
  source 1..33: mol_type = other RNA
ggcggcagcaacatcggcggcaagagcgtgcac

SEQ ID NO: 37644 - RNA, 33 nt, synthetic construct
  misc_feature 1..33: note = derived and/or modified sequence opt4 from anti-influenza_CDR
  source 1..33: mol_type = other RNA
cagcactacggcagcagccccagatacgccttc

SEQ ID NO: 37645 - RNA, 33 nt, synthetic construct
  misc_feature 1..33: note = derived and/or modified sequence opt4 from anti-influenza_CDR
  source 1..33: mol_type = other RNA
agagccagccagagcatcagcagctacctgaac

SEQ ID NO: 37646 - RNA, 33 nt, synthetic construct
  misc_feature 1..33: note = derived and/or modified sequence opt4 from anti-influenza_CDR
  source 1..33: mol_type = other RNA
ggcggcaacgccatcggcagcaagaaggtgcac

SEQ ID NO: 37647 - RNA, 33 nt, synthetic construct
  misc_feature 1..33: note = derived and/or modified sequence opt4 from anti-influenza_CDR
  source 1..33: mol_type = other RNA
caggtgtgggacttcaccatcgaccacgtggtg

SEQ ID NO: 37648 - RNA, 33 nt, synthetic construct
  misc_feature 1..33: note = derived and/or modified sequence opt4 from anti-influenza_CDR
  source 1..33: mol_type = other RNA
gccacctgggacggcagcctgagcgcctgggtg

SEQ ID NO: 37649 - RNA, 33 nt, synthetic construct
  misc_feature 1..33: note = derived and/or modified sequence opt4 from anti-influenza_CDR
  source 1..33: mol_type = other RNA
agagccagccagagcgtgggcaactacctggcc

SEQ ID NO: 37650 - RNA, 33 nt, synthetic construct
  misc_feature 1..33: note = derived and/or modified sequence opt4 from anti-influenza_CDR
  source 1..33: mol_type = other RNA
cagcagagaagcaagtggccccccatgtacagc

SEQ ID NO: 37651 - RNA, 33 nt, synthetic construct
  misc_feature 1..33: note = derived and/or modified sequence opt4 from anti-influenza_CDR
  source 1..33: mol_type = other RNA
gacgtgagcaccacctggagctggttcgccccc

SEQ ID NO: 37652 - RNA, 33 nt, synthetic construct
  misc_feature 1..33: note = derived and/or modified sequence opt4 from anti-influenza_CDR
  source 1..33: mol_type = other RNA
agagccagccagaacatcaagagatacttcaac

SEQ ID NO: 37653 - RNA, 33 nt, synthetic construct
  misc_feature 1..33: note = derived and/or modified sequence opt4 from anti-influenza_CDR
  source 1..33: mol_type = other RNA
agagccagccagagcgtgggcaacagcctggcc

SEQ ID NO: 37654 - RNA, 33 nt, synthetic construct
  misc_feature 1..33: note = derived and/or modified sequence opt4 from anti-influenza_CDR
  source 1..33: mol_type = other RNA
ggcgagagcaccctgagctactacgccgtgagc

SEQ ID NO: 37655 - RNA, 33 nt, synthetic construct
  misc_feature 1..33: note = derived and/or modified sequence opt4 from anti-influenza_CDR
  source 1..33: mol_type = other RNA
agagccagccagaacatctacaagtacctgaac

SEQ ID NO: 37656 - RNA, 33 nt, synthetic construct
  misc_feature 1..33: note = derived and/or modified sequence opt4 from anti-influenza_CDR
  source 1..33: mol_type = other RNA
gccagctgcagcggcggctactgcatcctggac

SEQ ID NO: 37657 - RNA, 33 nt, synthetic construct
  misc_feature 1..33: note = derived and/or modified sequence opt4 from anti-influenza_CDR
  source 1..33: mol_type = other RNA
agaaccagccagagcatcagcagctacctgaac

SEQ ID NO: 37658 - RNA, 33 nt, synthetic construct
  misc_feature 1..33: note = derived and/or modified sequence opt4 from anti-influenza_CDR
  source 1..33: mol_type = other RNA
agagccagccagagcatcggcgcctacgtgaac

SEQ ID NO: 37659 - RNA, 33 nt, synthetic construct
  misc_feature 1..33: note = derived and/or modified sequence opt4 from anti-influenza_CDR
  source 1..33: mol_type = other RNA
agagccagccagagcatcagcacctacctgaac

SEQ ID NO: 37660 - RNA, 33 nt, synthetic construct
  misc_feature 1..33: note = derived and/or modified sequence opt4 from anti-influenza_CDR
  source 1..33: mol_type = other RNA
agagccagccagagcatcgacaagttcctgaac

SEQ ID NO: 37661 - RNA, 33 nt, synthetic construct
  misc_feature 1..33: note = derived and/or modified sequence opt4 from anti-influenza_CDR
  source 1..33: mol_type = other RNA
ggcggccacaacatcggcagcaacagcgtgcac

SEQ ID NO: 37662 - RNA, 33 nt, synthetic construct
  misc_feature 1..33: note = derived and/or modified sequence opt4 from anti-influenza_CDR
  source 1..33: mol_type = other RNA
agagccagccagagcatcagcacctacctgcac

SEQ ID NO: 37663 - RNA, 33 nt, synthetic construct
  misc_feature 1..33: note = derived and/or modified sequence opt4 from anti-influenza_CDR
  source 1..33: mol_type = other RNA
cacgtgggcggccacacctacggcatcgactac

SEQ ID NO: 37664 - RNA, 33 nt, synthetic construct
  misc_feature 1..33: note = derived and/or modified sequence opt4 from anti-influenza_CDR
  source 1..33: mol_type = other RNA
agagccagccagagcatcagcaactacctgaac

SEQ ID NO: 37665 - RNA, 33 nt, synthetic construct
  misc_feature 1..33: note = derived and/or modified sequence opt4 from anti-influenza_CDR
  source 1..33: mol_type = other RNA
cacgacgacgccagccacggctacagcatcagc

SEQ ID NO: 37666 - RNA, 33 nt, synthetic construct
  misc_feature 1..33: note = derived and/or modified sequence opt4 from anti-influenza_CDR
  source 1..33: mol_type = other RNA
agagccagccagaccatcagcacctacctgaac

SEQ ID NO: 37667 - RNA, 33 nt, synthetic construct
  misc_feature 1..33: note = derived and/or modified sequence opt4 from anti-influenza_CDR
  source 1..33: mol_type = other RNA
agagccagccagagcatcagcagatacctgaac

SEQ ID NO: 37668 - RNA, 33 nt, synthetic construct
  misc_feature 1..33: note = derived and/or modified sequence opt4 from anti-influenza_CDR
  source 1..33: mol_type = other RNA
ggcacctgggacagcagcctgagcgcctacgtg

SEQ ID NO: 37669 - RNA, 33 nt, synthetic construct
  misc_feature 1..33: note = derived and/or modified sequence opt4 from anti-influenza_CDR
  source 1..33: mol_type = other RNA
agcagcaactactacgacagcgtgtacgactac

SEQ ID NO: 37670 - RNA, 33 nt, synthetic construct
  misc_feature 1..33: note = derived and/or modified sequence opt4 from anti-influenza_CDR
  source 1..33: mol_type = other RNA
gccgcctgggacgacatcctgaacgtgcccgtg

SEQ ID NO: 37671 - RNA, 33 nt, synthetic construct
  misc_feature 1..33: note = derived and/or modified sequence opt4 from anti-influenza_CDR
  source 1..33: mol_type = other RNA
gtggcctgggacgacagcgtggacggctacgtg

SEQ ID NO: 37672 - RNA, 33 nt, synthetic construct; identical to SEQ ID NO: 14746
  misc_feature 1..33: note = derived and/or modified sequence opt4 from anti-influenza_CDR
  source 1..33: mol_type = other RNA

SEQ ID NO: 37673 - RNA, 33 nt, synthetic construct
  misc_feature 1..33: note = derived and/or modified sequence opt4 from anti-influenza_CDR
  source 1..33: mol_type = other RNA
agagccagccagggcatcagcagctacctggcc

SEQ ID NO: 37674 - RNA, 33 nt, synthetic construct
  misc_feature 1..33: note = derived and/or modified sequence opt4 from anti-influenza_CDR
  source 1..33: mol_type = other RNA
agcagcggctactaccccgagtacttccaggac

SEQ ID NO: 37675 - RNA, 33 nt, synthetic construct
  misc_feature 1..33: note = derived and/or modified sequence opt4 from anti-influenza_CDR
  source 1..33: mol_type = other RNA
agcggccacaagctgggcgacaagtacgtgagc

SEQ ID NO: 37676 - RNA, 33 nt, synthetic construct; identical to SEQ ID NO: 14750
  misc_feature 1..33: note = derived and/or modified sequence opt4 from anti-influenza_CDR
  source 1..33: mol_type = other RNA

SEQ ID NO: 37677 - RNA, 33 nt, synthetic construct
  misc_feature 1..33: note = derived and/or modified sequence opt4 from anti-influenza_CDR
  source 1..33: mol_type = other RNA
agagccagccagagagtgagcagctacctggcc

SEQ ID NO: 37678 - RNA, 33 nt, synthetic construct; identical to SEQ ID NO: 36571
  misc_feature 1..33: note = derived and/or modified sequence opt4 from anti-influenza_CDR
  source 1..33: mol_type = other RNA

SEQ ID NO: 37679 - RNA, 33 nt, synthetic construct
  misc_feature 1..33: note = derived and/or modified sequence opt4 from anti-influenza_CDR
  source 1..33: mol_type = other RNA
caggtgtgggacagcagcagcgaccacgccgtg

SEQ ID NO: 37680 - RNA, 33 nt, synthetic construct; identical to SEQ ID NO: 14754
  misc_feature 1..33: note = derived and/or modified sequence opt4 from anti-influenza_CDR
  source 1..33: mol_type = other RNA

SEQ ID NO: 37681 - RNA, 33 nt, synthetic construct
  misc_feature 1..33: note = derived and/or modified sequence opt4 from anti-influenza_CDR
  source 1..33: mol_type = other RNA
agcagcggctactaccccgcctacctgccccac

SEQ ID NO: 37682 - RNA, 33 nt, synthetic construct
  misc_feature 1..33: note = derived and/or modified sequence opt4 from anti-influenza_CDR
  source 1..33: mol_type = other RNA
ggcggcaacaacatcggcagcaagggcgtgcac

SEQ ID NO: 37683 - RNA, 33 nt, synthetic construct
  misc_feature 1..33: note = derived and/or modified sequence opt4 from anti-influenza_CDR
  source 1..33: mol_type = other RNA
caggtgtgggacagcagcagcgaccacgtggtg

SEQ ID NO: 37684 - RNA, 33 nt, synthetic construct
  misc_feature 1..33: note = derived and/or modified sequence opt4 from anti-influenza_CDR
  source 1..33: mol_type = other RNA
ggcaactactactacgagagcagcctggactac

SEQ ID NO: 37685 - RNA, 33 nt, synthetic construct
  misc_feature 1..33: note = derived and/or modified sequence opt4 from anti-influenza_CDR
  source 1..33: mol_type = other RNA
ggcccccactactacagcagctacatggacgtg

SEQ ID NO: 37686 - RNA, 33 nt, synthetic construct
  misc_feature 1..33: note = derived and/or modified sequence opt4 from anti-influenza_CDR
  source 1..33: mol_type = other RNA
agagccagccagggcatcagcacctacctggcc

SEQ ID NO: 37687 - RNA, 33 nt, synthetic construct; identical to SEQ ID NO: 14761
  misc_feature 1..33: note = derived and/or modified sequence opt4 from anti-influenza_CDR
  source 1..33: mol_type = other RNA

SEQ ID NO: 37688 - RNA, 33 nt, synthetic construct
  misc_feature 1..33: note = derived and/or modified sequence opt4 from anti-influenza_CDR
  source 1..33: mol_type = other RNA
ggcggcaacaacatcggcagaaacagcgtgcac

SEQ ID NO: 37689 - RNA, 33 nt, synthetic construct
  misc_feature 1..33: note = derived and/or modified sequence opt4 from anti-influenza_CDR
  source 1..33: mol_type = other RNA
caggtgtggcacagcagcagcgaccactacgtg

SEQ ID NO: 37690 - RNA, 33 nt, synthetic construct
  misc_feature 1..33: note = derived and/or modified sequence opt4 from anti-influenza_CDR
  source 1..33: mol_type = other RNA
agcagcggctactacccccagtacttccaggac

SEQ ID NO: 37691 - RNA, 33 nt, synthetic construct
  misc_feature 1..33: note = derived and/or modified sequence opt4 from anti-influenza_CDR
  source 1..33: mol_type = other RNA
agagccagccagagcgtgagcagatacctggcc

SEQ ID NO: 37692 - RNA, 33 nt, synthetic construct
  misc_feature 1..33: note = derived and/or modified sequence opt4 from anti-influenza_CDR
  source 1..33: mol_type = other RNA
tggggccagggcaccaccctgaccgtgagcagc

SEQ ID NO: 37693 - RNA, 33 nt, synthetic construct
  misc_feature 1..33: note = derived and/or modified sequence opt4 from anti-influenza_CDR
  source 1..33: mol_type = other RNA
agagccagccagagcgtggacagcaacctggcc

SEQ ID NO: 37694 - RNA, 33 nt, synthetic construct
  misc_feature 1..33: note = derived and/or modified sequence opt4 from anti-influenza_CDR
  source 1..33: mol_type = other RNA
agagccagccagagcgtgagccacaacctggcc

SEQ ID NO: 37695 - RNA, 33 nt, synthetic construct
  misc_feature 1..33: note = derived and/or modified sequence opt4 from anti-influenza_CDR
  source 1..33: mol_type = other RNA
agagccagccagagcgtgagcagcaacctggcc

SEQ ID NO: 37696 - RNA, 33 nt, synthetic construct
  misc_feature 1..33: note = derived and/or modified sequence opt4 from anti-influenza_CDR
  source 1..33: mol_type = other RNA
agagccagccagagcgtggaccacaacctggcc

SEQ ID NO: 37697 - RNA, 33 nt, synthetic construct
  misc_feature 1..33: note = derived and/or modified sequence opt4 from anti-influenza_CDR
  source 1..33: mol_type = other RNA
cagcactacaccaactggccccccagactgacc

SEQ ID NO: 37698 - RNA, 33 nt, synthetic construct
  misc_feature 1..33: note = derived and/or modified sequence opt4 from anti-influenza_CDR
  source 1..33: mol_type = other RNA
cagcactacaccaactacccccccagactgacc

SEQ ID NO: 37699 - RNA, 33 nt, synthetic construct
  misc_feature 1..33: note = derived and/or modified sequence opt4 from anti-influenza_CDR
  source 1..33: mol_type = other RNA
cagcactacaccaacttcccccccagactgacc

SEQ ID NO: 37700 - RNA, 33 nt, synthetic construct
  misc_feature 1..33: note = derived and/or modified sequence opt4 from anti-influenza_CDR
  source 1..33: mol_type = other RNA
agagccagccaggtgatcagccacaacctggcc

SEQ ID NO: 37701 - RNA, 33 nt, synthetic construct
  misc_feature 1..33: note = derived and/or modified sequence opt4 from anti-influenza_CDR
  source 1..33: mol_type = other RNA
cagcactacagcaactggccccccagactgacc

SEQ ID NO: 37702 - RNA, 33 nt, synthetic construct
  misc_feature 1..33: note = derived and/or modified sequence opt4 from anti-influenza_CDR
  source 1..33: mol_type = other RNA
cagcactacagcaacttcccccccagactgacc

SEQ ID NO: 37703 - RNA, 33 nt, synthetic construct
  misc_feature 1..33: note = derived and/or modified sequence opt4 from anti-influenza_CDR
  source 1..33: mol_type = other RNA
cagcactacagcaactacccccccagactgacc

SEQ ID NO: 37704 - RNA, 33 nt, synthetic construct
  misc_feature 1..33: note = derived and/or modified sequence opt4 from anti-influenza_CDR
  source 1..33: mol_type = other RNA
agagccagccagagcgtggccaacaacctggcc

SEQ ID NO: 37705 - RNA, 33 nt, synthetic construct; identical to SEQ ID NO: 22421
  misc_feature 1..33: note = derived and/or modified sequence opt4 from anti-influenza_CDR
  source 1..33: mol_type = other RNA

SEQ ID NO: 37706 - RNA, 33 nt, synthetic construct
  misc_feature 1..33: note = derived and/or modified sequence opt4 from anti-influenza_CDR
  source 1..33: mol_type = other RNA
agagccagccagagcatcggcaactggctggcc

SEQ ID NO: 37707 - RNA, 33 nt, synthetic construct
  misc_feature 1..33: note = derived and/or modified sequence opt4 from anti-influenza_CDR
  source 1..33: mol_type = other RNA
cagagatacaccagcaacagccagggcttcacc

SEQ ID NO: 37708 - RNA, 33 nt, synthetic construct; identical to SEQ ID NO: 14782
  misc_feature 1..33: note = derived and/or modified sequence opt4 from anti-influenza_CDR
  source 1..33: mol_type = other RNA

SEQ ID NO: 37709 - RNA, 33 nt, synthetic construct
  misc_feature 1..33: note = derived and/or modified sequence opt4 from anti-influenza_CDR
  source 1..33: mol_type = other RNA
aaggccagccagaacgtgggcagcaacgtggcc

SEQ ID NO: 37710 - RNA, 33 nt, synthetic construct
  misc_feature 1..33: note = derived and/or modified sequence opt4 from anti-influenza_CDR
  source 1..33: mol_type = other RNA
caggtgtgggacatgagcagcgacagaagagtg

SEQ ID NO: 37711 - RNA, 33 nt, synthetic construct
  misc_feature 1..33: note = derived and/or modified sequence opt4 from anti-influenza_CDR
  source 1..33: mol_type = other RNA
cagagcctgctgcacagcaacggctacaactac

SEQ ID NO: 37712 - RNA, 33 nt, synthetic construct
  misc_feature 1..33: note = derived and/or modified sequence opt4 from anti-influenza_CDR
  source 1..33: mol_type = other RNA
acctacctggtgggcgccgtgggcttccagcac

SEQ ID NO: 37713 - RNA, 33 nt, synthetic construct; identical to SEQ ID NO: 13698
  misc_feature 1..33: note = derived and/or modified sequence opt4 from anti-influenza_CDR
  source 1..33: mol_type = other RNA

SEQ ID NO: 37714 - RNA, 33 nt, synthetic construct
  misc_feature 1..33: note = derived and/or modified sequence opt4 from anti-influenza_CDR
  source 1..33: mol_type = other RNA
cagagcctgctggacagcaacggctacaactac

SEQ ID NO: 37715 - RNA, 33 nt, synthetic construct
  misc_feature 1..33: note = derived and/or modified sequence opt4 from anti-influenza_CDR
  source 1..33: mol_type = other RNA
atgcaggccctgcagaccccccccatgtacacc

SEQ ID NO: 37716 - RNA, 33 nt, synthetic construct
  misc_feature 1..33: note = derived and/or modified sequence opt4 from anti-influenza_CDR
  source 1..33: mol_type = other RNA
cagagcctgctgcacagcaacggctacaaccac

SEQ ID NO: 37717 - RNA, 33 nt, synthetic construct
  misc_feature 1..33: note = derived and/or modified sequence opt4 from anti-influenza_CDR
  source 1..33: mol_type = other RNA
caggtgtgggacatcaccagcgacctggtggtg

SEQ ID NO: 37718 - RNA, 33 nt, synthetic construct
  misc_feature 1..33: note = derived and/or modified sequence opt4 from anti-influenza_CDR
  source 1..33: mol_type = other RNA
agagccagccaggacatcagcacctggctggcc

SEQ ID NO: 37719 - RNA, 33 nt, synthetic construct
  misc_feature 1..33: note = derived and/or modified sequence opt4 from anti-influenza_CDR
  source 1..33: mol_type = other RNA
agagccagcagaagcatcaccaccttcctggcc

SEQ ID NO: 37720 - RNA, 33 nt, synthetic construct
  misc_feature 1..33: note = derived and/or modified sequence opt4 from anti-influenza_CDR
  source 1..33: mol_type = other RNA
ggctggggcgccgtgaccagccccttcgacttc

SEQ ID NO: 37721 - RNA, 33 nt, synthetic construct
  misc_feature 1..33: note = derived and/or modified sequence opt4 from anti-influenza_CDR
  source 1..33: mol_type = other RNA
agagccagccagagcgtgagcagcagctacctg

SEQ ID NO: 37722 - RNA, 36 nt, synthetic construct
  misc_feature 1..36: note = derived and/or modified sequence opt4 from anti-influenza_CDR
  source 1..36: mol_type = other RNA
cagagcgtgctgtacagcagcaacaacaagaactac

SEQ ID NO: 37723 - RNA, 36 nt, synthetic construct
  misc_feature 1..36: note = derived and/or modified sequence opt4 from anti-influenza_CDR
  source 1..36: mol_type = other RNA
gccgcctgggacgacagcctgagcggcagctgggtg

SEQ ID NO: 37724 - RNA, 36 nt, synthetic construct
  misc_feature 1..36: note = derived and/or modified sequence opt4 from anti-influenza_CDR
  source 1..36: mol_type = other RNA
gtgttctacagcgccgacagaaccagctacgccgac

SEQ ID NO: 37725 - RNA, 36 nt, synthetic construct
  misc_feature 1..36: note = derived and/or modified sequence opt4 from anti-influenza_CDR
  source 1..36: mol_type = other RNA
agagtgggccagagcgtgagcggcagccacctggcc

SEQ ID NO: 37726 - RNA, 36 nt, synthetic construct
  misc_feature 1..36: note = derived and/or modified sequence opt4 from anti-influenza_CDR
  source 1..36: mol_type = other RNA
accctgagcagcgcctacagcaactacaaggtggac

SEQ ID NO: 37727 - RNA, 36 nt, synthetic construct
  misc_feature 1..36: note = derived and/or modified sequence opt4 from anti-influenza_CDR
  source 1..36: mol_type = other RNA
gtgggcaccggcggcatcgtgggcagcaagggcgac

SEQ ID NO: 37728 - RNA, 36 nt, synthetic construct
  misc_feature 1..36: note = derived and/or modified sequence opt4 from anti-influenza_CDR
  source 1..36: mol_type = other RNA
agatacagcagaagcagccccggcaccttcgagagc

SEQ ID NO: 37729 - RNA, 36 nt, synthetic construct
  misc_feature 1..36: note = derived and/or modified sequence opt4 from anti-influenza_CDR
  source 1..36: mol_type = other RNA
cagagctacgacagcagcctgagcggcttccacgtg

SEQ ID NO: 37730 - RNA, 36 nt, synthetic construct
  misc_feature 1..36: note = derived and/or modified sequence opt4 from anti-influenza_CDR
  source 1..36: mol_type = other RNA
agagccagccagagcgtgagcagcagccagctggcc

SEQ ID NO: 37731 - RNA, 36 nt, synthetic construct
  misc_feature 1..36: note = derived and/or modified sequence opt4 from anti-influenza_CDR
  source 1..36: mol_type = other RNA
agagccagccagttcgtgagcaccagaagcctggcc

SEQ ID NO: 37732 - RNA, 36 nt, synthetic construct; identical to SEQ ID NO: 14806
  misc_feature 1..36: note = derived and/or modified sequence opt4 from anti-influenza_CDR
  source 1..36: mol_type = other RNA

SEQ ID NO: 37733 - RNA, 36 nt, synthetic construct
  misc_feature 1..36: note = derived and/or modified sequence opt4 from anti-influenza_CDR
  source 1..36: mol_type = other RNA
agagccagccacttcgtgaactacagaagcctggcc

SEQ ID NO: 37734 - RNA, 36 nt, synthetic construct
  misc_feature 1..36: note = derived and/or modified sequence opt4 from anti-influenza_CDR
  source 1..36: mol_type = other RNA
agagccagccacttcgtgatcggcagagccgtggcc

SEQ ID NO: 37735 - RNA, 36 nt, synthetic construct
  misc_feature 1..36: note = derived and/or modified sequence opt4 from anti-influenza_CDR
  source 1..36: mol_type = other RNA
agaatctaccacggcggcaacagcggcttcgacttc

SEQ ID NO: 37736 - RNA, 36 nt, synthetic construct
  misc_feature 1..36: note = derived and/or modified sequence opt4 from anti-influenza_CDR
  source 1..36: mol_type = other RNA
accctgagcagcggcttcgacaactaccaggtggcc

SEQ ID NO: 37737 - RNA, 36 nt, synthetic construct
  misc_feature 1..36: note = derived and/or modified sequence opt4 from anti-influenza_CDR
  source 1..36: mol_type = other RNA
gtgggcaacggcggcaacgtggccagcaagggcgac

SEQ ID NO: 37738 - RNA, 36 nt, synthetic construct
  misc_feature 1..36: note = derived and/or modified sequence opt4 from anti-influenza_CDR
  source 1..36: mol_type = other RNA
gtgagaggcggcagcaccgtggcctacttcggcgtg

SEQ ID NO: 37739 - RNA, 36 nt, synthetic construct
  misc_feature 1..36: note = derived and/or modified sequence opt4 from anti-influenza_CDR
  source 1..36: mol_type = other RNA
tgcctgagcagaatgagaggctacggcctggacgtg

SEQ ID NO: 37740 - RNA, 36 nt, synthetic construct
  misc_feature 1..36: note = derived and/or modified sequence opt4 from anti-influenza_CDR
  source 1..36: mol_type = other RNA
gtgggccagatggacaagtactacgccatggacgtg

SEQ ID NO: 37741 - RNA, 36 nt, synthetic construct
  misc_feature 1..36: note = derived and/or modified sequence opt4 from anti-influenza_CDR
  source 1..36: mol_type = other RNA
ggcgtgaccaacaaggtgaacagcatcatcgacaag

SEQ ID NO: 37742 - RNA, 36 nt, synthetic construct
  misc_feature 1..36: note = derived and/or modified sequence opt4 from anti-influenza_CDR
  source 1..36: mol_type = other RNA
ggcgtgaccaacaaggtgaacagaatcatcgacaag

SEQ ID NO: 37743 - RNA, 36 nt, synthetic construct; identical to SEQ ID NO: 14817
  misc_feature 1..36: note = derived and/or modified sequence opt4 from anti-influenza_CDR
  source 1..36: mol_type = other RNA

SEQ ID NO: 37744 - RNA, 36 nt, synthetic construct
  misc_feature 1..36: note = derived and/or modified sequence opt4 from anti-influenza_CDR
  source 1..36: mol_type = other RNA
cccctgggcatcctgcactactacgccatggacctg

SEQ ID NO: 37745 - RNA, 36 nt, synthetic construct
  misc_feature 1..36: note = derived and/or modified sequence opt4 from anti-influenza_CDR
  source 1..36: mol_type = other RNA
aagatcaccagcaaggtgaacaacatcgtggacaag

SEQ ID NO: 37746 - RNA, 36 nt, synthetic construct; identical to SEQ ID NO: 14820
  misc_feature 1..36: note = derived and/or modified sequence opt4 from anti-influenza_CDR
  source 1..36: mol_type = other RNA

SEQ ID NO: 37747 - RNA, 36 nt, synthetic construct
  misc_feature 1..36: note = derived and/or modified sequence opt4 from anti-influenza_CDR
  source 1..36: mol_type = other RNA
aacggcagaagcagcaccagctggggcatcgacgtg

SEQ ID NO: 37748 - RNA, 36 nt, synthetic construct; identical to SEQ ID NO: 14822
  misc_feature 1..36: note = derived and/or modified sequence opt4 from anti-influenza_CDR
  source 1..36: mol_type = other RNA

SEQ ID NO: 37749 - RNA, 36 nt, synthetic construct
  misc_feature 1..36: note = derived and/or modified sequence opt4 from anti-influenza_CDR
  source 1..36: mol_type = other RNA
cccctgggcagcagatactactacggcatggacgtg

SEQ ID NO: 37750 - RNA, 36 nt, synthetic construct
  misc_feature 1..36: note = derived and/or modified sequence opt4 from anti-influenza_CDR
  source 1..36: mol_type = other RNA
ggcatcaccaacaaggtgaacagcgtgatcgagaag

SEQ ID NO: 37751 - RNA, 36 nt, synthetic construct
  misc_feature 1..36: note = derived and/or modified sequence opt4 from anti-influenza_CDR
  source 1..36: mol_type = other RNA
ggcgtgaccaacaaggtgaacagcatcatcaacaag

SEQ ID NO: 37752 - RNA, 36 nt, synthetic construct
  misc_feature 1..36: note = derived and/or modified sequence opt4 from anti-influenza_CDR
  source 1..36: mol_type = other RNA
cacatgggctaccaggtgagagagaccatggacgtg

SEQ ID NO: 37753 - RNA, 36 nt, synthetic construct
  misc_feature 1..36: note = derived and/or modified sequence opt4 from anti-influenza_CDR
  source 1..36: mol_type = other RNA
gccacctgggacagaagacccaccgcctacgtggtg

SEQ ID NO: 37754 - RNA, 36 nt, synthetic construct; identical to SEQ ID NO: 22470
  misc_feature 1..36: note = derived and/or modified sequence opt4 from anti-influenza_CDR
  source 1..36: mol_type = other RNA

SEQ ID NO: 37755 - RNA, 36 nt, synthetic construct
  misc_feature 1..36: note = derived and/or modified sequence opt4 from anti-influenza_CDR
  source 1..36: mol_type = other RNA
ggcgacaagggcatctactactactacatggacgtg

SEQ ID NO: 37756 - RNA, 36 nt, synthetic construct
  misc_feature 1..36: note = derived and/or modified sequence opt4 from anti-influenza_CDR
  source 1..36: mol_type = other RNA
ggcagcggctaccacatcagcacccccttcgacaac

SEQ ID NO: 37757 - RNA, 36 nt, synthetic construct
  misc_feature 1..36: note = derived and/or modified sequence opt4 from anti-influenza_CDR
  source 1..36: mol_type = other RNA
agagccagccagagcgtgagcagcagctacctggcc

SEQ ID NO: 37758 - RNA, 36 nt, synthetic construct
  misc_feature 1..36: note = derived and/or modified sequence opt4 from anti-influenza_CDR
  source 1..36: mol_type = other RNA
ggcagcggctacaccaccagaaactacttcgactac

SEQ ID NO: 37759 - RNA, 36 nt, synthetic construct
  misc_feature 1..36: note = derived and/or modified sequence opt4 from anti-influenza_CDR
  source 1..36: mol_type = other RNA
agagccagccagagcgtgagcagcaactacctgggc

SEQ ID NO: 37760 - RNA, 36 nt, synthetic construct
  misc_feature 1..36: note = derived and/or modified sequence opt4 from anti-influenza_CDR
  source 1..36: mol_type = other RNA
ggcagcacctacgacttcagcagcggcctggactac

SEQ ID NO: 37761 - RNA, 36 nt, synthetic construct
  misc_feature 1..36: note = derived and/or modified sequence opt4 from anti-influenza_CDR
  source 1..36: mol_type = other RNA
ggcgtgcaccaccccggcaccgacaacgaccagatc

SEQ ID NO: 37762 - RNA, 36 nt, synthetic construct
  misc_feature 1..36: note = derived and/or modified sequence opt4 from anti-influenza_CDR
  source 1..36: mol_type = other RNA
ggcgtgcaccaccccagcaccgacagcgaccagacc

SEQ ID NO: 37763 - RNA, 36 nt, synthetic construct
  misc_feature 1..36: note = derived and/or modified sequence opt4 from anti-influenza_CDR
  source 1..36: mol_type = other RNA
ggcgtgcaccaccccagcaacgagaccgagcagaga

SEQ ID NO: 37764 - RNA, 36 nt, synthetic construct; identical to SEQ ID NO: 14838
  misc_feature 1..36: note = derived and/or modified sequence opt4 from anti-influenza_CDR
  source 1..36: mol_type = other RNA

SEQ ID NO: 37765 - RNA, 36 nt, synthetic construct
  misc_feature 1..36: note = derived and/or modified sequence opt4 from anti-influenza_CDR
  source 1..36: mol_type = other RNA
ggcggcctgatcggcaccggcagctactactggggc

SEQ ID NO: 37766 - RNA, 36 nt, synthetic construct
  misc_feature 1..36: note = derived and/or modified sequence opt4 from anti-influenza_CDR
  source 1..36: mol_type = other RNA
gccagatacaactggggcatcagatacttcgacttc

SEQ ID NO: 37767 - RNA, 36 nt, synthetic construct
  misc_feature 1..36: note = derived and/or modified sequence opt4 from anti-influenza_CDR
  source 1..36: mol_type = other RNA
cagagcgtgctgagcaacagcaagaacctgaactac

SEQ ID NO: 37768 - RNA, 36 nt, synthetic construct
  misc_feature 1..36: note = derived and/or modified sequence opt4 from anti-influenza_CDR
  source 1..36: mol_type = other RNA
tgccaggtgtgggagaccagcgaggacctgtgggtg

SEQ ID NO: 37769 - RNA, 39 nt, synthetic construct
  misc_feature 1..39: note = derived and/or modified sequence opt4 from anti-influenza_CDR
  source 1..39: mol_type = other RNA
gccagaggcggcagatactacgtggactacttcgactac

SEQ ID NO: 37770 - RNA, 39 nt, synthetic construct
  misc_feature 1..39: note = derived and/or modified sequence opt4 from anti-influenza_CDR
  source 1..39: mol_type = other RNA
gccagaagcggcgacggctacaactactacttccccctg

SEQ ID NO: 37771 - RNA, 39 nt, synthetic construct
  misc_feature 1..39: note = derived and/or modified sequence opt4 from anti-influenza_CDR
  source 1..39: mol_type = other RNA
gccagaggctgcggctacaactgctactacttcgacggc

SEQ ID NO: 37772 - RNA, 39 nt, synthetic construct
  misc_feature 1..39: note = derived and/or modified sequence opt4 from anti-influenza_CDR
  source 1..39: mol_type = other RNA
agcggcagcagcagcaacatcggcagcaacaccgtgaac

SEQ ID NO: 37773 - RNA, 39 nt, synthetic construct
  misc_feature 1..39: note = derived and/or modified sequence opt4 from anti-influenza_CDR
  source 1..39: mol_type = other RNA
gacagcccctacagcagcagctggagcttcttcgactac

SEQ ID NO: 37774 - RNA, 39 nt, synthetic construct
  misc_feature 1..39: note = derived and/or modified sequence opt4 from anti-influenza_CDR
  source 1..39: mol_type = other RNA
agcggcagcgacagcaacatcggcgactacttcgtgtgc

SEQ ID NO: 37775 - RNA, 39 nt, synthetic construct
  misc_feature 1..39: note = derived and/or modified sequence opt4 from anti-influenza_CDR
  source 1..39: mol_type = other RNA
gccagaatggtggtggtgaccggcgacggcttcgacgtg

SEQ ID NO: 37776 - RNA, 39 nt, synthetic construct
  misc_feature 1..39: note = derived and/or modified sequence opt4 from anti-influenza_CDR
  source 1..39: mol_type = other RNA
tggctgagcatcatcaacgccggcggcggcgacatcgac

SEQ ID NO: 37777 - RNA, 39 nt, synthetic construct
  misc_feature 1..39: note = derived and/or modified sequence opt4 from anti-influenza_CDR
  source 1..39: mol_type = other RNA
gccgccagcagcctgcagagcggcgtgcccagcagattc

SEQ ID NO: 37778 - RNA, 39 nt, synthetic construct
  misc_feature 1..39: note = derived and/or modified sequence opt4 from anti-influenza_CDR
  source 1..39: mol_type = other RNA
cacgacgccaagttcagcggcagctactacgtggccagc

SEQ ID NO: 37779 - RNA, 39 nt, synthetic construct
  misc_feature 1..39: note = derived and/or modified sequence opt4 from anti-influenza_CDR
  source 1..39: mol_type = other RNA
cacgacgtgaagttcagcggcagctactacgtggccagc

SEQ ID NO: 37780 - RNA, 39 nt, synthetic construct
  misc_feature 1..39: note = derived and/or modified sequence opt4 from anti-influenza_CDR
  source 1..39: mol_type = other RNA
accggcagcgagagcaccaccggctacggcatggacgtg

SEQ ID NO: 37781 - RNA, 39 nt, synthetic construct
  misc_feature 1..39: note = derived and/or modified sequence opt4 from anti-influenza_CDR
  source 1..39: mol_type = other RNA
gccgccagcaccagcgtgctgggctacggcatggacgtg

SEQ ID NO: 37782 - RNA, 39 nt, synthetic construct
  misc_feature 1..39: note = derived and/or modified sequence opt4 from anti-influenza_CDR
  source 1..39: mol_type = other RNA
agcggcagcaccttcaacatcggcagcaacgccgtggac

SEQ ID NO: 37783 - RNA, 39 nt, synthetic construct
  misc_feature 1..39: note = derived and/or modified sequence opt4 from anti-influenza_CDR
  source 1..39: mol_type = other RNA
agcggcagcagaagcaacgtgggcgacaacagcgtgtac

SEQ ID NO: 37784 - RNA, 39 nt, synthetic construct
  misc_feature 1..39: note = derived and/or modified sequence opt4 from anti-influenza_CDR
  source 1..39: mol_type = other RNA
agcggcagcagcagcaacatcggcaacgactacgtgagc

SEQ ID NO: 37785 - RNA, 39 nt, synthetic construct
  misc_feature 1..39: note = derived and/or modified sequence opt4 from anti-influenza_CDR
  source 1..39: mol_type = other RNA
ggcggcggcagctacggcgcctacgagggcttcgactac

SEQ ID NO: 37786 - RNA, 39 nt, synthetic construct
  misc_feature 1..39: note = derived and/or modified sequence opt4 from anti-influenza_CDR
  source 1..39: mol_type = other RNA
agcggcagcagcagcaacatcggcagcaactacgtgtac

SEQ ID NO: 37787 - RNA, 39 nt, synthetic construct
  misc_feature 1..39: note = derived and/or modified sequence opt4 from anti-influenza_CDR
  source 1..39: mol_type = other RNA
gccagaagacagcagctgtacaagggctactaccaccac

SEQ ID NO: 37788 - RNA, 39 nt, synthetic construct
  misc_feature 1..39: note = derived and/or modified sequence opt4 from anti-influenza_CDR
  source 1..39: mol_type = other RNA
agcggcagcaccagcaacatcggctacaaccccgtgagc

SEQ ID NO: 37789 - RNA, 39 nt, synthetic construct
  misc_feature 1..39: note = derived and/or modified sequence opt4 from anti-influenza_CDR
  source 1..39: mol_type = other RNA
gccagaggcatgaactactacagcgactacttcgactac

SEQ ID NO: 37790 - RNA, 39 nt, synthetic construct
  misc_feature 1..39: note = derived and/or modified sequence opt4 from anti-influenza_CDR
  source 1..39: mol_type = other RNA
gccagaggccacagcggcagctacagactgttcgacttc

SEQ ID NO: 37791 - RNA, 39 nt, synthetic construct
  misc_feature 1..39: note = derived and/or modified sequence opt4 from anti-influenza_CDR
  source 1..39: mol_type = other RNA
gccaagcccctgagaggcagctacagatacttcgacctg

SEQ ID NO: 37792 - RNA, 39 nt, synthetic construct
  misc_feature 1..39: note = derived and/or modified sequence opt4 from anti-influenza_CDR
  source 1..39: mol_type = other RNA
cccatctgggtgaagacccccctgaagctggccaacggc

SEQ ID NO: 37793 - RNA, 39 nt, synthetic construct
  misc_feature 1..39: note = derived and/or modified sequence opt4 from anti-influenza_CDR
  source 1..39: mol_type = other RNA
caggccagccagagcgtgtacaacaagaacaacctggcc

SEQ ID NO: 37794 - RNA, 39 nt, synthetic construct
  misc_feature 1..39: note = derived and/or modified sequence opt4 from anti-influenza_CDR
  source 1..39: mol_type = other RNA
cagagcagcgagagcgtgtacaagaacaacaacctggcc

SEQ ID NO: 37795 - RNA, 39 nt, synthetic construct
  misc_feature 1..39: note = derived and/or modified sequence opt4 from anti-influenza_CDR
  source 1..39: mol_type = other RNA
cagagcagccagagcgtggacagcaacaaccagctgagc

SEQ ID NO: 37796 - RNA, 39 nt, synthetic construct
  misc_feature 1..39: note = derived and/or modified sequence opt4 from anti-influenza_CDR
  source 1..39: mol_type = other RNA
cagagcagccagagcgtggacaacaacaaggacctggcc

SEQ ID NO: 37797 - RNA, 39 nt, synthetic construct
  misc_feature 1..39: note = derived and/or modified sequence opt4 from anti-influenza_CDR
  source 1..39: mol_type = other RNA
cagagcagccagagcgtgtacaacaacaacagactgagc

SEQ ID NO: 37798 - RNA, 39 nt, synthetic construct
  misc_feature 1..39: note = derived and/or modified sequence opt4 from anti-influenza_CDR
  source 1..39: mol_type = other RNA
cagagcagccagagcgtgtacaagaacaacaacctggcc

SEQ ID NO: 37799 - RNA, 39 nt, synthetic construct
  misc_feature 1..39: note = derived and/or modified sequence opt4 from anti-influenza_CDR
  source 1..39: mol_type = other RNA
ggcggcggcttcggctggagccagacctacttcggctac

SEQ ID NO: 37800 - RNA, 42 nt, synthetic construct
  misc_feature 1..42: note = derived and/or modified sequence opt4 from anti-influenza_CDR
  source 1..42: mol_type = other RNA
tggctgggcagaacctactacagaagcaagtggtacaacgac

SEQ ID NO: 37801 - RNA, 42 nt, synthetic construct
  misc_feature 1..42: note = derived and/or modified sequence opt4 from anti-influenza_CDR
  source 1..42: mol_type = other RNA
ggcggcctggtgggcggctacgacgagtacttcttcgactac

SEQ ID NO: 37802 - RNA, 42 nt, synthetic construct
  misc_feature 1..42: note = derived and/or modified sequence opt4 from anti-influenza_CDR
  source 1..42: mol_type = other RNA
caccccaagtacttctacggcagcggcagctaccccgacttc

SEQ ID NO: 37803 - RNA, 42 nt, synthetic construct
  misc_feature 1..42: note = derived and/or modified sequence opt4 from anti-influenza_CDR
  source 1..42: mol_type = other RNA
accggcagcagcagcgacgtgggcgccagcaacagcgtgagc

SEQ ID NO: 37804 - RNA, 42 nt, synthetic construct
  misc_feature 1..42: note = derived and/or modified sequence opt4 from anti-influenza_CDR
  source 1..42: mol_type = other RNA
ggcgcctactacgacagcagcggctaccccgccttctacatc

SEQ ID NO: 37805 - RNA, 42 nt, synthetic construct
  misc_feature 1..42: note = derived and/or modified sequence opt4 from anti-influenza_CDR
  source 1..42: mol_type = other RNA
accggcagcagcagcaacatcggcagcgactacgacgtgcac

SEQ ID NO: 37806 - RNA, 42 nt, synthetic construct
  misc_feature 1..42: note = derived and/or modified sequence opt4 from anti-influenza_CDR
  source 1..42: mol_type = other RNA
gagttcgagaccagcggctacttccacggcagcttcgactac

SEQ ID NO: 37807 - RNA, 42 nt, synthetic construct
  misc_feature 1..42: note = derived and/or modified sequence opt4 from anti-influenza_CDR
  source 1..42: mol_type = other RNA
gccagcagcaccggcgccgtgaccagcagctacttccccaac

SEQ ID NO: 37808 - RNA, 42 nt, synthetic construct
  misc_feature 1..42: note = derived and/or modified sequence opt4 from anti-influenza_CDR
  source 1..42: mol_type = other RNA
accggcggcagcagcgacatcggcgccagcaacagcgtgagc

SEQ ID NO: 37809 - RNA, 42 nt, synthetic construct
  misc_feature 1..42: note = derived and/or modified sequence opt4 from anti-influenza_CDR
  source 1..42: mol_type = other RNA
accggcagcagcagcgacgtgggcggctacgactacgtgagc

SEQ ID NO: 37810 - RNA, 42 nt, synthetic construct
  misc_feature 1..42: note = derived and/or modified sequence opt4 from anti-influenza_CDR
  source 1..42: mol_type = other RNA
ggcagcagcaccggcgccgtgaccagaggccactacccctac

SEQ ID NO: 37811 - RNA, 42 nt, synthetic construct
  misc_feature 1..42: note = derived and/or modified sequence opt4 from anti-influenza_CDR
  source 1..42: mol_type = other RNA
ggcagcagcaccggccccgtgaccagcggccactacccctac

SEQ ID NO: 37812 - RNA, 42 nt, synthetic construct; identical to SEQ ID NO: 14886
  misc_feature 1..42: note = derived and/or modified sequence opt4 from anti-influenza_CDR
  source 1..42: mol_type = other RNA

SEQ ID NO: 37813 - RNA, 42 nt, synthetic construct
  misc_feature 1..42: note = derived and/or modified sequence opt4 from anti-influenza_CDR
  source 1..42: mol_type = other RNA
accggcagcagcagcaacatcggcgccggctacgacgtgcac

SEQ ID NO: 37814 - RNA, 42 nt, synthetic construct
  misc_feature 1..42: note = derived and/or modified sequence opt4 from anti-influenza_CDR
  source 1..42: mol_type = other RNA
atcccccactacaacttcggcagcggcagctacttcgactac

SEQ ID NO: 37815 - RNA, 42 nt, synthetic construct
  misc_feature 1..42: note = derived and/or modified sequence opt4 from anti-influenza_CDR
  source 1..42: mol_type = other RNA
accggcaccagcagcgacgtgggcggctacaactacgtgagc

SEQ ID NO: 37816 - RNA, 42 nt, synthetic construct
  misc_feature 1..42: note = derived and/or modified sequence opt4 from anti-influenza_CDR
  source 1..42: mol_type = other RNA
accggcaccagcagcgacgtgggcgcctacaactacgtgagc

SEQ ID NO: 37817 - RNA, 42 nt, synthetic construct
  misc_feature 1..42: note = derived and/or modified sequence opt4 from anti-influenza_CDR
  source 1..42: mol_type = other RNA
gccgagagacccaaggtgagaggccaggccggcagaatgaac

SEQ ID NO: 37818 - RNA, 42 nt, synthetic construct
  misc_feature 1..42: note = derived and/or modified sequence opt4 from anti-influenza_CDR
  source 1..42: mol_type = other RNA
ggcagcagaccctgggtgagaggcgtgagcagcagaatcagc

SEQ ID NO: 37819 - RNA, 42 nt, synthetic construct
  misc_feature 1..42: note = derived and/or modified sequence opt4 from anti-influenza_CDR
  source 1..42: mol_type = other RNA
atctggggcgtggccgcccccggcaccgccgccgcccagatc

SEQ ID NO: 37820 - RNA, 42 nt, synthetic construct
  misc_feature 1..42: note = derived and/or modified sequence opt4 from anti-influenza_CDR
  source 1..42: mol_type = other RNA
tgggtgagacagccccccggcaagggcctggagtgggtggcc

SEQ ID NO: 37821 - RNA, 42 nt, synthetic construct
  misc_feature 1..42: note = derived and/or modified sequence opt4 from anti-influenza_CDR
  source 1..42: mol_type = other RNA
gccagaggccccgagggcgtgtggggcagaagcatcgacagc

SEQ ID NO: 37822 - RNA, 42 nt, synthetic construct
  misc_feature 1..42: note = derived and/or modified sequence opt4 from anti-influenza_CDR
  source 1..42: mol_type = other RNA
gccagagaccccgacacccccttcgtgagagccttcgacagc

SEQ ID NO: 37823 - RNA, 42 nt, synthetic construct
  misc_feature 1..42: note = derived and/or modified sequence opt4 from anti-influenza_CDR
  source 1..42: mol_type = other RNA
accggcagcaccagcgacatcggcagctacaactacgtgagc

SEQ ID NO: 37824 - RNA, 42 nt, synthetic construct
  misc_feature 1..42: note = derived and/or modified sequence opt4 from anti-influenza_CDR
  source 1..42: mol_type = other RNA
tgggactggaacttcgacctgtacctgggctggttcgacccc

SEQ ID NO: 37825 - RNA, 42 nt, synthetic construct; identical to SEQ ID NO: 14899
  misc_feature 1..42: note = derived and/or modified sequence opt4 from anti-influenza_CDR
  source 1..42: mol_type = other RNA

SEQ ID NO: 37826 - RNA, 42 nt, synthetic construct
  misc_feature 1..42: note = derived and/or modified sequence opt4 from anti-influenza_CDR
  source 1..42: mol_type = other RNA
ggccccggctacagcggctaccactacggctggttcgacacc

SEQ ID NO: 37827 - RNA, 42 nt, synthetic construct
  misc_feature 1..42: note = derived and/or modified sequence opt4 from anti-influenza_CDR
  source 1..42: mol_type = other RNA
gccagatgggactacggcgtgtacgagggctacatcgactac

SEQ ID NO: 37828 - RNA, 45 nt, synthetic construct
  misc_feature 1..45: note = derived and/or modified sequence opt4 from anti-influenza_CDR
  source 1..45: mol_type = other RNA
gccagagccggcaccaccctgaccagattcaactggttcgacccc

SEQ ID NO: 37829 - RNA, 45 nt, synthetic construct
  misc_feature 1..45: note = derived and/or modified sequence opt4 from anti-influenza_CDR
  source 1..45: mol_type = other RNA
gccagagccggcaccaccgtgaccagattcaactggttcgacccc

SEQ ID NO: 37830 - RNA, 45 nt, synthetic construct
  misc_feature 1..45: note = derived and/or modified sequence opt4 from anti-influenza_CDR
  source 1..45: mol_type = other RNA
gccagaggccagagatactactacgacagagacggcatggacgtg

SEQ ID NO: 37831 - RNA, 45 nt, synthetic construct
  misc_feature 1..45: note = derived and/or modified sequence opt4 from anti-influenza_CDR
  source 1..45: mol_type = other RNA
gccagaagcggcggctacctgccccagaacaactggatcgacccc

SEQ ID NO: 37832 - RNA, 45 nt, synthetic construct
  misc_feature 1..45: note = derived and/or modified sequence opt4 from anti-influenza_CDR
  source 1..45: mol_type = other RNA
atggagaacgagagaaccctggacttccacgacagcaacgtgaag

SEQ ID NO: 37833 - RNA, 45 nt, synthetic construct
  misc_feature 1..45: note = derived and/or modified sequence opt4 from anti-influenza_CDR
  source 1..45: mol_type = other RNA
ggcgccgaccacggcagcggcagcaacttcgtgagcccctacgtg

SEQ ID NO: 37834 - RNA, 45 nt, synthetic construct
  misc_feature 1..45: note = derived and/or modified sequence opt4 from anti-influenza_CDR
  source 1..45: mol_type = other RNA
gacaccagaagcagcctggacaactaccagtacggcatggacgtg

SEQ ID NO: 37835 - RNA, 45 nt, synthetic construct
  misc_feature 1..45: note = derived and/or modified sequence opt4 from anti-influenza_CDR
  source 1..45: mol_type = other RNA
gaggactacgacatcctgaccggcgccggccccggcatggaggtg

SEQ ID NO: 37836 - RNA, 45 nt, synthetic construct
  misc_feature 1..45: note = derived and/or modified sequence opt4 from anti-influenza_CDR
  source 1..45: mol_type = other RNA
cacccctacgacgtgctgaccggcagcggcgactggttcgacccc

SEQ ID NO: 37837 - RNA, 45 nt, synthetic construct
  misc_feature 1..45: note = derived and/or modified sequence opt4 from anti-influenza_CDR
  source 1..45: mol_type = other RNA
ggcgccgaccacggcagcggcaacaacttcgtgagcccctacgtg

SEQ ID NO: 37838 - RNA, 45 nt, synthetic construct
  misc_feature 1..45: note = derived and/or modified sequence opt4 from anti-influenza_CDR
  source 1..45: mol_type = other RNA
gtgatctacagcggcggcagcacctactacgccgacagcgtgaag

SEQ ID NO: 37839 - RNA, 45 nt, synthetic construct
  misc_feature 1..45: note = derived and/or modified sequence opt4 from anti-influenza_CDR
  source 1..45: mol_type = other RNA
tggtaccagcagaagcccggcaaggcccccaagctgctgatctac

SEQ ID NO: 37840 - RNA, 45 nt, synthetic construct; identical to SEQ ID NO: 22556
  misc_feature 1..45: note = derived and/or modified sequence opt4 from anti-influenza_CDR
  source 1..45: mol_type = other RNA

SEQ ID NO: 37841 - RNA, 45 nt, synthetic construct
  misc_feature 1..45: note = derived and/or modified sequence opt4 from anti-influenza_CDR
  source 1..45: mol_type = other RNA
gccagagcccacaccgccctgaccagattcagatggctggacccc

SEQ ID NO: 37842 - RNA, 45 nt, synthetic construct
  misc_feature 1..45: note = derived and/or modified sequence opt4 from anti-influenza_CDR
  source 1..45: mol_type = other RNA
gccagcctggactacgacttcagctactactaccacagagacgtg

SEQ ID NO: 37843 - RNA, 45 nt, synthetic construct
  misc_feature 1..45: note = derived and/or modified sequence opt4 from anti-influenza_CDR
  source 1..45: mol_type = other RNA
gccagagtggccaccccctactactacgagagcggcttcgactac

SEQ ID NO: 37844 - RNA, 45 nt, synthetic construct
  misc_feature 1..45: note = derived and/or modified sequence opt4 from anti-influenza_CDR
  source 1..45: mol_type = other RNA
gccagaagaggcggcggctggcagtactactacggcatggacgtg

SEQ ID NO: 37845 - RNA, 48 nt, synthetic construct
  misc_feature 1..48: note = derived and/or modified sequence opt4 from anti-influenza_CDR
  source 1..48: mol_type = other RNA
agcggccacatcaccgtgttcggcgtgaacgtggacgccttcgacatg

SEQ ID NO: 37846 - RNA, 48 nt, synthetic construct
  misc_feature 1..48: note = derived and/or modified sequence opt4 from anti-influenza_CDR
  source 1..48: mol_type = other RNA
ggcggccacatcaccgtgttcggcctgaacatcgacgcctacgacatc

SEQ ID NO: 37847 - RNA, 48 nt, synthetic construct
  misc_feature 1..48: note = derived and/or modified sequence opt4 from anti-influenza_CDR
  source 1..48: mol_type = other RNA
ggcggccacatcaccgagttcggcctgaacatcgacgcctacgacatc

SEQ ID NO: 37848 - RNA, 48 nt, synthetic construct
  misc_feature 1..48: note = derived and/or modified sequence opt4 from anti-influenza_CDR
  source 1..48: mol_type = other RNA
ggcggccacatcaccgtgttcggcgtgaacatcgacgccttcgacatc

SEQ ID NO: 37849 - RNA, 48 nt, synthetic construct
  misc_feature 1..48: note = derived and/or modified sequence opt4 from anti-influenza_CDR
  source 1..48: mol_type = other RNA
ggcggccacatcaccgtgttcggcgtgaacatcgacgccttcgacgtg

SEQ ID NO: 37850 - RNA, 48 nt, synthetic construct
  misc_feature 1..48: note = derived and/or modified sequence opt4 from anti-influenza_CDR
  source 1..48: mol_type = other RNA
gccagagacggctggggccagcagctggtgccctactacttcgactac

SEQ ID NO: 37851 - RNA, 48 nt, synthetic construct
  misc_feature 1..48: note = derived and/or modified sequence opt4 from anti-influenza_CDR
  source 1..48: mol_type = other RNA
gacttctgggtgagctactactacgacagcagcgccccccccgccatc

SEQ ID NO: 37852 - RNA, 48 nt, synthetic construct
  misc_feature 1..48: note = derived and/or modified sequence opt4 from anti-influenza_CDR
  source 1..48: mol_type = other RNA
gccagagccggcgtgaagatcttcggcctgatcgtgggcgccctggac

SEQ ID NO: 37853 - RNA, 48 nt, synthetic construct
  misc_feature 1..48: note = derived and/or modified sequence opt4 from anti-influenza_CDR
  source 1..48: mol_type = other RNA
gccagagacggcgccggcagctactaccccctgaactggttcgacccc

SEQ ID NO: 37854 - RNA, 48 nt, synthetic construct
  misc_feature 1..48: note = derived and/or modified sequence opt4 from anti-influenza_CDR
  source 1..48: mol_type = other RNA
gtgatctacagccacggcagagcctactacagcgccagcgtgaacggc

SEQ ID NO: 37855 - RNA, 48 nt, synthetic construct
  misc_feature 1..48: note = derived and/or modified sequence opt4 from anti-influenza_CDR
  source 1..48: mol_type = other RNA
gacaccctgcacaacggctacaccaactacaaccccagcctgagaggc

SEQ ID NO: 37856 - RNA, 48 nt, synthetic construct
  misc_feature 1..48: note = derived and/or modified sequence opt4 from anti-influenza_CDR
  source 1..48: mol_type = other RNA
tacatcagctacaacggcagacccaagtacaaccccagcctgaccagc

SEQ ID NO: 37857 - RNA, 48 nt, synthetic construct
  misc_feature 1..48: note = derived and/or modified sequence opt4 from anti-influenza_CDR
  source 1..48: mol_type = other RNA
gagaccagattcggcgagctgctgagcccctacgacgccttcgagatc

SEQ ID NO: 37858 - RNA, 48 nt, synthetic construct
  misc_feature 1..48: note = derived and/or modified sequence opt4 from anti-influenza_CDR
  source 1..48: mol_type = other RNA
ctgatctactgggacgacgacaagagatacagccccagcctgaagaga

SEQ ID NO: 37859 - RNA, 48 nt, synthetic construct
  misc_feature 1..48: note = derived and/or modified sequence opt4 from anti-influenza_CDR
  source 1..48: mol_type = other RNA
tacatctactacatcggcaacaccgactacagacccagcctgaagagc

SEQ ID NO: 37860 - RNA, 48 nt, synthetic construct
  misc_feature 1..48: note = derived and/or modified sequence opt4 from anti-influenza_CDR
  source 1..48: mol_type = other RNA
gagatcagccacggcggcagcaccaactacaaccccagcctgaagagc

SEQ ID NO: 37861 - RNA, 48 nt, synthetic construct
  misc_feature 1..48: note = derived and/or modified sequence opt4 from anti-influenza_CDR
  source 1..48: mol_type = other RNA
gagatcaaccacagcggcagaaccaactacaaccccagcctgaagagc

SEQ ID NO: 37862 - RNA, 48 nt, synthetic construct
  misc_feature 1..48: note = derived and/or modified sequence opt4 from anti-influenza_CDR
  source 1..48: mol_type = other RNA
ctgatcagctgggacgacgagaagcactacagccccagcctgcagagc

SEQ ID NO: 37863 - RNA, 48 nt, synthetic construct
  misc_feature 1..48: note = derived and/or modified sequence opt4 from anti-influenza_CDR
  source 1..48: mol_type = other RNA
gagggcgtgtacttcgacagcggcacctacagaggctacttcgactac

SEQ ID NO: 37864 - RNA, 48 nt, synthetic construct
  misc_feature 1..48: note = derived and/or modified sequence opt4 from anti-influenza_CDR
  source 1..48: mol_type = other RNA
tacatctaccacagcggcagcaccaactacaaccccagcctgaagagc

SEQ ID NO: 37865 - RNA, 48 nt, synthetic construct
  misc_feature 1..48: note = derived and/or modified sequence opt4 from anti-influenza_CDR
  source 1..48: mol_type = other RNA
tacatctactacagaggcagcaccttctacaaccccagcctgaagagc

SEQ ID NO: 37866 - RNA, 48 nt, synthetic construct
  misc_feature 1..48: note = derived and/or modified sequence opt4 from anti-influenza_CDR
  source 1..48: mol_type = other RNA
tacatcagctacagcggcagcaccaagtacaaccccagcctgagaagc

SEQ ID NO: 37867 - RNA, 48 nt, synthetic construct
  misc_feature 1..48: note = derived and/or modified sequence opt4 from anti-influenza_CDR
  source 1..48: mol_type = other RNA
gagatcaagcacagcggcagaaccaactacaaccccagcctggagagc

SEQ ID NO: 37868 - RNA, 48 nt, synthetic construct
  misc_feature 1..48: note = derived and/or modified sequence opt4 from anti-influenza_CDR
  source 1..48: mol_type = other RNA
gagatcaaccacagcggcggcaccaactacaaccccagcctgaagaga

SEQ ID NO: 37869 - RNA, 48 nt, synthetic construct
  misc_feature 1..48: note = derived and/or modified sequence opt4 from anti-influenza_CDR
  source 1..48: mol_type = other RNA
ttcatgtactacagcgccagcacctactacaaccccagcctgaagagc

SEQ ID NO: 37870 - RNA, 48 nt, synthetic construct
  misc_feature 1..48: note = derived and/or modified sequence opt4 from anti-influenza_CDR
  source 1..48: mol_type = other RNA
tacgtgtactacagcggcagcaccacctacaaccccagcctgaagagc

SEQ ID NO: 37871 - RNA, 48 nt, synthetic construct
  misc_feature 1..48: note = derived and/or modified sequence opt4 from anti-influenza_CDR
  source 1..48: mol_type = other RNA
aacatctactacaccggcatcaccttctacaaccccagcctgagcagc

SEQ ID NO: 37872 - RNA, 48 nt, synthetic construct
  misc_feature 1..48: note = derived and/or modified sequence opt4 from anti-influenza_CDR
  source 1..48: mol_type = other RNA
ttcatctactacggcggcaacaccaagtacaaccccagcctgaagagc

SEQ ID NO: 37873 - RNA, 48 nt, synthetic construct
  misc_feature 1..48: note = derived and/or modified sequence opt4 from anti-influenza_CDR
  source 1..48: mol_type = other RNA
ttcatgttccacagcggcagccccagatacaaccccaccctgaagagc

SEQ ID NO: 37874 - RNA, 48 nt, synthetic construct
  misc_feature 1..48: note = derived and/or modified sequence opt4 from anti-influenza_CDR
  source 1..48: mol_type = other RNA
ttcttctacaacggcggcagcaccaagtacaaccccagcctgaagagc

SEQ ID NO: 37875 - RNA, 48 nt, synthetic construct
  misc_feature 1..48: note = derived and/or modified sequence opt4 from anti-influenza_CDR
  source 1..48: mol_type = other RNA
cacatctacgactacggcagaaccttctacaacagcagcctgcagagc

SEQ ID NO: 37876 - RNA, 48 nt, synthetic construct
  misc_feature 1..48: note = derived and/or modified sequence opt4 from anti-influenza_CDR
  source 1..48: mol_type = other RNA
gtgttctacagcgagaccagaacctactacgccgacagcgtgaagggc

SEQ ID NO: 37877 - RNA, 48 nt, synthetic construct
  misc_feature 1..48: note = derived and/or modified sequence opt4 from anti-influenza_CDR
  source 1..48: mol_type = other RNA
tacgtgtacaacagaggcagcaccaagtacagccccagcctgaagagc

SEQ ID NO: 37878 - RNA, 48 nt, synthetic construct
  misc_feature 1..48: note = derived and/or modified sequence opt4 from anti-influenza_CDR
  source 1..48: mol_type = other RNA
tacatctacaacagaggcagcaccaagtacacccccagcctgaagagc

SEQ ID NO: 37879 - RNA, 48 nt, synthetic construct
  misc_feature 1..48: note = derived and/or modified sequence opt4 from anti-influenza_CDR
  source 1..48: mol_type = other RNA
tacctgtactacagcggcagcaccaagtacaaccccagcctgaagagc

SEQ ID NO: 37880 - RNA, 48 nt, synthetic construct
  misc_feature 1..48: note = derived and/or modified sequence opt4 from anti-influenza_CDR
  source 1..48: mol_type = other RNA
tacgtgtacaacagcggcaacaccaagtacaaccccagcctgaagagc

SEQ ID NO: 37881 - RNA, 48 nt, synthetic construct
  misc_feature 1..48: note = derived and/or modified sequence opt4 from anti-influenza_CDR
  source 1..48: mol_type = other RNA
cacatcttcgacagcggcagcacctactacaaccccagcctgaagagc

SEQ ID NO: 37882 - RNA, 48 nt, synthetic construct
  misc_feature 1..48: note = derived and/or modified sequence opt4 from anti-influenza_CDR
  source 1..48: mol_type = other RNA
gtgttctacagcgccgacagaaccagctacgccgacagcgtgaagggc

SEQ ID NO: 37883 - RNA, 48 nt, synthetic construct
  misc_feature 1..48: note = derived and/or modified sequence opt4 from anti-influenza_CDR
  source 1..48: mol_type = other RNA
tacatctactacagcggcaacacctactacaaccccagcctgaagagc

SEQ ID NO: 37884 - RNA, 48 nt, synthetic construct
  misc_feature 1..48: note = derived and/or modified sequence opt4 from anti-influenza_CDR
  source 1..48: mol_type = other RNA
agaagcagccagagcctgctgcacagcaacggctacaactacctggac

SEQ ID NO: 37885 - RNA, 48 nt, synthetic construct
  misc_feature 1..48: note = derived and/or modified sequence opt4 from anti-influenza_CDR
  source 1..48: mol_type = other RNA
accatctaccacagcggcagcacctactacaaccccagcctgaagagc

SEQ ID NO: 37886 - RNA, 48 nt, synthetic construct
  misc_feature 1..48: note = derived and/or modified sequence opt4 from anti-influenza_CDR
  source 1..48: mol_type = other RNA
agaagcagccagagcctgctgcacagcaacggccacatctacttcgac

SEQ ID NO: 37887 - RNA, 48 nt, synthetic construct
  misc_feature 1..48: note = derived and/or modified sequence opt4 from anti-influenza_CDR
  source 1..48: mol_type = other RNA
atctggggcgtggccgcccccagcaccgccagcgcccagaccagcctg

SEQ ID NO: 37888 - RNA, 48 nt, synthetic construct
  misc_feature 1..48: note = derived and/or modified sequence opt4 from anti-influenza_CDR
  source 1..48: mol_type = other RNA
agaagcagccagagcctgctgtacaccgacggcttcacctacctgagc

SEQ ID NO: 37889 - RNA, 48 nt, synthetic construct
  misc_feature 1..48: note = derived and/or modified sequence opt4 from anti-influenza_CDR
  source 1..48: mol_type = other RNA
gccaagcccagactggactacctggactacttccacgccgccgacagc

SEQ ID NO: 37890 - RNA, 48 nt, synthetic construct
  misc_feature 1..48: note = derived and/or modified sequence opt4 from anti-influenza_CDR
  source 1..48: mol_type = other RNA
gccagaagccccggctacagcggctacctgtacggctggttcgacccc

SEQ ID NO: 37891 - RNA, 48 nt, synthetic construct
  misc_feature 1..48: note = derived and/or modified sequence opt4 from anti-influenza_CDR
  source 1..48: mol_type = other RNA
gccatcgccggcagcggcagcgccgactacgccagctgggccaagggc

SEQ ID NO: 37892 - RNA, 48 nt, synthetic construct
  misc_feature 1..48: note = derived and/or modified sequence opt4 from anti-influenza_CDR
  source 1..48: mol_type = other RNA
gccatcgccggcagcggcagcgccgactacgccagctgggccaagagc

SEQ ID NO: 37893 - RNA, 48 nt, synthetic construct
  misc_feature 1..48: note = derived and/or modified sequence opt4 from anti-influenza_CDR
  source 1..48: mol_type = other RNA
gccatcggcggcggcggcagcgccgactacgccagctgggccaagagc

SEQ ID NO: 37894 - RNA, 48 nt, synthetic construct
  misc_feature 1..48: note = derived and/or modified sequence opt4 from anti-influenza_CDR
  source 1..48: mol_type = other RNA
agaagcagccagagcctgctgagaagcaacggctacaactacctggac

SEQ ID NO: 37895 - RNA, 48 nt, synthetic construct
  misc_feature 1..48: note = derived and/or modified sequence opt4 from anti-influenza_CDR
  source 1..48: mol_type = other RNA
cagggcgaccacatcgcctggctgctgagaggcatcaacttcgactac

SEQ ID NO: 37896 - RNA, 51 nt, synthetic construct
  misc_feature 1..51: note = derived and/or modified sequence opt4 from anti-influenza_CDR
  source 1..51: mol_type = other RNA
gccagactgggcagcggcagctaccacaacggccccaactggttcgacccc

SEQ ID NO: 37897 - RNA, 51 nt, synthetic construct
  misc_feature 1..51: note = derived and/or modified sequence opt4 from anti-influenza_CDR
  source 1..51: mol_type = other RNA
gccagagccgagaacctgctgagcccctacctggccgagggcttcgacccc

SEQ ID NO: 37898 - RNA, 51 nt, synthetic construct
  misc_feature 1..51: note = derived and/or modified sequence opt4 from anti-influenza_CDR
  source 1..51: mol_type = other RNA
gtgatcagctacgacggcagcaacaagtactacgccgacagcgtgaagggc

SEQ ID NO: 37899 - RNA, 51 nt, synthetic construct
  misc_feature 1..51: note = derived and/or modified sequence opt4 from anti-influenza_CDR
  source 1..51: mol_type = other RNA
ggcaccatccccctgctgggcaccaccaactacgcccagaagttccagggc

SEQ ID NO: 37900 - RNA, 51 nt, synthetic construct
  misc_feature 1..51: note = derived and/or modified sequence opt4 from anti-influenza_CDR
  source 1..51: mol_type = other RNA
ggcatcatcgccgtgttcaacaccgccaactacgcccagaagttccagggc

SEQ ID NO: 37901 - RNA, 51 nt, synthetic construct
  misc_feature 1..51: note = derived and/or modified sequence opt4 from anti-influenza_CDR
  source 1..51: mol_type = other RNA
aacatcgaggacgacggcggcgacaagtactacgtggacagcgtgaagggc

SEQ ID NO: 37902 - RNA, 51 nt, synthetic construct
  misc_feature 1..51: note = derived and/or modified sequence opt4 from anti-influenza_CDR
  source 1..51: mol_type = other RNA
tggatcaaccccaacagcggcaccaccggcagcgcccagagattccagggc

SEQ ID NO: 37903 - RNA, 51 nt, synthetic construct
  misc_feature 1..51: note = derived and/or modified sequence opt4 from anti-influenza_CDR
  source 1..51: mol_type = other RNA
ggcatcaaccccgtgttcggcagaccccactacgcccagaagttccagggc

SEQ ID NO: 37904 - RNA, 51 nt, synthetic construct
  misc_feature 1..51: note = derived and/or modified sequence opt4 from anti-influenza_CDR
  source 1..51: mol_type = other RNA
ggcatcatccccctgatcaacgcccccaactacgcccccaagttccagggc

SEQ ID NO: 37905 - RNA, 51 nt, synthetic construct
  misc_feature 1..51: note = derived and/or modified sequence opt4 from anti-influenza_CDR
  source 1..51: mol_type = other RNA
ggcatcatccccatgatgggcaccgtgaactacgcccagaagctgcagggc

SEQ ID NO: 37906 - RNA, 51 nt, synthetic construct
  misc_feature 1..51: note = derived and/or modified sequence opt4 from anti-influenza_CDR
  source 1..51: mol_type = other RNA
ggcatcatccccctgttcggcgccgccaagtacgcccagaagttccagggc

SEQ ID NO: 37907 - RNA, 51 nt, synthetic construct
  misc_feature 1..51: note = derived and/or modified sequence opt4 from anti-influenza_CDR
  source 1..51: mol_type = other RNA
aagagcagccagagagtgctgtacagcagcaacaacaagaactacctggcc

SEQ ID NO: 37908 - RNA, 51 nt, synthetic construct
  misc_feature 1..51: note = derived and/or modified sequence opt4 from anti-influenza_CDR
  source 1..51: mol_type = other RNA
ctgatcagcgacgacggcagcaacaagttctacgccgacagcgtgaagggc

SEQ ID NO: 37909 - RNA, 51 nt, synthetic construct
  misc_feature 1..51: note = derived and/or modified sequence opt4 from anti-influenza_CDR
  source 1..51: mol_type = other RNA
atcatcagctacgacggcaacgaccagtactacaccgacagcgtgaagggc

SEQ ID NO: 37910 - RNA, 51 nt, synthetic construct
  misc_feature 1..51: note = derived and/or modified sequence opt4 from anti-influenza_CDR
  source 1..51: mol_type = other RNA
tggatcagcacctacaacggcaacaccaacttcgcccagaacttccagggc

SEQ ID NO: 37911 - RNA, 51 nt, synthetic construct
  misc_feature 1..51: note = derived and/or modified sequence opt4 from anti-influenza_CDR
  source 1..51: mol_type = other RNA
gtggagggcagctacagagacttctggaacaaccagaacagattcgacccc

SEQ ID NO: 37912 - RNA, 51 nt, synthetic construct
  misc_feature 1..51: note = derived and/or modified sequence opt4 from anti-influenza_CDR
  source 1..51: mol_type = other RNA
tggatcaaccccaacagcggcgacaccaactacgcccagaagttccagggc

SEQ ID NO: 37913 - RNA, 51 nt, synthetic construct
  misc_feature 1..51: note = derived and/or modified sequence opt4 from anti-influenza_CDR
  source 1..51: mol_type = other RNA
aagagcagccagagcgtgctgtacagcagcaacaacaagagccacctggcc

SEQ ID NO: 37914 - RNA, 51 nt, synthetic construct
  misc_feature 1..51: note = derived and/or modified sequence opt4 from anti-influenza_CDR
  source 1..51: mol_type = other RNA
atcatctaccccggcgacagcgacaccagatacagccccagcttccagggc

SEQ ID NO: 37915 - RNA, 51 nt, synthetic construct
  misc_feature 1..51: note = derived and/or modified sequence opt4 from anti-influenza_CDR
  source 1..51: mol_type = other RNA
ggcatcatccccgtgttccccacccccaactacgcccagatgttccagggc

SEQ ID NO: 37916 - RNA, 51 nt, synthetic construct
  misc_feature 1..51: note = derived and/or modified sequence opt4 from anti-influenza_CDR
  source 1..51: mol_type = other RNA
ggcatcgtgcccgtgttcggcaccgccaactacgcccagaagttccagggc

SEQ ID NO: 37917 - RNA, 51 nt, synthetic construct
  misc_feature 1..51: note = derived and/or modified sequence opt4 from anti-influenza_CDR
  source 1..51: mol_type = other RNA
tggatcaaccccgagagcggcgacaccaagtacgcccagaagttccagggc

SEQ ID NO: 37918 - RNA, 51 nt, synthetic construct
  misc_feature 1..51: note = derived and/or modified sequence opt4 from anti-influenza_CDR
  source 1..51: mol_type = other RNA
agaagcagccagagcatcttccacaacagcaacaacgagaactacctggcc

SEQ ID NO: 37919 - RNA, 51 nt, synthetic construct
  misc_feature 1..51: note = derived and/or modified sequence opt4 from anti-influenza_CDR
  source 1..51: mol_type = other RNA
tggatcaacgccaagagaggcggcaccaactacgcccagaagttccagggc

SEQ ID NO: 37920 - RNA, 51 nt, synthetic construct
  misc_feature 1..51: note = derived and/or modified sequence opt4 from anti-influenza_CDR
  source 1..51: mol_type = other RNA
tggatcaaccccgacagcggcgccaccagcagcgcccagaacttccagggc

SEQ ID NO: 37921 - RNA, 51 nt, synthetic construct
  misc_feature 1..51: note = derived and/or modified sequence opt4 from anti-influenza_CDR
  source 1..51: mol_type = other RNA
tggatcagccccgacagcgacgccaccaagtacgcccagaagttccagggc

SEQ ID NO: 37922 - RNA, 51 nt, synthetic construct
  misc_feature 1..51: note = derived and/or modified sequence opt4 from anti-influenza_CDR
  source 1..51: mol_type = other RNA
aacatcaagcaggacggcagagagaagtactacgtggacagcctgagaggc

SEQ ID NO: 37923 - RNA, 51 nt, synthetic construct; identical to SEQ ID NO: 22639
  misc_feature 1..51: note = derived and/or modified sequence opt4 from anti-influenza_CDR
  source 1..51: mol_type = other RNA

SEQ ID NO: 37924 - RNA, 51 nt, synthetic construct
  misc_feature 1..51: note = derived and/or modified sequence opt4 from anti-influenza_CDR
  source 1..51: mol_type = other RNA
aagagcagccagagcatcctgaacagcagcaacaacaagaactacctggcc

SEQ ID NO: 37925 - RNA, 51 nt, synthetic construct
  misc_feature 1..51: note = derived and/or modified sequence opt4 from anti-influenza_CDR
  source 1..51: mol_type = other RNA
tggatcagcgcctacaacggcaacaccaactacgcccagaagttccagggc

SEQ ID NO: 37926 - RNA, 51 nt, synthetic construct
  misc_feature 1..51: note = derived and/or modified sequence opt4 from anti-influenza_CDR
  source 1..51: mol_type = other RNA
ggcgtgatccccatcttcagaaccgccaactacgcccagaacttccagggc

SEQ ID NO: 37927 - RNA, 51 nt, synthetic construct; identical to SEQ ID NO: 22643
  misc_feature 1..51: note = derived and/or modified sequence opt4 from anti-influenza_CDR
  source 1..51: mol_type = other RNA

SEQ ID NO: 37928 - RNA, 51 nt, synthetic construct
  misc_feature 1..51: note = derived and/or modified sequence opt4 from anti-influenza_CDR
  source 1..51: mol_type = other RNA
ggcatcagccccatgttcggcaccaccacctacgcccagaagttccagggc

SEQ ID NO: 37929 - RNA, 51 nt, synthetic construct
  misc_feature 1..51: note = derived and/or modified sequence opt4 from anti-influenza_CDR
  source 1..51: mol_type = other RNA
aagagcagccagagcgtgctgtacagcagcaacaacaagaactacctggcc

SEQ ID NO: 37930 - RNA, 51 nt, synthetic construct; identical to SEQ ID NO: 22646
  misc_feature 1..51: note = derived and/or modified sequence opt4 from anti-influenza_CDR
  source 1..51: mol_type = other RNA

SEQ ID NO: 37931 - RNA, 51 nt, synthetic construct
  misc_feature 1..51: note = derived and/or modified sequence opt4 from anti-influenza_CDR
  source 1..51: mol_type = other RNA
ggcatcagccccctgttcggcaccaccaactacgcccagaagttccagggc

SEQ ID NO: 37932 - RNA, 51 nt, synthetic construct; identical to SEQ ID NO: 22648
  misc_feature 1..51: note = derived and/or modified sequence opt4 from anti-influenza_CDR
  source 1..51: mol_type = other RNA

SEQ ID NO: 37933 - RNA, 51 nt, synthetic construct
  misc_feature 1..51: note = derived and/or modified sequence opt4 from anti-influenza_CDR
  source 1..51: mol_type = other RNA
ggcatcatcggcatgttcggcagcaccaactacgcccagaacttccagggc

SEQ ID NO: 37934 - RNA, 51 nt, synthetic construct
  misc_feature 1..51: note = derived and/or modified sequence opt4 from anti-influenza_CDR
  source 1..51: mol_type = other RNA
tggatcaaccccaacagcggcggcaccaactacgcccagaagttccagggc

SEQ ID NO: 37935 - RNA, 51 nt, synthetic construct
  misc_feature 1..51: note = derived and/or modified sequence opt4 from anti-influenza_CDR
  source 1..51: mol_type = other RNA
gccatcagcagcagcggcgacagcacctactacgccgacagcgtgaagggc

SEQ ID NO: 37936 - RNA, 51 nt, synthetic construct
  misc_feature 1..51: note = derived and/or modified sequence opt4 from anti-influenza_CDR
  source 1..51: mol_type = other RNA
agcatcagcagcagcagcagctacatctactacgtggacagcgtgaagggc

SEQ ID NO: 37937 - RNA, 51 nt, synthetic construct
  misc_feature 1..51: note = derived and/or modified sequence opt4 from anti-influenza_CDR
  source 1..51: mol_type = other RNA
gacatcatcggcatgttcggcagcaccaactacgcccagaacttccagggc

SEQ ID NO: 37938 - RNA, 51 nt, synthetic construct; identical to SEQ ID NO: 22654
  misc_feature 1..51: note = derived and/or modified sequence opt4 from anti-influenza_CDR
  source 1..51: mol_type = other RNA

SEQ ID NO: 37939 - RNA, 51 nt, synthetic construct; identical to SEQ ID NO: 22655
  misc_feature 1..51: note = derived and/or modified sequence opt4 from anti-influenza_CDR
  source 1..51: mol_type = other RNA

SEQ ID NO: 37940 - RNA, 51 nt, synthetic construct; identical to SEQ ID NO: 22656
  misc_feature 1..51: note = derived and/or modified sequence opt4 from anti-influenza_CDR
  source 1..51: mol_type = other RNA

SEQ ID NO: 37941 - RNA, 51 nt, synthetic construct
  misc_feature 1..51: note = derived and/or modified sequence opt4 from anti-influenza_CDR
  source 1..51: mol_type = other RNA
ggcatcttcgccctgttcggcaccaccgactacgcccagaagttccagggc

SEQ ID NO: 37942 - RNA, 51 nt, synthetic construct; identical to SEQ ID NO: 22658
  misc_feature 1..51: note = derived and/or modified sequence opt4 from anti-influenza_CDR
  source 1..51: mol_type = other RNA

SEQ ID NO: 37943 - RNA, 51 nt, synthetic construct
  misc_feature 1..51: note = derived and/or modified sequence opt4 from anti-influenza_CDR
  source 1..51: mol_type = other RNA
ggcatcatcgccgtgttcggcaccaccaagtacgcccacaagttccagggc

SEQ ID NO: 37944 - RNA, 51 nt, synthetic construct
  misc_feature 1..51: note = derived and/or modified sequence opt4 from anti-influenza_CDR
  source 1..51: mol_type = other RNA
ggcatcctgggcgtgttcggcagccccagctacgcccagaagttccagggc

SEQ ID NO: 37945 - RNA, 51 nt, synthetic construct; identical to SEQ ID NO: 22661
  misc_feature 1..51: note = derived and/or modified sequence opt4 from anti-influenza_CDR
  source 1..51: mol_type = other RNA

SEQ ID NO: 37946 - RNA, 51 nt, synthetic construct
  misc_feature 1..51: note = derived and/or modified sequence opt4 from anti-influenza_CDR
  source 1..51: mol_type = other RNA
tggatcagcgcctacaccggcgacaccgactacgcccagaagttccagggc

SEQ ID NO: 37947 - RNA, 51 nt, synthetic construct
  misc_feature 1..51: note = derived and/or modified sequence opt4 from anti-influenza_CDR
  source 1..51: mol_type = other RNA
agcttcgaccccgaggacggcgagaccatctacgcccagaagttccagggc

SEQ ID NO: 37948 - RNA, 51 nt, synthetic construct
  misc_feature 1..51: note = derived and/or modified sequence opt4 from anti-influenza_CDR
  source 1..51: mol_type = other RNA
ggcatcagcggcagcggcgagagcacctactacgccgacagcgtgaagggc

SEQ ID NO: 37949 - RNA, 51 nt, synthetic construct
  misc_feature 1..51: note = derived and/or modified sequence opt4 from anti-influenza_CDR
  source 1..51: mol_type = other RNA
gtggtgagctacgacggcaactacaagtactacgccgacagcgtgcagggc

SEQ ID NO: 37950 - RNA, 51 nt, synthetic construct
  misc_feature 1..51: note = derived and/or modified sequence opt4 from anti-influenza_CDR
  source 1..51: mol_type = other RNA
ggcagcatcagctacagcggcagcacctactaccaccccagcctgaagagc

SEQ ID NO: 37951 - RNA, 51 nt, synthetic construct
  misc_feature 1..51: note = derived and/or modified sequence opt4 from anti-influenza_CDR
  source 1..51: mol_type = other RNA
accagaggcagacccatcggcagaaactgggagcccagagacaaggactac

SEQ ID NO: 37952 - RNA, 51 nt, synthetic construct
  misc_feature 1..51: note = derived and/or modified sequence opt4 from anti-influenza_CDR
  source 1..51: mol_type = other RNA
gccagagaggccggctaccacagcagcttcagcggcgtgtacttcgactac

SEQ ID NO: 37953 - RNA, 51 nt, synthetic construct
  misc_feature 1..51: note = derived and/or modified sequence opt4 from anti-influenza_CDR
  source 1..51: mol_type = other RNA
agaatcgaccccaacggcagcggcaccacctacgcccagaagttccagggc

SEQ ID NO: 37954 - RNA, 51 nt, synthetic construct
  misc_feature 1..51: note = derived and/or modified sequence opt4 from anti-influenza_CDR
  source 1..51: mol_type = other RNA
agaatcgaccccaacggcgccggcaccacctacgcccagaagttccagggc

SEQ ID NO: 37955 - RNA, 51 nt, synthetic construct; identical to SEQ ID NO: 22671
  misc_feature 1..51: note = derived and/or modified sequence opt4 from anti-influenza_CDR
  source 1..51: mol_type = other RNA

SEQ ID NO: 37956 - RNA, 51 nt, synthetic construct
  misc_feature 1..51: note = derived and/or modified sequence opt4 from anti-influenza_CDR
  source 1..51: mol_type = other RNA
atgatgtaccccggcgacagcgacaccatctacagccccagcttccagggc

SEQ ID NO: 37957 - RNA, 51 nt, synthetic construct
  misc_feature 1..51: note = derived and/or modified sequence opt4 from anti-influenza_CDR
  source 1..51: mol_type = other RNA
atgatgtaccccggcgacgccgacgccatctacagccccagcttccagggc

SEQ ID NO: 37958 - RNA, 51 nt, synthetic construct
  misc_feature 1..51: note = derived and/or modified sequence opt4 from anti-influenza_CDR
  source 1..51: mol_type = other RNA
atgatgtaccccggcgagagcgagaccatctacagccccagcttccagggc

SEQ ID NO: 37959 - RNA, 51 nt, synthetic construct
  misc_feature 1..51: note = derived and/or modified sequence opt4 from anti-influenza_CDR
  source 1..51: mol_type = other RNA
atgatgtaccccggcgacgccgacaccatctacagccccagcttccagggc

SEQ ID NO: 37960 - RNA, 51 nt, synthetic construct
  misc_feature 1..51: note = derived and/or modified sequence opt4 from anti-influenza_CDR
  source 1..51: mol_type = other RNA
atgatgtaccccggcagcagcgacaccatctacagccccagcttccagggc

SEQ ID NO: 37961 - RNA, 51 nt, synthetic construct
  misc_feature 1..51: note = derived and/or modified sequence opt4 from anti-influenza_CDR
  source 1..51: mol_type = other RNA
atgatgtaccccggcgacagcgacgccatctacagccccagcttccagggc

SEQ ID NO: 37962 - RNA, 51 nt, synthetic construct
  misc_feature 1..51: note = derived and/or modified sequence opt4 from anti-influenza_CDR
  source 1..51: mol_type = other RNA
atgatgtaccccggcgacaccgacaccatctacagccccagcttccagggc

SEQ ID NO: 37963 - RNA, 51 nt, synthetic construct
  misc_feature 1..51: note = derived and/or modified sequence opt4 from anti-influenza_CDR
  source 1..51: mol_type = other RNA
atgatgtaccccggcgagagcgacaccatctacagccccagcttccagggc

SEQ ID NO: 37964 - RNA, 51 nt, synthetic construct
  misc_feature 1..51: note = derived and/or modified sequence opt4 from anti-influenza_CDR
  source 1..51: mol_type = other RNA
gtgatcagctgggacagcggcagaatcggctacgccgacagcgtgaagggc

SEQ ID NO: 37965 - RNA, 51 nt, synthetic construct
  misc_feature 1..51: note = derived and/or modified sequence opt4 from anti-influenza_CDR
  source 1..51: mol_type = other RNA
gtgagaagcggcgcctactacttcaactacctggtgccctacttcgactac

SEQ ID NO: 37966 - RNA, 51 nt, synthetic construct
  misc_feature 1..51: note = derived and/or modified sequence opt4 from anti-influenza_CDR
  source 1..51: mol_type = other RNA
gtgagaagcggcgcctactacgtgaactacctggtgccctacttcgactac

SEQ ID NO: 37967 - RNA, 51 nt, synthetic construct
  misc_feature 1..51: note = derived and/or modified sequence opt4 from anti-influenza_CDR
  source 1..51: mol_type = other RNA
atcatcagctgggacagcggcagaatcggctacgccgacagcgtgagaggc

SEQ ID NO: 37968 - RNA, 51 nt, synthetic construct
  misc_feature 1..51: note = derived and/or modified sequence opt4 from anti-influenza_CDR
  source 1..51: mol_type = other RNA
cacggcggcgtgtactactacggcagcgccagcagcggctggttcgacccc

SEQ ID NO: 37969 - RNA, 54 nt, synthetic construct
  misc_feature 1..54: note = derived and/or modified sequence opt4 from anti-influenza_CDR
  source 1..54: mol_type = other RNA
agaacctactacagaagcaagtggtacaacgactacgccgagagcgtgaagagc

SEQ ID NO: 37970 - RNA, 54 nt, synthetic construct
  misc_feature 1..54: note = derived and/or modified sequence opt4 from anti-influenza_CDR
  source 1..54: mol_type = other RNA
agaacctactacagaagcaagtggtactacgactacgccgagagcgtgaagagc

SEQ ID NO: 37971 - RNA, 54 nt, synthetic construct
  misc_feature 1..54: note = derived and/or modified sequence opt4 from anti-influenza_CDR
  source 1..54: mol_type = other RNA
agaacctactacagaagcaagtggtacaacgactacgccgtgagcgtgaagagc

SEQ ID NO: 37972 - RNA, 54 nt, synthetic construct
  misc_feature 1..54: note = derived and/or modified sequence opt4 from anti-influenza_CDR
  source 1..54: mol_type = other RNA
agaacctactacagaagcaagtggtacaacgactacgccgacttcctgaagaga

SEQ ID NO: 37973 - RNA, 54 nt, synthetic construct
  misc_feature 1..54: note = derived and/or modified sequence opt4 from anti-influenza_CDR
  source 1..54: mol_type = other RNA
agaacctactacagaagcggctggtacaacgactacgccgagagcgtgaagagc

SEQ ID NO: 37974 - RNA, 54 nt, synthetic construct
  misc_feature 1..54: note = derived and/or modified sequence opt4 from anti-influenza_CDR
  source 1..54: mol_type = other RNA
gccagactgggcggcaacaaggactacggcgactacctgtggtacttcgacctg

SEQ ID NO: 37975 - RNA, 54 nt, synthetic construct
  misc_feature 1..54: note = derived and/or modified sequence opt4 from anti-influenza_CDR
  source 1..54: mol_type = other RNA
gccaaggacaccgccgaccacggcgactacgtggacctgggcttcttcgacgcc

SEQ ID NO: 37976 - RNA, 54 nt, synthetic construct
  misc_feature 1..54: note = derived and/or modified sequence opt4 from anti-influenza_CDR
  source 1..54: mol_type = other RNA
gccagaagcggcatcttcgactggagcgcccccctggtggaggccttcgacatc

SEQ ID NO: 37977 - RNA, 54 nt, synthetic construct
  misc_feature 1..54: note = derived and/or modified sequence opt4 from anti-influenza_CDR
  source 1..54: mol_type = other RNA
gccagacacgccagctgcagcgccagaagctgctactggggccccgtggactac

SEQ ID NO: 37978 - RNA, 54 nt, synthetic construct
  misc_feature 1..54: note = derived and/or modified sequence opt4 from anti-influenza_CDR
  source 1..54: mol_type = other RNA
gacgccccccccaacgtggaggtggccagcatgaccaactggtacttcgacctg

SEQ ID NO: 37979 - RNA, 54 nt, synthetic construct
  misc_feature 1..54: note = derived and/or modified sequence opt4 from anti-influenza_CDR
  source 1..54: mol_type = other RNA
ctgagaaccgactacggcgaccccgacagcgtgtactactacggcatggacgtg

SEQ ID NO: 37980 - RNA, 54 nt, synthetic construct
  misc_feature 1..54: note = derived and/or modified sequence opt4 from anti-influenza_CDR
  source 1..54: mol_type = other RNA
ggcacctgcgccggcgactgcagcctgcactactactactacggcctggacgtg

SEQ ID NO: 37981 - RNA, 54 nt, synthetic construct
  misc_feature 1..54: note = derived and/or modified sequence opt4 from anti-influenza_CDR
  source 1..54: mol_type = other RNA
cacgtgagcgtgagccacggcggcagaaccaagagcaaccccagcgtgatgagc

SEQ ID NO: 37982 - RNA, 54 nt, synthetic construct
  misc_feature 1..54: note = derived and/or modified sequence opt4 from anti-influenza_CDR
  source 1..54: mol_type = other RNA
gccctgatctacttcgacggcagcaagcagtactacgccgacagcgtgaagggc

SEQ ID NO: 37983 - RNA, 54 nt, synthetic construct
  misc_feature 1..54: note = derived and/or modified sequence opt4 from anti-influenza_CDR
  source 1..54: mol_type = other RNA
accctgatcagctacgacggcgccaaccagtactacgccgacagcgtgaagggc

SEQ ID NO: 37984 - RNA, 54 nt, synthetic construct
  misc_feature 1..54: note = derived and/or modified sequence opt4 from anti-influenza_CDR
  source 1..54: mol_type = other RNA
gccgtgcccggccccgtgttcggcatcttccccccctggagctacttcgacaac

SEQ ID NO: 37985 - RNA, 54 nt, synthetic construct; identical to SEQ ID NO: 22701
  misc_feature 1..54: note = derived and/or modified sequence opt4 from anti-influenza_CDR
  source 1..54: mol_type = other RNA

SEQ ID NO: 37986 - RNA, 54 nt, synthetic construct
  misc_feature 1..54: note = derived and/or modified sequence opt4 from anti-influenza_CDR
  source 1..54: mol_type = other RNA
ggctggatcagcgcctacaccggcaacacccactacgccaagaacttcgagggc

SEQ ID NO: 37987 - RNA, 54 nt, synthetic construct
  misc_feature 1..54: note = derived and/or modified sequence opt4 from anti-influenza_CDR
  source 1..54: mol_type = other RNA
ggctggatcaaccccaacttcggcggcacccactacgccagaaagttccagggc

SEQ ID NO: 37988 - RNA, 54 nt, synthetic construct
  misc_feature 1..54: note = derived and/or modified sequence opt4 from anti-influenza_CDR
  source 1..54: mol_type = other RNA
gtgagatggagagccgccgccgtgatcatggaccagttctacaagatggacgtg

SEQ ID NO: 37989 - RNA, 54 nt, synthetic construct
  misc_feature 1..54: note = derived and/or modified sequence opt4 from anti-influenza_CDR
  source 1..54: mol_type = other RNA
gccgtgcccggccccatcttcggcatcttccccccctggagctacttcgaccac

SEQ ID NO: 37990 - RNA, 54 nt, synthetic construct
  misc_feature 1..54: note = derived and/or modified sequence opt4 from anti-influenza_CDR
  source 1..54: mol_type = other RNA
gccgccagcaccgccaccagcggcacctactacgccatgagacccttcgacttc

SEQ ID NO: 37991 - RNA, 57 nt, synthetic construct
  misc_feature 1..57: note = derived and/or modified sequence opt4 from anti-influenza_CDR
  source 1..57: mol_type = other RNA
gccagaggcaagagacccggctactgcagcggcggcgtgtgcagcagcgactactgg

SEQ ID NO: 37992 - RNA, 57 nt, synthetic construct
  misc_feature 1..57: note = derived and/or modified sequence opt4 from anti-influenza_CDR
  source 1..57: mol_type = other RNA
gccagacactacccctactacgacctgcccaccggcttctacagccagttcgacttc

SEQ ID NO: 37993 - RNA, 57 nt, synthetic construct
  misc_feature 1..57: note = derived and/or modified sequence opt4 from anti-influenza_CDR
  source 1..57: mol_type = other RNA
ggcagcggcggctacggcggcttcgactacttcggcaagctgagaacctgggacttc

SEQ ID NO: 37994 - RNA, 57 nt, synthetic construct
  misc_feature 1..57: note = derived and/or modified sequence opt4 from anti-influenza_CDR
  source 1..57: mol_type = other RNA
ttcatcagaaccagaccctggggcggcaccgccgacaccgccgccagcgtgaagggc

SEQ ID NO: 37995 - RNA, 57 nt, synthetic construct
  misc_feature 1..57: note = derived and/or modified sequence opt4 from anti-influenza_CDR
  source 1..57: mol_type = other RNA
ctgaactaccacgacagcggcacctactacaacgcccccagaggctggttcgacccc

SEQ ID NO: 37996 - RNA, 57 nt, synthetic construct
  misc_feature 1..57: note = derived and/or modified sequence opt4 from anti-influenza_CDR
  source 1..57: mol_type = other RNA
gtgaaggacggctactgcaccctgaccagctgccccgtgggctggtacttcgacctg

SEQ ID NO: 37997 - RNA, 57 nt, synthetic construct
  misc_feature 1..57: note = derived and/or modified sequence opt4 from anti-influenza_CDR
  source 1..57: mol_type = other RNA
gccgtgcccggccccatcttcggcatcttccccccctggagctacttcgaccactgg

SEQ ID NO: 37998 - RNA, 57 nt, synthetic construct
  misc_feature 1..57: note = derived and/or modified sequence opt4 from anti-influenza_CDR
  source 1..57: mol_type = other RNA
gccagagccatgatccagggcgtggtgaccctgtacctgagacccggcgactactgg

SEQ ID NO: 37999 - RNA, 57 nt, synthetic construct
  misc_feature 1..57: note = derived and/or modified sequence opt4 from anti-influenza_CDR
  source 1..57: mol_type = other RNA
gccaaggtgggcccctacaccggctacgacgactacaactactacggcatggacgtg

SEQ ID NO: 38000 - RNA, 57 nt, synthetic construct
  misc_feature 1..57: note = derived and/or modified sequence opt4 from anti-influenza_CDR
  source 1..57: mol_type = other RNA
gccaaggtggagagaagcttctacgacggcagcggctacggcgacgccctggagatc

SEQ ID NO: 38001 - RNA, 57 nt, synthetic construct
  misc_feature 1..57: note = derived and/or modified sequence opt4 from anti-influenza_CDR
  source 1..57: mol_type = other RNA
tactgcgccagaggcagagtgaacagcggctacgactggggccccaacttcgacagc

SEQ ID NO: 38002 - RNA, 57 nt, synthetic construct
  misc_feature 1..57: note = derived and/or modified sequence opt4 from anti-influenza_CDR
  source 1..57: mol_type = other RNA
ttctgcgccagaggcagccccaacagcggctacgactggggcccccacttcgactac

SEQ ID NO: 38003 - RNA, 57 nt, synthetic construct
  misc_feature 1..57: note = derived and/or modified sequence opt4 from anti-influenza_CDR
  source 1..57: mol_type = other RNA
agaatcaagagcaacaccgacggcggcaccaccgactacgccgcccccgtgaagggc

SEQ ID NO: 38004 - RNA, 57 nt, synthetic construct
  misc_feature 1..57: note = derived and/or modified sequence opt4 from anti-influenza_CDR
  source 1..57: mol_type = other RNA
ctgagactgcagggcgaggtggtggtgccccccagccagagcaactggttcgacccc

SEQ ID NO: 38005 - RNA, 60 nt, synthetic construct
  misc_feature 1..60: note = derived and/or modified sequence opt4 from anti-influenza_CDR
  source 1..60: mol_type = other RNA
gccaaggagggcggcaacaccatcttcggcctggtgaccatggcctactacttcgacagc

SEQ ID NO: 38006 - RNA, 60 nt, synthetic construct
  misc_feature 1..60: note = derived and/or modified sequence opt4 from anti-influenza_CDR
  source 1..60: mol_type = other RNA
gccagagccggcggcgacagcagcggctactacggcgccctgggcagattcttccagcac

SEQ ID NO: 38007 - RNA, 60 nt, synthetic construct
  misc_feature 1..60: note = derived and/or modified sequence opt4 from anti-influenza_CDR
  source 1..60: mol_type = other RNA
gccaaggacagcagaggctactgcagcagcatcatctgcttcgagggcggcctggacaac

SEQ ID NO: 38008 - RNA, 60 nt, synthetic construct
  misc_feature 1..60: note = derived and/or modified sequence opt4 from anti-influenza_CDR
  source 1..60: mol_type = other RNA
ggcagcggcagcagcgacagaagcgactacgacccccactactactactacctggacgtg

SEQ ID NO: 38009 - RNA, 60 nt, synthetic construct
  misc_feature 1..60: note = derived and/or modified sequence opt4 from anti-influenza_CDR
  source 1..60: mol_type = other RNA
ggcaccgaccccgacaccgaggtgtactgcagagtgggcaactgcgccgccttcgactac

SEQ ID NO: 38010 - RNA, 60 nt, synthetic construct
  misc_feature 1..60: note = derived and/or modified sequence opt4 from anti-influenza_CDR
  source 1..60: mol_type = other RNA
ggcaccagccacgtgagcagatacttcgactggctgccccccaccaactggttcgacccc

SEQ ID NO: 38011 - RNA, 60 nt, synthetic construct
  misc_feature 1..60: note = derived and/or modified sequence opt4 from anti-influenza_CDR
  source 1..60: mol_type = other RNA
ggcaccgaccccgacaccgagggctactgcagaagcggcagctgcagcgccttcgacttc

SEQ ID NO: 38012 - RNA, 60 nt, synthetic construct
  misc_feature 1..60: note = derived and/or modified sequence opt4 from anti-influenza_CDR
  source 1..60: mol_type = other RNA
ggcaccgaccccgacaccgaggtgtactgcagagccggcaactgcgccgccttcgacttc

SEQ ID NO: 38013 - RNA, 60 nt, synthetic construct
  misc_feature 1..60: note = derived and/or modified sequence opt4 from anti-influenza_CDR
  source 1..60: mol_type = other RNA
agaggcggccacagcttcggctacggcagcggcggcgacacccacagcgagttcgacagc

SEQ ID NO: 38014 - RNA, 60 nt, synthetic construct
  misc_feature 1..60: note = derived and/or modified sequence opt4 from anti-influenza_CDR
  source 1..60: mol_type = other RNA
cacatgagcatgcagcaggtggtgagcgccggctgggagagagccgacctggtgggcgac

SEQ ID NO: 38015 - RNA, 60 nt, synthetic construct
  misc_feature 1..60: note = derived and/or modified sequence opt4 from anti-influenza_CDR
  source 1..60: mol_type = other RNA
gacagcagactgagaagcctgctgtacttcgagtggctgagccagggctacttcaacccc

SEQ ID NO: 38016 - RNA, 60 nt, synthetic construct
  misc_feature 1..60: note = derived and/or modified sequence opt4 from anti-influenza_CDR
  source 1..60: mol_type = other RNA
gccagacacctgggccagcagctggtgagcaacacctactactactacggcatggacgtg

SEQ ID NO: 38017 - RNA, 63 nt, synthetic construct; identical to SEQ ID NO: 22733
  misc_feature 1..63: note = derived and/or modified sequence opt4 from anti-influenza_CDR
  source 1..63: mol_type = other RNA

SEQ ID NO: 38018 - RNA, 63 nt, synthetic construct
  misc_feature 1..63: note = derived and/or modified sequence opt4 from anti-influenza_CDR
  source 1..63: mol_type = other RNA
gccagagccgccgacgagagcgtggagagcctgaccatcaaggccttcagaaccaactaccac

SEQ ID NO: 38019 - RNA, 63 nt, synthetic construct
  misc_feature 1..63: note = derived and/or modified sequence opt4 from anti-influenza_CDR
  source 1..63: mol_type = other RNA
gccagaatgcccctggccaactacgacctgctgaccggcctgtacatcggcgccttcgacctg

SEQ ID NO: 38020 - RNA, 63 nt, synthetic construct
  misc_feature 1..63: note = derived and/or modified sequence opt4 from anti-influenza_CDR
  source 1..63: mol_type = other RNA
gacatgctggcctactacagcgacaacagcggcaagaagtacaacgtgtacggcatggacgtg

SEQ ID NO: 38021 - RNA, 63 nt, synthetic construct
  misc_feature 1..63: note = derived and/or modified sequence opt4 from anti-influenza_CDR
  source 1..63: mol_type = other RNA
gacatgctggcctactactacgacggcagcggcatcagatacaacctgtacggcatggacgtg

SEQ ID NO: 38022 - RNA, 66 nt, synthetic construct
  misc_feature 1..66: note = derived and/or modified sequence opt4 from anti-influenza_CDR
  source 1..66: mol_type = other RNA
gccaaggaccccagactgagacacctgctgtacttccccttcaccagcatgatctacttcgactac

SEQ ID NO: 38023 - RNA, 66 nt, synthetic construct
  misc_feature 1..66: note = derived and/or modified sequence opt4 from anti-influenza_CDR
  source 1..66: mol_type = other RNA
gccaaggacagccagctgagaagcctgctgtacttcgagtggctgagccagggctacttcgacccc

SEQ ID NO: 38024 - RNA, 66 nt, synthetic construct
  misc_feature 1..66: note = derived and/or modified sequence opt4 from anti-influenza_CDR
  source 1..66: mol_type = other RNA
gccaaggacagccagctgagaagcctgctgtacttcgagtggctgagccagggctacttcgactac

SEQ ID NO: 38025 - RNA, 66 nt, synthetic construct
  misc_feature 1..66: note = derived and/or modified sequence opt4 from anti-influenza_CDR
  source 1..66: mol_type = other RNA
gccaaggacagccagctgagaagcctgctgtacttcgagtggctgagccagggctacttcgagccc

SEQ ID NO: 38026 - RNA, 66 nt, synthetic construct
  misc_feature 1..66: note = derived and/or modified sequence opt4 from anti-influenza_CDR
  source 1..66: mol_type = other RNA
gccaaggagagacccctgagactgctgagatacttcgactggctgagcggcggcgccaacgactac

SEQ ID NO: 38027 - RNA, 66 nt, synthetic construct
  misc_feature 1..66: note = derived and/or modified sequence opt4 from anti-influenza_CDR
  source 1..66: mol_type = other RNA
gccagagacgtgcacaactacgacttcctgaccggctaccccctgcacctgtacggcatggacgtg

SEQ ID NO: 38028 - RNA, 66 nt, synthetic construct
  misc_feature 1..66: note = derived and/or modified sequence opt4 from anti-influenza_CDR
  source 1..66: mol_type = other RNA
gccagagacggcagagagggctacttctacggcagcggcagcttctacaacctgaagggcctgaac

SEQ ID NO: 38029 - RNA, 66 nt, synthetic construct
  misc_feature 1..66: note = derived and/or modified sequence opt4 from anti-influenza_CDR
  source 1..66: mol_type = other RNA
agcaccgacagaggccacgtgctgagatacttcggctggatgctgcccggcgacgccttcgacgtg

SEQ ID NO: 38030 - RNA, 66 nt, synthetic construct
  misc_feature 1..66: note = derived and/or modified sequence opt4 from anti-influenza_CDR
  source 1..66: mol_type = other RNA
ctgaactactacgacagaagcggctaccacagccccgacggccccagcaacaactggttcgacccc

SEQ ID NO: 38031 - RNA, 66 nt, synthetic construct
  misc_feature 1..66: note = derived and/or modified sequence opt4 from anti-influenza_CDR
  source 1..66: mol_type = other RNA
gccagagtgcccagagacagactgctgaccctgtactacgagagcagcacctacggcttcgactac

SEQ ID NO: 38032 - RNA, 66 nt, synthetic construct
  misc_feature 1..66: note = derived and/or modified sequence opt4 from anti-influenza_CDR
  source 1..66: mol_type = other RNA
gccagaaagtggggcagaatgaccgtgttcggcgtggccaccgaccagctgtactacttcgactac

SEQ ID NO: 38033 - RNA, 66 nt, synthetic construct
  misc_feature 1..66: note = derived and/or modified sequence opt4 from anti-influenza_CDR
  source 1..66: mol_type = other RNA
gccaccgacatcgtggtggagagagacgccagcctgggcggcttcaacagctacggcatggacgtg

SEQ ID NO: 38034 - RNA, 69 nt, synthetic construct
  misc_feature 1..69: note = derived and/or modified sequence opt4 from anti-influenza_CDR
  source 1..69: mol_type = other RNA
gccagaaacctgcccgacatcgccgtggtgaccgccgtgcaggacgccacccccgtgtggttcgacccc

SEQ ID NO: 38035 - RNA, 69 nt, synthetic construct
  misc_feature 1..69: note = derived and/or modified sequence opt4 from anti-influenza_CDR
  source 1..69: mol_type = other RNA
gacggcccctacagcgacgacttcagaagcggctacgccgccagatacagatacttcggcatggacgtg

SEQ ID NO: 38036 - RNA, 72 nt, synthetic construct
  misc_feature 1..72: note = derived and/or modified sequence opt4 from anti-influenza_CDR
  source 1..72: mol_type = other RNA
ggcagagagctgctgagactgcagcacttcctgaccgacagccagagcgagagaagagactgcttcgacccc

SEQ ID NO: 38037 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagaaacgagtggggctgcagatgcaacgacagcagcgac

SEQ ID NO: 38038 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccaagaacgagtgggagtgcagatgcaacgacagcagcgac

SEQ ID NO: 38039 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacgagtgggagtgcagatgcaacgacagcagcgac

SEQ ID NO: 38040 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacggctgggagtgcaagtgcaacgacagcagcgac

SEQ ID NO: 38041 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaagcgagtggggctgcagatgcaacgacagcagcgac

SEQ ID NO: 38042 - RNA, 72 nt, synthetic construct
  misc_feature 1..72: note = derived and/or modified sequence opt4 from anti-influenza_CDR
  source 1..72: mol_type = other RNA
atgagcttcctgcccgaggtggagacccccatcagaaacgagtggggctgcagatgcaacgacagcagcgac

SEQ ID NO: 38043 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacgagtggggctgcagatgcaacgacagcagcaac

SEQ ID NO: 38044 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaaggagtggggctgcagatgcaacgacagcagcgac

SEQ ID NO: 38045 - RNA, 72 nt, synthetic construct
  misc_feature 1..72: note = derived and/or modified sequence opt4 from anti-influenza_CDR
  source 1..72: mol_type = other RNA
atgagcttcctgaccgaggtggagacccccatcagaaacgagtggggctgcagatgcaacgacagcagcgac

SEQ ID NO: 38046 - RNA, 72 nt, synthetic construct
  misc_feature 1..72: note = derived and/or modified sequence opt4 from anti-influenza_CDR
  source 1..72: mol_type = other RNA
atgagcctgcccaccgaggtggagacccccatcagaagcgagtggggctgcagatgcaacgacagcagcgac

SEQ ID NO: 38047 - RNA, 72 nt, synthetic construct
  misc_feature 1..72: note = derived and/or modified sequence opt4 from anti-influenza_CDR
  source 1..72: mol_type = other RNA
atgagcctgctgcccgaggtggagacccccatcagaaacgagtggggctgcagatgcaacgacagcagcgac

SEQ ID NO: 38048 - RNA, 72 nt, synthetic construct
  misc_feature 1..72: note = derived and/or modified sequence opt4 from anti-influenza_CDR
  source 1..72: mol_type = other RNA
atgagcctgctgcccgaggtggagacccccatcagaaacggctggggctgcagatgcaacgacagcagcgac

SEQ ID NO: 38049 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagaaacggctgggagtgcagatgcagcggcagcagcgac

SEQ ID NO: 38050 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacgagtgggagtacagatgcaacgacagcagcgac

SEQ ID NO: 38051 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacgagtgggagtacagatgcagcgacagcagcgac

SEQ ID NO: 38052 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagaaacggctgggagtgcagatacagcgacagcagcgac

SEQ ID NO: 38053 - RNA, 72 nt, synthetic construct
  misc_feature 1..72: note = derived and/or modified sequence opt4 from anti-influenza_CDR
  source 1..72: mol_type = other RNA
atgagcttcctgaccgaggtggagaccctgaccagaaacggctgggagtgcagatgcagcgacagcagcgac

SEQ ID NO: 38054 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagaccctgaccagaaacggctgggagtgcaagtgcagagacagcagcgac

SEQ ID NO: 38055 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacgagtggggctgcagatgcaacgacagcagcgac

SEQ ID NO: 38056 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaagcgagtggggctgcagatgcaacgacagcggcgac

SEQ ID NO: 38057 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacgagtgggagtgcagatgcaacggcagcagcgac

SEQ ID NO: 38058 - RNA, 72 nt, synthetic construct
  misc_feature 1..72: note = derived and/or modified sequence opt4 from anti-influenza_CDR
  source 1..72: mol_type = other RNA
atgagcctgcccaccgaggtggagacccccatcagaaacgagtggggctgcagatgcaacgacagcagcgac

SEQ ID NO: 38059 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacgagtggggctgcagatgcaacggcagcagcgac

SEQ ID NO: 38060 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggacaccctgaccagaaacggctggggctgcagatgcagcgacagcagcgac

SEQ ID NO: 38061 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagaccctgaccaagaacggctggggctgcagatgcagcgacagcagcgac

SEQ ID NO: 38062 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagaaacggctgggagtgcaagtgcagcgacagcagcgac

SEQ ID NO: 38063 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccacaccagaaacggctgggagtgcaagtgcagcgacagcagcgac

SEQ ID NO: 38064 - RNA, 72 nt, synthetic construct
  misc_feature 1..72: note = derived and/or modified sequence opt4 from anti-influenza_CDR
  source 1..72: mol_type = other RNA
atgagcctgctgaccgaggtgaagacccccaccagaaacggctgggagtgcaagtgcagcgacagcagcgac

SEQ ID NO: 38065 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagaccctgaccagaaacggctggggctgcagatgcagcgacagcagcgac

SEQ ID NO: 38066 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagagacggctgggagtgcaagtgcagcgacagcagcgac

SEQ ID NO: 38067 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagaaacggctggggctgcagatgcagcgacagcagcgac

SEQ ID NO: 38068 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagaaacggctgggagtgcaagtgcaacgacagcagcgac

SEQ ID NO: 38069 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagaccctgaccagaaacggctgggagtgcaagtgcagcgacagcagcgac

SEQ ID NO: 38070 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaacgagtggggctgcaagtgcaacgacagcagcgac

SEQ ID NO: 38071 - RNA, 72 nt, synthetic construct
  misc_feature 1..72: note = derived and/or modified sequence opt4 from anti-influenza_CDR
  source 1..72: mol_type = other RNA
atgagcttcctgaccgaggtggagacccccatcagaaacgagtggggctgcagatgcaacggcagcagcgac

SEQ ID NO: 38072 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagaaacggctgggagtgcagatgcaacgacagcagcgac

SEQ ID NO: 38073 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccatcagaaagggctgggagtgcaactgcagcgacagcagcgac

SEQ ID NO: 38074 - RNA, 72 nt, synthetic construct
  misc_feature 1..72: note = derived and/or modified sequence opt4 from anti-influenza_CDR
  source 1..72: mol_type = other RNA
atgagcctgctgaccgaggtggagacccccaccagaaacgagtgggagtgcagatgcagcgacagcagcgac

SEQ ID NO: 38075 - RNA, 72 nt, synthetic construct
  misc_feature 1..72: note = derived and/or modified sequence opt4 from anti-influenza_CDR
  source 1..72: mol_type = other RNA
atgagcctgctgaccggcgtggagacccacaccagaaacggctggggctgcaagtgcagcgacagcagcgac

SEQ ID NO: 38076 - RNA, 72 nt, synthetic construct
  misc_feature 1..72: note = derived and/or modified sequence opt4 from anti-influenza_CDR
  source 1..72: mol_type = other RNA
atgagcctgctgcccgaggtggagacccacaccagaaacggctggggctgcagatgcagcgacagcagcgac

SEQ ID NO: 38077 - RNA, 72 nt, synthetic construct
  misc_feature 1..72: note = derived and/or modified sequence opt4 from anti-influenza_CDR
  source 1..72: mol_type = other RNA
accgacggcccctacagcgacgacttcagaagcggctacgccgccagatacagatacttcggcatggacgtg

SEQ ID NO: 38078 - RNA, 75 nt, synthetic construct
  misc_feature 1..75: note = derived and/or modified sequence opt4 from anti-influenza_CDR
  source 1..75: mol_type = other RNA
gccaagcacatgagcctgcagcaggtggtgagcgccggctgggagagagccgacctggtgggcgacgccttcgac

SEQ ID NO: 38079 - RNA, 75 nt, synthetic construct
  misc_feature 1..75: note = derived and/or modified sequence opt4 from anti-influenza_CDR
  source 1..75: mol_type = other RNA
gccaagcacctgagcatgcagcaggtggtgagcgccggctgggagagagccgacctggtgggcgacgccttcgac

SEQ ID NO: 38080 - RNA, 75 nt, synthetic construct
  misc_feature 1..75: note = derived and/or modified sequence opt4 from anti-influenza_CDR
  source 1..75: mol_type = other RNA
gccaagcacgccagcctgcagcaggtggtgagcgccggctgggagagagccgacctggtgggcgacgccttcgac

SEQ ID NO: 38081 - RNA, 75 nt, synthetic construct
  misc_feature 1..75: note = derived and/or modified sequence opt4 from anti-influenza_CDR
  source 1..75: mol_type = other RNA
gccaagcacagcagcctgcagcaggtggtgagcgccggctgggagagagccgacctggtgggcgacgccttcgac

SEQ ID NO: 38082 - RNA, 75 nt, synthetic construct
  misc_feature 1..75: note = derived and/or modified sequence opt4 from anti-influenza_CDR
  source 1..75: mol_type = other RNA
gccaagcacctgagcctgcagcaggtggtgagcgccggctgggagagagccgacctggtgggcgacgccttcgac

SEQ ID NO: 38083 - RNA, 75 nt, synthetic construct
  misc_feature 1..75: note = derived and/or modified sequence opt4 from anti-influenza_CDR
  source 1..75: mol_type = other RNA
gccaagcacatgagcatgcagcaggtggtgagcgccggctgggagagagccgacctggtgggcgacgccttcgac

SEQ ID NO: 38084 - RNA, 75 nt, synthetic construct
  misc_feature 1..75: note = derived and/or modified sequence opt4 from anti-influenza_CDR
  source 1..75: mol_type = other RNA
gccagaggccccgagacctactactacgacaagaccaactggctgaacagccaccccgacgagtacttccagcac

SEQ ID NO: 38085 - RNA, 75 nt, synthetic construct
  misc_feature 1..75: note = derived and/or modified sequence opt4 from anti-influenza_CDR
  source 1..75: mol_type = other RNA
accaccgacggcccctacagcgacgacttcagaagcggctacgccgccagatacagatacttcggcatggacgtg

SEQ ID NO: 38086 - RNA, 75 nt, synthetic construct
  misc_feature 1..75: note = derived and/or modified sequence opt4 from anti-influenza_CDR
  source 1..75: mol_type = other RNA
accgacggcccctacagcgacgacttcagaagcggctacgccgccagatacagatacttcggcatggacgtgtgg

SEQ ID NO: 38087 - RNA, 78 nt, synthetic construct
  misc_feature 1..78: note = derived and/or modified sequence opt4 from anti-influenza_CDR
  source 1..78: mol_type = other RNA
gacatccagatgacccagagccccagcagcctgagcgccagcgtgggcgacagagtgaccatcacctgcagaagcagc

SEQ ID NO: 38088 - RNA, 78 nt, synthetic construct
  misc_feature 1..78: note = derived and/or modified sequence opt4 from anti-influenza_CDR
  source 1..78: mol_type = other RNA
gccaccggcagagccgccaccggcagcgccagctgcaccggcggcggcacctactggacctactgcacctgcaccacc

SEQ ID NO: 38089 - RNA, 81 nt, synthetic construct
  misc_feature 1..81: note = derived and/or modified sequence opt4 from anti-influenza_CDR
  source 1..81: mol_type = other RNA
ggctacatccccgaggcccccagagacggccaggcctacgtgagaaaggacggcgagtgggtgctgctgagcaccttcctg

SEQ ID NO: 38090 - RNA, 90 nt, synthetic construct
  misc_feature 1..90: note = derived and/or modified sequence opt4 from anti-influenza_CDR
  source 1..90: mol_type = other RNA
caggtgcagctgctggagaccggcggcggcctggtgaagcccggccagagcctgaagctgagctgcgccgccagcggcttcaccttcacc

SEQ ID NO: 38091 - RNA, 96 nt, synthetic construct
  misc_feature 1..96: note = derived and/or modified sequence opt4 from anti-influenza_CDR
  source 1..96: mol_type = other RNA
agattcaccatcagcagagacaacagcaagaacaccctgtacctgcagatgaacagcctgagagccgaggacaccgccgtgtactactgcgccaag

SEQ ID NO: 38092 - RNA, 96 nt, synthetic construct
  misc_feature 1..96: note = derived and/or modified sequence opt4 from anti-influenza_CDR
  source 1..96: mol_type = other RNA
ggcgtgcccagcagattcagcggcagcggcagcggcaccgacttcaccctgaccatcagcagcctgcagcccgaggacttcgccacctactactgc

SEQ ID NO: 38093 - RNA, 15 nt, synthetic construct
  misc_feature 1..15: note = derived and/or modified sequence opt4 from anti-OX40_HeavyChain_CDR1
  source 1..15: mol_type = other RNA
agctacagcatgaac

SEQ ID NO: 38094 - RNA, 15 nt, synthetic construct
  misc_feature 1..15: note = derived and/or modified sequence opt4 from anti-OX40_HeavyChain_CDR1
  source 1..15: mol_type = other RNA
gactacgccatgcac

SEQ ID NO: 38095 - RNA, 15 nt, synthetic construct
  misc_feature 1..15: note = derived and/or modified sequence opt4 from anti-OX40_HeavyChain_CDR1
  source 1..15: mol_type = other RNA
gacagctacatgagc

SEQ ID NO: 38096 - RNA, 15 nt, synthetic construct
  misc_feature 1..15: note = derived and/or modified sequence opt4 from anti-OX40_HeavyChain_CDR1
  source 1..15: mol_type = other RNA
gacgcctacatgagc

SEQ ID NO: 38097 - RNA, 15 nt, synthetic construct
  misc_feature 1..15: note = derived and/or modified sequence opt4 from anti-OX40_HeavyChain_CDR1
  source 1..15: mol_type = other RNA
gagagctacatgagc

SEQ ID NO: 38098 - RNA, 15 nt, synthetic construct
  misc_feature 1..15: note = derived and/or modified sequence opt4 from anti-OX40_HeavyChain_CDR1
  source 1..15: mol_type = other RNA
agcggctactggaac

SEQ ID NO: 38099 - RNA, 21 nt, synthetic construct
  misc_feature 1..21: note = derived and/or modified sequence opt4 from anti-OX40_LightChain_CDR2
  source 1..21: mol_type = other RNA
tacaccagcagactgcacagc

SEQ ID NO: 38100 - RNA, 21 nt, synthetic construct
  misc_feature 1..21: note = derived and/or modified sequence opt4 from anti-OX40_LightChain_CDR2
  source 1..21: mol_type = other RNA
gccgccagcagcctgcagagc

SEQ ID NO: 38101 - RNA, 21 nt, synthetic construct
  misc_feature 1..21: note = derived and/or modified sequence opt4 from anti-OX40_LightChain_CDR2
  source 1..21: mol_type = other RNA
gacgccagcaacagagccacc

SEQ ID NO: 38102 - RNA, 21 nt, synthetic construct
  misc_feature 1..21: note = derived and/or modified sequence opt4 from anti-OX40_LightChain_CDR2
  source 1..21: mol_type = other RNA
tacaccagcagactgagaagc

SEQ ID NO: 38103 - RNA, 24 nt, synthetic construct
  misc_feature 1..24: note = derived and/or modified sequence opt4 from anti-OX40_LightChain_CDR3
  source 1..24: mol_type = other RNA
cagcagagaagcaactggcccacc

SEQ ID NO: 38104 - RNA, 24 nt, synthetic construct
  misc_feature 1..24: note = derived and/or modified sequence opt4 from anti-OX40_HeavyChain_CDR3
  source 1..24: mol_type = other RNA
gcccccagatggtacttcagcgtg

SEQ ID NO: 38105 - RNA, 24 nt, synthetic construct
  misc_feature 1..24: note = derived and/or modified sequence opt4 from anti-OX40_HeavyChain_CDR3
  source 1..24: mol_type = other RNA
gcccccagatggtacttcagcgcc

SEQ ID NO: 38106 - RNA, 24 nt, synthetic construct
  misc_feature 1..24: note = derived and/or modified sequence opt4 from anti-OX40_HeavyChain_CDR3
  source 1..24: mol_type = other RNA
gcccccagatggtacttcgccgtg

SEQ ID NO: 38107 - RNA, 27 nt, synthetic construct
  misc_feature 1..27: note = derived and/or modified sequence opt4 from anti-OX40_LightChain_CDR3
  source 1..27: mol_type = other RNA
cagcagggcaacaccctgccctggacc

SEQ ID NO: 38108 - RNA, 27 nt, synthetic construct
  misc_feature 1..27: note = derived and/or modified sequence opt4 from anti-OX40_HeavyChain_CDR3
  source 1..27: mol_type = other RNA
gagagcggctggtacctgttcgactac

SEQ ID NO: 38109 - RNA, 27 nt, synthetic construct
  misc_feature 1..27: note = derived and/or modified sequence opt4 from anti-OX40_LightChain_CDR3
  source 1..27: mol_type = other RNA
cagcagtacaacagctacccccccacc

SEQ ID NO: 38110 - RNA, 27 nt, synthetic construct
  misc_feature 1..27: note = derived and/or modified sequence opt4 from anti-OX40_LightChain_CDR3
  source 1..27: mol_type = other RNA
cagcagggccacaccctgccccccacc

SEQ ID NO: 38111 - RNA, 27 nt, synthetic construct
  misc_feature 1..27: note = derived and/or modified sequence opt4 from anti-OX40_LightChain_CDR3
  source 1..27: mol_type = other RNA
cagcagggccacaccctgcccgccacc

SEQ ID NO: 38112 - RNA, 27 nt, synthetic construct
  misc_feature 1..27: note = derived and/or modified sequence opt4 from anti-OX40_LightChain_CDR3
  source 1..27: mol_type = other RNA
cagcagggccacaccgccccccccacc

SEQ ID NO: 38113 - RNA, 27 nt, synthetic construct
  misc_feature 1..27: note = derived and/or modified sequence opt4 from anti-OX40_LightChain_CDR3
  source 1..27: mol_type = other RNA
cagcagggcgccaccctgccccccacc

SEQ ID NO: 38114 - RNA, 27 nt, synthetic construct
  misc_feature 1..27: note = derived and/or modified sequence opt4 from anti-OX40_LightChain_CDR3
  source 1..27: mol_type = other RNA
cagcagggccacgccctgccccccacc

SEQ ID NO: 38115 - RNA, 27 nt, synthetic construct
  misc_feature 1..27: note = derived and/or modified sequence opt4 from anti-OX40_LightChain_CDR3
  source 1..27: mol_type = other RNA
cagcaggcccacaccctgccccccacc

SEQ ID NO: 38116 - RNA, 27 nt, synthetic construct
  misc_feature 1..27: note = derived and/or modified sequence opt4 from anti-OX40_LightChain_CDR3
  source 1..27: mol_type = other RNA
cagcagggccacaccctggcccccacc

SEQ ID NO: 38117 - RNA, 27 nt, synthetic construct
  misc_feature 1..27: note = derived and/or modified sequence opt4 from anti-OX40_LightChain_CDR3
  source 1..27: mol_type = other RNA
caggccggccacaccctgccccccacc

SEQ ID NO: 38118 - RNA, 30 nt, synthetic construct; identical to SEQ ID NO: 15192
  misc_feature 1..30: note = derived and/or modified sequence opt4 from anti-OX40_HeavyChain_CDR1
  source 1..30: mol_type = other RNA

SEQ ID NO: 38119 - RNA, 30 nt, synthetic construct
  misc_feature 1..30: note = derived and/or modified sequence opt4 from anti-OX40_HeavyChain_CDR3
  source 1..30: mol_type = other RNA
tactacggcagcagcctgagcatggactac

SEQ ID NO: 38120 - RNA, 33 nt, synthetic construct
  misc_feature 1..33: note = derived and/or modified sequence opt4 from anti-OX40_LightChain_CDR1
  source 1..33: mol_type = other RNA
agagccagccaggacatcagcaactacctgaac

SEQ ID NO: 38121 - RNA, 33 nt, synthetic construct
  misc_feature 1..33: note = derived and/or modified sequence opt4 from anti-OX40_LightChain_CDR1
  source 1..33: mol_type = other RNA
agagccagccagggcatcagcagctggctggcc

SEQ ID NO: 38122 - RNA, 33 nt, synthetic construct; identical to SEQ ID NO: 37640
  misc_feature 1..33: note = derived and/or modified sequence opt4 from anti-OX40_LightChain_CDR1
  source 1..33: mol_type = other RNA

SEQ ID NO: 38123 - RNA, 39 nt, synthetic construct
  misc_feature 1..39: note = derived and/or modified sequence opt4 from anti-OX40_HeavyChain_CDR3
  source 1..39: mol_type = other RNA
tacagatacgactacgacggcggccacgccatggactac

SEQ ID NO: 38124 - RNA, 39 nt, synthetic construct; identical to SEQ ID NO: 15198
  misc_feature 1..39: note = derived and/or modified sequence opt4 from anti-OX40_HeavyChain_CDR3
  source 1..39: mol_type = other RNA

SEQ ID NO: 38125 - RNA, 39 nt, synthetic construct; identical to SEQ ID NO: 22841
  misc_feature 1..39: note = derived and/or modified sequence opt4 from anti-OX40_HeavyChain_CDR3
  source 1..39: mol_type = other RNA

SEQ ID NO: 38126 - RNA, 45 nt, synthetic construct; identical to SEQ ID NO: 15200
  misc_feature 1..45: note = derived and/or modified sequence opt4 from anti-OX40_HeavyChain_CDR3
  source 1..45: mol_type = other RNA

SEQ ID NO: 38127 - RNA, 48 nt, synthetic construct
  misc_feature 1..48: note = derived and/or modified sequence opt4 from anti-OX40_HeavyChain_CDR2
  source 1..48: mol_type = other RNA
tacatcagctacaacggcatcacctaccacaaccccagcctgaagagc

SEQ ID NO: 38128 - RNA, 48 nt, synthetic construct
  misc_feature 1..48: note = derived and/or modified sequence opt4 from anti-OX40_HeavyChain_CDR2
  source 1..48: mol_type = other RNA
tacatcagctacaacgccatcacctaccacaaccccagcctgaagagc

SEQ ID NO: 38129 - RNA, 48 nt, synthetic construct
  misc_feature 1..48: note = derived and/or modified sequence opt4 from anti-OX40_HeavyChain_CDR2
  source 1..48: mol_type = other RNA
tacatcagctacagcggcatcacctaccacaaccccagcctgaagagc

SEQ ID NO: 38130 - RNA, 51 nt, synthetic construct; identical to SEQ ID NO: 22846
  misc_feature 1..51: note = derived and/or modified sequence opt4 from anti-OX40_HeavyChain_CDR2
  source 1..51: mol_type = other RNA

SEQ ID NO: 38131 - RNA, 51 nt, synthetic construct
  misc_feature 1..51: note = derived and/or modified sequence opt4 from anti-OX40_HeavyChain_CDR2
  source 1..51: mol_type = other RNA
tacatcagcagcagcagcagcaccatcgactacgccgacagcgtgaagggc

SEQ ID NO: 38132 - RNA, 51 nt, synthetic construct
  misc_feature 1..51: note = derived and/or modified sequence opt4 from anti-OX40_HeavyChain_CDR2
  source 1..51: mol_type = other RNA
ggcatcagctggaacagcggcagcatcggctacgccgacagcgtgaagggc

SEQ ID NO: 38133 - RNA, 51 nt, synthetic construct
  misc_feature 1..51: note = derived and/or modified sequence opt4 from anti-OX40_HeavyChain_CDR2
  source 1..51: mol_type = other RNA
gacatgtaccccgacaacggcgacagcagctacaaccagaagttcagagag

SEQ ID NO: 38134 - RNA, 51 nt, synthetic construct
  misc_feature 1..51: note = derived and/or modified sequence opt4 from anti-OX40_HeavyChain_CDR2
  source 1..51: mol_type = other RNA
gacatgtaccccgacaacgccgacagcagctacaaccagaagttcagagag

SEQ ID NO: 38135 - RNA, 51 nt, synthetic construct
  misc_feature 1..51: note = derived and/or modified sequence opt4 from anti-OX40_HeavyChain_CDR2
  source 1..51: mol_type = other RNA
gacatgtaccccgacaacgccgacgccagctacaaccagaagttcagagag

SEQ ID NO: 38136 - RNA, 51 nt, synthetic construct
  misc_feature 1..51: note = derived and/or modified sequence opt4 from anti-OX40_HeavyChain_CDR2
  source 1..51: mol_type = other RNA
gacatgtaccccgacaacggcgacgccagctacaaccagaagttcagagag

SEQ ID NO: 38137 - RNA, 51 nt, synthetic construct
  misc_feature 1..51: note = derived and/or modified sequence opt4 from anti-OX40_HeavyChain_CDR2
  source 1..51: mol_type = other RNA
gacatgtaccccgacagcggcgacagcagctacaaccagaagttcagagag

SEQ ID NO: 38138 - RNA, 51 nt, synthetic construct
  misc_feature 1..51: note = derived and/or modified sequence opt4 from anti-OX40_HeavyChain_CDR2
  source 1..51: mol_type = other RNA
gacatgtaccccgacaacggcagcagcagctacaaccagaagttcagagag

SEQ ID NO: 38139 - RNA, 309 nt, synthetic construct
  misc_feature 1..309: note = derived and/or modified sequence opt4 from Ig_LightChain_kappa_constant_domain
  source 1..309: mol_type = other RNA
accgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcagcaccctgaccctgagcaaggccgactacgagaagcacaaggtgtacgcctgcgaggtgacccaccagggcctgagcagccccgtgaccaagagcttcaacaga

SEQ ID NO: 38140 - RNA, 309 nt, synthetic construct
  misc_feature 1..309: note = derived and/or modified sequence opt4 from Ig_LightChain_kappa_constant_domain
  source 1..309: mol_type = other RNA
accgtggccgcccccagcgtgttcatcttcccccccagcgacgagcagctgaagagcggcaccgccagcgtggtgtgcctgctgaacaacttctaccccagagaggccaaggtgcagtggaaggtggacaacgccctgcagagcggcaacagccaggagagcgtgaccgagcaggacagcaaggacagcacctacagcctgagcaacaccctgaccctgagcaaggccgactacgagaagcacaaggtgtacgcctgcgaggtgacccaccagggcctgagcagccccgtgaccaagagcttcaacaga

SEQ ID NO: 38141 - RNA, 312 nt, synthetic construct
  misc_feature 1..312: note = derived and/or modified sequence opt4 from Ig_LightChain_lambda_constant_domain
  source 1..312: mol_type = other RNA
cccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccaccgagtgcagc

SEQ ID NO: 38142 - RNA, 312 nt, synthetic construct
  misc_feature 1..312: note = derived and/or modified sequence opt4 from Ig_LightChain_lambda_constant_domain
  source 1..312: mol_type = other RNA
cccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacagaagctacagctgccaggtgacccacgagggcagcaccgtggagaagaccgtggcccccgccgagtgcagc

SEQ ID NO: 38143 - RNA, 312 nt, synthetic construct
  misc_feature 1..312: note = derived and/or modified sequence opt4 from Ig_LightChain_lambda_constant_domain
  source 1..312: mol_type = other RNA
cccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccaccgagtgcagc

SEQ ID NO: 38144 - RNA, 312 nt, synthetic construct
  misc_feature 1..312: note = derived and/or modified sequence opt4 from Ig_LightChain_lambda_constant_domain
  source 1..312: mol_type = other RNA
cccaaggccgcccccagcgtgaccctgttcccccccagcagcgaggagctgcaggccaacaaggccaccctggtgtgcctgatcagcgacttctaccccggcgccgtgaccgtggcctggaaggccgacagcagccccgtgaaggccggcgtggagaccaccacccccagcaagcagagcaacaacaagtacgccgccagcagctacctgagcctgacccccgagcagtggaagagccacaagagctacagctgccaggtgacccacgagggcagcaccgtggagaagaccgtggcccccgccgagtgcagc

SEQ ID NO: 38145 - RNA, 282 nt, synthetic construct
  misc_feature 1..282: note = derived and/or modified sequence opt4 from IgG1_HeavyChain_CH1_constant_domain
  source 1..282: mol_type = other RNA
agcgccagcaccaagggccccagcgtgttccccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtg

SEQ ID NO: 38146 - RNA, 270 nt, synthetic construct
  misc_feature 1..270: note = derived and/or modified sequence opt4 from IgG1_HeavyChain_CH1_constant_domain
  source 1..270: mol_type = other RNA
agcggccccagcgtgttccccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtg

SEQ ID NO: 38147 - RNA, 270 nt, synthetic construct
  misc_feature 1..270: note = derived and/or modified sequence opt4 from IgG1_HeavyChain_CH1_constant_domain
  source 1..270: mol_type = other RNA
agcggccccagcgtgttccccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggcc

SEQ ID NO: 38148 - RNA, 270 nt, synthetic construct
  misc_feature 1..270: note = derived and/or modified sequence opt4 from IgG1_HeavyChain_CH1_constant_domain
  source 1..270: mol_type = other RNA
agcggccccagcgtgttccccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtg

SEQ ID NO: 38149 - RNA, 270 nt, synthetic construct
  misc_feature 1..270: note = derived and/or modified sequence opt4 from IgG1_HeavyChain_CH1_constant_domain
  source 1..270: mol_type = other RNA
agcggccccagcgtgttccccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagcc

SEQ ID NO: 38150 - RNA, 270 nt, synthetic construct
  misc_feature 1..270: note = derived and/or modified sequence opt4 from IgG1_HeavyChain_CH1_constant_domain
  source 1..270: mol_type = other RNA
agcggccccagcgtgctgcccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtg

SEQ ID NO: 38151 - RNA, 270 nt, synthetic construct
  misc_feature 1..270: note = derived and/or modified sequence opt4 from IgG1_HeavyChain_CH1_constant_domain
  source 1..270: mol_type = other RNA
agcggccccagcgtgctgcccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggcc

SEQ ID NO: 38152 - RNA, 270 nt, synthetic construct
  misc_feature 1..270: note = derived and/or modified sequence opt4 from IgG1_HeavyChain_CH1_constant_domain
  source 1..270: mol_type = other RNA
agcggccccagcgtgctgcccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtg

SEQ ID NO: 38153 - RNA, 270 nt, synthetic construct
  misc_feature 1..270: note = derived and/or modified sequence opt4 from IgG1_HeavyChain_CH1_constant_domain
  source 1..270: mol_type = other RNA
agcggccccagcgtgctgcccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagcc

SEQ ID NO: 38154 - RNA, 282 nt, synthetic construct
  misc_feature 1..282: note = derived and/or modified sequence opt4 from IgG1_HeavyChain_CH1_constant_domain
  source 1..282: mol_type = other RNA
agcgccagcaccaagggccccagcgtgttccccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggcc

SEQ ID NO: 38155 - RNA, 282 nt, synthetic construct
  misc_feature 1..282: note = derived and/or modified sequence opt4 from IgG1_HeavyChain_CH1_constant_domain
  source 1..282: mol_type = other RNA
agcgccagcaccaagggccccagcgtgttccccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtg

SEQ ID NO: 38156 - RNA, 282 nt, synthetic construct
  misc_feature 1..282: note = derived and/or modified sequence opt4 from IgG1_HeavyChain_CH1_constant_domain
  source 1..282: mol_type = other RNA
agcgccagcaccaagggccccagcgtgttccccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagcc

SEQ ID NO: 38157 - RNA, 282 nt, synthetic construct
  misc_feature 1..282: note = derived and/or modified sequence opt4 from IgG1_HeavyChain_CH1_constant_domain
  source 1..282: mol_type = other RNA
agcgccagcaccaagggccccagcgtgctgcccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggtg

SEQ ID NO: 38158 - RNA, 282 nt, synthetic construct
  misc_feature 1..282: note = derived and/or modified sequence opt4 from IgG1_HeavyChain_CH1_constant_domain
  source 1..282: mol_type = other RNA
agcgccagcaccaagggccccagcgtgctgcccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagaaggcc

SEQ ID NO: 38159 - RNA, 282 nt, synthetic construct
  misc_feature 1..282: note = derived and/or modified sequence opt4 from IgG1_HeavyChain_CH1_constant_domain
  source 1..282: mol_type = other RNA
agcgccagcaccaagggccccagcgtgctgcccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagtg

SEQ ID NO: 38160 - RNA, 282 nt, synthetic construct
  misc_feature 1..282: note = derived and/or modified sequence opt4 from IgG1_HeavyChain_CH1_constant_domain
  source 1..282: mol_type = other RNA
agcgccagcaccaagggccccagcgtgctgcccctggcccccagcagcaagagcaccagcggcggcaccgccgccctgggctgcctggtgaaggactacttccccgagcccgtgaccgtgagctggaacagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaagagagcc

SEQ ID NO: 38161 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38162 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38163 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38164 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctgctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38165 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctgctgggcgcccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38166 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctgctgggcgcccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38167 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctgctgggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38168 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctgctgggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38169 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctggccggcggccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38170 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctggccggcggccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38171 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctggccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38172 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctggccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38173 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctggccggcgcccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38174 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctggccggcgcccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38175 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctggccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38176 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgagctggccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38177 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccctgggcggccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38178 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccctgggcggccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38179 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38180 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccctgggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38181 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccctgggcgcccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38182 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccctgggcgcccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38183 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccctgggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38184 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccctgggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38185 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38186 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38187 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38188 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccgccggcggccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38189 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccgccggcgcccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38190 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccgccggcgcccccagcgtgttcctgttcccccccaagcccaaggacaccctgatgatcagcagaacccccgaggtgacctgcgtggtggtggacgtgagccacgaggaccccgaggtgaagttcaacgtgtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38191 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccgccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacaacagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38192 - RNA, 330 nt, synthetic construct
  misc_feature 1..330: note = derived and/or modified sequence opt4 from IgG1_HeavyChain_CH2_constant_domain
  source 1..330: mol_type = other RNA
gcccccgaggccgccggcgcccccagcgtgttcctgttcccccccaagcccaaggacaccctgatgatcagcagaacccccgaggtgacctgcgtggtggtggacgtgagccacgaggaccccgaggtgaagttcaactggtacgtggacggcgtggaggtgcacaacgccaagaccaagcccagagaggagcagtacgccagcacctacagagtggtgagcgtgctgaccgtgctgcaccaggactggctgaacggcaaggagtacaagtgcaaggtgagcaacaaggccctgcccgcccccatcgagaagaccatcagcaaggccaag

SEQ ID NO: 38193 - RNA, 318 nt, synthetic construct
  misc_feature 1..318: note = derived and/or modified sequence opt4 from IgG1_HeavyChain_CH3_constant_domain
  source 1..318: mol_type = other RNA
ggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 38194 - RNA, 318 nt, synthetic construct
  misc_feature 1..318: note = derived and/or modified sequence opt4 from IgG1_HeavyChain_CH3_constant_domain
  source 1..318: mol_type = other RNA
ggccagcccagagagccccaggtgtacaccctgccccccagcagagaggagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 38195 - RNA, 318 nt, synthetic construct
  misc_feature 1..318: note = derived and/or modified sequence opt4 from IgG1_HeavyChain_CH3_constant_domain
  source 1..318: mol_type = other RNA
ggccagcccagagagccccaggtgtacaccctgccccccagcagagacgagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 38196 - RNA, 318 nt, synthetic construct
  misc_feature 1..318: note = derived and/or modified sequence opt4 from IgG1_HeavyChain_CH3_constant_domain
  source 1..318: mol_type = other RNA
ggccagcccagagagccccaggtgtacaccctgccccccagcagagacgagctgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 38197 - RNA, 297 nt, synthetic construct
  misc_feature 1..297: note = derived and/or modified sequence opt4 from IgG2_HeavyChain_CH1_constant_domain
  source 1..297: mol_type = other RNA
agcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcaacttcggcacccagacctacacctgcaacgtggaccacaagcccagcaacaccaaggtggacaagaccgtg

SEQ ID NO: 38198 - RNA, 297 nt, synthetic construct
  misc_feature 1..297: note = derived and/or modified sequence opt4 from IgG2_HeavyChain_CH1_constant_domain
  source 1..297: mol_type = other RNA
agcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgaccagcagcaacttcggcacccagacctacacctgcaacgtggaccacaagcccagcaacaccaaggtggacaagaccgtg

SEQ ID NO: 38199 - RNA, 327 nt, synthetic construct
  misc_feature 1..327: note = derived and/or modified sequence opt4 from IgG2_HeavyChain_CH2_constant_domain
  source 1..327: mol_type = other RNA
gccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaag

SEQ ID NO: 38200 - RNA, 327 nt, synthetic construct
  misc_feature 1..327: note = derived and/or modified sequence opt4 from IgG2_HeavyChain_CH2_constant_domain
  source 1..327: mol_type = other RNA
gccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgccagcatcgagaagaccatcagcaagaccaag

SEQ ID NO: 38201 - RNA, 327 nt, synthetic construct
  misc_feature 1..327: note = derived and/or modified sequence opt4 from IgG2_HeavyChain_CH2_constant_domain
  source 1..327: mol_type = other RNA
gccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagccccatcgagaagaccatcagcaagaccaag

SEQ ID NO: 38202 - RNA, 327 nt, synthetic construct
  misc_feature 1..327: note = derived and/or modified sequence opt4 from IgG2_HeavyChain_CH2_constant_domain
  source 1..327: mol_type = other RNA
gccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcgtggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagcagcatcgagaagaccatcagcaagaccaag

SEQ ID NO: 38203 - RNA, 327 nt, synthetic construct
  misc_feature 1..327: note = derived and/or modified sequence opt4 from IgG2_HeavyChain_CH2_constant_domain
  source 1..327: mol_type = other RNA
gccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcatggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgcccccatcgagaagaccatcagcaagaccaag

SEQ ID NO: 38204 - RNA, 327 nt, synthetic construct
  misc_feature 1..327: note = derived and/or modified sequence opt4 from IgG2_HeavyChain_CH2_constant_domain
  source 1..327: mol_type = other RNA
gccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcatggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccgccagcatcgagaagaccatcagcaagaccaag

SEQ ID NO: 38205 - RNA, 327 nt, synthetic construct
  misc_feature 1..327: note = derived and/or modified sequence opt4 from IgG2_HeavyChain_CH2_constant_domain
  source 1..327: mol_type = other RNA
gccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcatggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagccccatcgagaagaccatcagcaagaccaag

SEQ ID NO: 38206 - RNA, 327 nt, synthetic construct
  misc_feature 1..327: note = derived and/or modified sequence opt4 from IgG2_HeavyChain_CH2_constant_domain
  source 1..327: mol_type = other RNA
gccccccccgtggccggccccagcgtgttcctgttcccccccaagcccaaggacaccctgatgatcagcagaacccccgaggtgacctgcgtggtggtggacgtgagccacgaggaccccgaggtgcagttcaactggtacgtggacggcatggaggtgcacaacgccaagaccaagcccagagaggagcagttcaacagcaccttcagagtggtgagcgtgctgaccgtggtgcaccaggactggctgaacggcaaggagtacaagtgcaaggtgagcaacaagggcctgcccagcagcatcgagaagaccatcagcaagaccaag

SEQ ID NO: 38207 - RNA, 318 nt, synthetic construct
  misc_feature 1..318: note = derived and/or modified sequence opt4 from IgG2_HeavyChain_CH3_constant_domain
  source 1..318: mol_type = other RNA
ggccagcccagagagccccaggtgtacaccctgccccccagcagagaggagatgaccaagaaccaggtgagcctgacctgcctggtgaagggcttctaccccagcgacatcgccgtggagtgggagagcaacggccagcccgagaacaactacaagaccaccccccccatgctggacagcgacggcagcttcttcctgtacagcaagctgaccgtggacaagagcagatggcagcagggcaacgtgttcagctgcagcgtgatgcacgaggccctgcacaaccactacacccagaagagcctgagcctgagccccggc

SEQ ID NO: 38208 - RNA, 297 nt, synthetic construct
  misc_feature 1..297: note = derived and/or modified sequence opt4 from IgG4_HeavyChain_CH1_constant_domain
  source 1..297: mol_type = other RNA
agcgccagcaccaagggccccagcgtgttccccctggccccctgcagcagaagcaccagcgagagcaccgccgccctgggctgcctggtgaaggactacttccccgagcccgtgaccgtgagctggaacagcggcgccctgaccagcggcgtgcacaccttccccgccgtgctgcagagcagcggcctgtacagcctgagcagcgtggtgaccgtgcccagcagcagcctgggcaccaagacctacacctgcaacgtggaccacaagcccagcaacaccaaggtggacaagagagtg

SEQ ID NO: 38209 - RNA, 330 nt, synthetic construct
  misc_feature 1..330: note = derived and/or modified sequence opt4 from IgG4_HeavyChain_CH2_constant_domain
  source 1..330: mol_type = other RNA
gcccccgagttcctgggcggccccagcgtgttcctgttcccccccaagcccaaggacaccctgatgatcagcagaacccccgaggtgacctgcgtggtggtggacgtgagccaggaggaccccgaggtgcagttcaactggtacgtggacggcgtggaggtgcacaacgccaagaccaagcccagagaggagcagttcaacagcacctacagagtggtgagcgtgctgaccgtgctgcaccaggactggctgaacggcaaggagtacaagtgcaaggtgagcaacaagggcctgcccagcagcatcgagaagaccatcagcaaggccaag

SEQ ID NO: 38210 - RNA, 318 nt, synthetic construct
  misc_feature 1..318: note = derived and/or modified sequence opt4 from IgG4_HeavyChain_CH3_constant_domain
  source 1..318: mol_type = other RNA
ggccagcccagagagccccaggtgtacaccctgccccccagccaggaggagatgaccaagaaccaggtgagcctgacctgcctggtgaagggcttctaccccagcgacatcgccgtggagtgggagagcaacggccagcccgagaacaactacaagaccaccccccccgtgctggacagcgacggcagcttcttcctgtacagcagactgaccgtggacaagagcagatggcaggagggcaacgtgttcagctgcagcgtgatgcacgaggccctgcacaaccactacacccagaagagcctgagcctgagcctgggc

SEQ ID NO: 38211 - RNA, 1347 nt, synthetic construct
  misc_feature 1..1347: note = derived and/or modified sequence opt5 from AAB-003_gamma1-Chain
  source 1..1347: mol_type = other RNA
gaggtgcagctgctcgaaagcggcgggggactggtccaacccggcgggtcccttagactgtcttgcgccgctagcggattcaccttttccaactacggcatgtcttgggttcggcaggcccctgggaagggactcgagtgggtggcgagcatccgctccggcggcgggagaacatattactctgacaatgtgaaaggacggttcacgattagccgcgataactccaagaataccctgtatcttcagatgaacagcctgagagctgaagacacagccgtctactattgtgtgcggtacgatcactattctggctccagcgactactgggggcagggaaccctcgttacagtgtcttccgccagcaccaaaggcccgtctgtctttcccctggctccttccagcaagtccacatctgggggaaccgccgctctgggctgcctcgtgaaagattacttccccgagcctgttacggtgagctggaactccggcgccctgaccagcggggtccatacatttcccgcggtgcttcaatcttccggactgtatagcctctctagcgtggtcaccgttccttcctctagcctgggcacacagacctacatctgtaatgtgaatcacaagccgtccaacacgaaggtggacaaaaaggtcgaacccaaaagctgcgataagacacatacctgtcctccctgccctgcccccgaggctgccggggctccgtctgtgttcctttttcctcccaaacctaaggacacactgatgatttcccgcacccccgaggttacctgtgtggtcgtggatgttagccacgaagaccccgaggtgaagttcaattggtatgtcgatggagtggaagtccataacgccaaaacaaagcctagagaggagcagtacaattctacgtatcgggtggtttccgtgctcaccgtcctgcaccaggactggctgaacggcaaagaatacaagtgcaaagtgagcaataaggcgctcccggcccccatcgagaaaacaatttccaaggctaaggggcaacctcgcgaaccccaggtttataccctgcctccctctagagaggaaatgacaaagaaccaggtgagccttacctgtctggtcaagggattttacccgtccgatatcgccgtggagtgggagtctaatggccagcctgaaaacaactacaaaacgacaccccctgtgctcgacagcgacggctccttctttctgtatagcaaacttaccgttgataaatctcggtggcaacaggggaatgtcttctcctgcagcgtgatgcacgaggctctgcataaccactacacccagaagtctctctccctgagccccggaaag

SEQ ID NO: 38212 - RNA, 1329 nt, synthetic construct
  misc_feature 1..1329: note = derived and/or modified sequence opt5 from Abagovomab_HeavyChain
  source 1..1329: mol_type = other RNA
caggtgaagctgcaggagagcggcgccgaactcgctagacccggggcctccgtcaaactgtcttgcaaggcgagcggatacaccttcacaaactattggatgcagtgggttaaacagcggcctggccaggggcttgactggatcggagctatttacccgggcgatgggaatacgcgctatacccacaagtttaaaggaaaggccacactgaccgccgacaagtcctctagcacagcttacatgcaactctcctctctggccagcgaggattccggcgtgtattactgtgctagaggcgaagggaactatgcctggttcgcgtactggggacagggcaccacagtgaccgtcagctctgccaaaacgacacccccttccgtgtacccccttgctcctgggagcgccgctcagaccaattctatggttaccctgggatgcctcgtgaagggctattttcccgagcctgtcacagtgacctggaactccgggagcctgtcttccggagttcatacgttcccggccgtgctgcagagcgacctctacacactgtcctctagcgtcaccgtgccctccagcacatggccttctgaaaccgtgacctgtaatgtcgcgcaccccgcctccagcacaaaagttgataagaaaatcgtgcctcgggactgcggctgtaagccctgcatttgtacggtgccggaggtctctagcgtgtttatcttccctcccaagcctaaagatgttcttaccattacactgacccccaaggtgacatgcgtcgtggttgacatctccaaagatgaccccgaggtgcaattttcttggttcgtcgatgacgtggaagtccataccgctcagacgcagcctcgcgaggaacagtttaacagcacattcagatccgtgagcgagctcccgatcatgcaccaagattggctgaatggcaaggagtttaaatgtcgggttaactctgccgctttccccgcccctattgaaaagaccatctccaaaaccaaggggcgccccaaggcccctcaggtgtatacaattcccccgcctaaagagcagatggctaaggacaaagtcagccttacctgcatgatcacagactttttccccgaagatattacggtggagtggcaatggaatggacagcctgcggaaaactacaagaatacccagcccatcatggacacagatggctcttatttcgtttactccaaactgaacgtgcaaaagagcaattgggaggccgggaacacctttacatgttccgtcctccatgagggactgcacaatcaccataccgaaaagtctctgagccactcccctggcaaa

SEQ ID NO: 38213 - RNA, 642 nt, synthetic construct
  misc_feature 1..642: note = derived and/or modified sequence opt5 from Abagovomab_LightChain
  source 1..642: mol_type = other RNA
gacatcgagctgacccagagccccgcctccctctctgctagcgtgggcgaaacagtcacgattacctgccaagcctccgagaacatctactcttatctggcgtggcaccagcagaagcaggggaaaagccctcaacttctggtttacaatgctaagacactcgccggaggcgtgtcctctagattcagcgggtccggaagcggcacccatttttctctgaaaattaagtcccttcagccggaagatttcgggatctattactgtcagcaccattatggcattctgcccacatttggaggcgggaccaaactcgagatcaagcgggccgacgctgcccctacagtgagcatctttcccccttcttccgaacagctgaccagcggaggcgcttctgtcgtgtgcttcctgaacaatttctaccccaaggatattaacgttaaatggaagatcgacgggtccgagcgccaaaatggagtgctcaacagctggacggatcaggactccaaagattctacctatagcatgtccagcacactgacccttacaaaggacgagtacgaaagacacaattcttacacctgtgaggccacgcataaaacatccaccagccctattgtcaagtcttttaaccggaatgaatgc

SEQ ID NO: 38214 - RNA, 1350 nt, synthetic construct
  misc_feature 1..1350: note = derived and/or modified sequence opt5 from Abciximab_HeavyChain
  source 1..1350: mol_type = other RNA
gaggtgcagctgcaacagagcggcgccgaactcgtcaagcccggggcttccgttaaactgtcttgcaccgccagcggattcaacatcaaggacacatacgtgcactgggtgaaacagagacctgagcagggccttgaatggattgggcggatcgatccggcgaatggatatacgaagtacgaccccaaatttcaaggcaaggctaccattacagccgatacctcctctaacacagcctatctgcagctcagctccctgacctctgaggacacagctgtctactattgtgtgcgccctctttacgattattacgccatggactactgggggcagggaaccagcgttacggtgtccagcgctaagaccacagccccctctgtctatcctctggcgcccgtgtgcggcgataccacaggctccagcgttaccctcgggtgtctggtgaaaggatacttccctgaaccggtcacgctgacatggaactctggctccctcagctctggggtgcatacctttcccgccgtgctgcagtccgacctttatacactgagctcctctgtcaccgttaccagctccacatggcctagccaatctatcacgtgcaatgtggctcaccccgcctccagcaccaaggtggataaaaagattgagcctagacccaaatcttgtgacaagacacatacctgcccgccttgtcccgctcctgagctcctgggaggccccagcgtcttcctttttccccctaagccgaaagatacactgatgatctcccggacccccgaagtgacgtgcgttgtggtcgacgtgtctcacgaggatcctgaagttaagttcaattggtacgtggacggggtcgaggtgcataacgccaaaacaaagccccgcgaggaacagtataatagcacctacagagtcgtgtccgttctcaccgtgctgcaccaggactggctgaacggaaaagagtataagtgtaaagtcagcaataaggcgctccctgcccccatcgaaaagacaatttctaaagctaagggccagccgcgggagcctcaagtgtacaccctgcccccttcccgcgatgaacttacgaaaaaccaggttagcctgacatgcctcgtgaagggcttttacccctctgacatcgccgtcgagtgggagtccaatgggcagcctgaaaacaattataaaaccacacccccggtgctggatagcgacggatccttctttctttactctaagctgaccgtggataagagcagatggcaacagggcaacgttttctcctgttctgtcatgcacgaggctctccataatcactatacacagaaaagcctgtccctgagccctgggaag

SEQ ID NO: 38215 - RNA, 642 nt, synthetic construct
  misc_feature 1..642: note = derived and/or modified sequence opt5 from Abciximab_LightChain
  source 1..642: mol_type = other RNA
gacatcctgatgacccagagccccagctctatgagcgtgtccctcggcgatacagtctctattacgtgccacgccagccaagggatctcctctaacattggatggctgcagcagaagcctggcaagagcttcatggggcttatctactatggaaccaatctggttgacggcgtgccgtccagatttagcgggtctggatccggcgctgattacagcctcacaatttcttccctggacagcgaggatttcgccgactattactgtgtgcagtatgcgcaacttccctacacctttggcgggggaacaaaactggaaatcaaacgggctgatgccgcccctaccgtctctatctttcccccttccagcgagcagctcacatccggcggggcttctgtggtttgcttcctgaacaatttctatcccaaggacattaacgtgaaatggaagatcgatggaagcgaacgccagaatggcgtcctgaactcctggaccgaccaggatagcaaggactctacgtactccatgagctctaccctcacactgaccaaagatgagtacgaaagacataatagctatacatgtgaggccacccacaagacgtccacatctcctattgtgaaatcctttaaccggaatgagtgc

SEQ ID NO: 38216 - RNA, 1341 nt, synthetic construct
  misc_feature 1..1341: note = derived and/or modified sequence opt5 from Abituzumab_HeavyChain1
  source 1..1341: mol_type = other RNA
caggtgcaactgcagcagagcggcggggagctcgccaagcccggagcttccgtcaaagtttcttgcaaggccagcggctacaccttctcctctttttggatgcactgggtgagacaggcgcctgggcaaggactggaatggatcggctatattaacccgcggagcgggtacacagagtataatgaaatcttccgcgacaaagctacgatgaccacagatacctccacatctaccgcctacatggagcttagctccctgagaagcgaagacacagccgtgtattactgtgcttcttttctcggacggggcgccatggattattggggccaggggaccacggtcaccgtgtccagcgcttctacaaagggaccctccgttttccctctggccccctgcagccgctctacctccgagagcacagcggcccttggctgtctggtgaaagactactttcctgagcccgtcaccgtgtcctggaactctggggctctcacgagcggagttcatacattccctgccgtgctgcagtccagcggcctgtactctctctccagcgtcgtgaccgtgccgtctagcaattttgggacacagacctatacctgcaacgtcgatcacaagccctccaatacaaaggttgacaaaacggtggaacctaagtctagcgataaaacccatacatgtcccccttgccccgctccgcctgtggccggaccctccgtcttcctgtttcctcccaagcccaaagacacccttatgattagcagaacacctgaggtgacctgtgttgtggtcgatgtgtctcacgaagacccggaggttcaattcaactggtacgtggatggcgtcgaggtgcataatgcgaagacgaagccccgggaggaacaggcccagtccacatttcgcgtcgtgagcgttctgaccgtggtccaccaggactggctcaacggcaaagaatataagtgcaaagtgtctaataaggggctgcctgctcccatcgagaaaaccatttccaagacaaaaggacaacctagagaaccccaggtttacacccttccgcctagccgggaggagatgacaaagaaccaggtgtccctgacgtgtctcgtcaagggcttctatccctctgatatcgccgtggaatgggagagcaatgggcaacctgaaaacaattacaaaaccacaccccctatgctggactccgacggatctttctttctgtatagcaagctcaccgtggataaatcccgctggcagcagggcaacgttttcagctgctctgtcatgcacgaggctctgcataatcactacacacagaagtcccttagcctgtctcccgggaaa

SEQ ID NO: 38217 - RNA, 642 nt, synthetic construct
  misc_feature 1..642: note = derived and/or modified sequence opt5 from Abituzumab_LightChain1
  source 1..642: mol_type = other RNA
gacatccagatgacccaaagcccctcctctctgagcgcctccgtgggcgatagagtcacaattacgtgccgggcttctcaggacatcagcaactacctcgcctggtatcagcagaagcctgggaaagcgccgaagctgcttatttactatacctccaaaatccactctggagttcccagccgcttctccggcagcgggtctggaacagattacacctttacaatttccagcctgcaacctgaggacatcgctacctattactgtcagcagggcaatacattcccctatacctttgggcagggaacgaaggtggaaatcaaaagaaccgtggccgccccttctgtcttcatttttcccccttccgatgagcaactcaagagcggcacagcttctgtggtttgcctgcttaacaatttctacccgcgggaagccaaggtgcagtggaaagtcgacaacgctctgcagtccggcaatagccaggagtccgtgaccgaacaagattctaaggacagcacatactccctcagctctaccctgacgctgtccaaagccgattatgagaagcataaagtttacgcgtgtgaggtgacacaccaggggctcagctctcccgtcaccaagagctttaaccgcggagaatgc

SEQ ID NO: 38218 - RNA, 1332 nt, synthetic construct
  misc_feature 1..1332: note = derived and/or modified sequence opt5 from Abrilumab_HeavyChain1
  source 1..1332: mol_type = other RNA
caggtgcaactggtccagagcggcgccgaggttaagaaacccggggcttccgtgaaggtgtcttgcaaagtcagcggatacaccctctccgacctgtctatccactgggtgagacaggcccctggcaaggggcttgaatggatgggaggcttcgatccgcaggacggggagacaatttatgcgcaaaaatttcagggacgggttacgatgaccgaagatacaagcaccgacacagcttacatggagctgtcctctctcaagagcgaagataccgccgtgtattactgtgccacaggctcctctagctcctggttcgacccctggggccaggggaccctggtcacggtgagctctgcttccaccaagggacctagcgtttttccccttgccccttgctctcgctccacaagcgagtccaccgctgccctgggctgtctcgtgaaagattatttccccgagcctgtcacagtgtcttggaacagcggggcgctgacctccggagtgcatacgtttccggccgtcctgcagagctctggcctctactccctgagctctgttgtgacagtgcccagctccaatttcgggacccaaacatatacctgcaacgtcgaccacaagccttctaataccaaagtggataagacagttgaaagaaaatgttgcgtggagtgtcccccttgccccgctccgcctgtcgccggacccagcgtgtttcttttccctcccaagcccaaggacacgctgatgatctcccggacccctgaagttacatgtgtggtcgtggatgtcagccatgaggacccggaggtgcagtttaactggtacgttgatggcgtggaagtccacaatgctaaaaccaagccccgcgaggaacagttcaactctacatttagagtggtttccgtgctcaccgtcgtgcatcaggactggctgaatggcaaagagtacaagtgcaaagtgagcaacaaggggcttcctgcccccattgagaaaacgatctctaagacaaagggacaacctcgggaaccccaggtttataccctgccgccttcccgcgaggaaatgaccaaaaatcaggtcagcctcacatgtctggtgaagggcttctacccctccgacattgcggtggagtgggaatctaacgggcaacctgagaataactataaaaccacaccccctatgctggatagcgacggatcctttttcctctactctaagctgacggtcgataaaagcagatggcagcagggcaatgtgttctcctgcagcgttatgcacgaagcccttcacaaccattatacccagaagtctctgtccctcagccccgggaag

SEQ ID NO: 38219 - RNA, 642 nt, synthetic construct
  misc_feature 1..642: note = derived and/or modified sequence opt5 from Abrilumab_LightChain1
  source 1..642: mol_type = other RNA
gacatccagatgacccaaagcccctcctctgtgagcgcctccgtcggcgatagagttacaattacgtgccgggcttctcaggggatcagctcctggctggcctggtaccagcagaagcctggaaaagcgccgaagctcctgatttatggcgcttctaaccttgagagcggggtgccctcccgcttcagcggatctggctccgggaccgactttacactgaccatcagctctctccaacctgaagatttcgccaattactattgtcagcaggccaactcctttccctggacattcggacagggcaccaaagtggagattaagagaacagtcgctgcccctagcgtgtttatctttcccccttctgacgaacaactgaaatccggcaccgctagcgttgtgtgccttctgaataacttctacccgcgggaggccaaggtccagtggaaggtggataatgcgctccagtccgggaactctcaggaaagcgttacggagcaagactccaaagatagcacctattctctgtccagcacactgaccctctctaaggccgactacgagaaacacaaggtgtatgcttgtgaagtcacacatcagggactgagctcccccgtgaccaaatctttcaatcgcggcgagtgc

SEQ ID NO: 38220 - RNA, 639 nt, synthetic construct
  misc_feature 1..639: note = derived and/or modified sequence opt5 from Abrilumab_LightChain1_variant2
  source 1..639: mol_type = other RNA
cagatcgtgctgacccaaagccccgccattatgtccgcttctcctggcgagaaggtcacaatcacgtgcagcgcctcctctagcgtttcctacatgaactggttccagcagaaaccggggacctctcccaagctctggatttatagcacatccaatctggcgagcggagtgcctgctagattttctggctccgggagcggaacctcttactcccttacaatcagccggatggaagccgaggacgccgctacctattactgtcagcaaagatcttcctatcccaacacattcggcgggggaaccaaactggaaattaagcgcgccgatgctgcccctacggtgagcatctttcccccttcctctgagcagctcaccagcggcggcgcgtccgtcgtgtgcttcctgaataacttttacccgaaagacatcaatgttaagtggaagattgatgggagcgaacggcagaacggagtgcttaattcttggacagaccaggattccaaagacagcacctattctatgagctccacactgaccctcacgaaggatgagtacgagcgccacaactcttacacatgtgaagccacccataaaacaagcacctcccccatcgtcaagagcttcaatagaaacgagtgc

SEQ ID NO: 38221 - RNA, 1347 nt, synthetic construct
  misc_feature 1..1347: note = derived and/or modified sequence opt5 from Actoxumab_HeavyChain1
  source 1..1347: mol_type = other RNA
gaggtgcagctggtccaaagcggcgccgaagttaagaaatccggggagtctctcaagatcagctgcaaaggatccggctactctttcaccagctattggattgggtgggtgagacagatgcccggaaagggcctggaatggatggggatcttttaccctggagactcctctacacggtatagcccgtccttccagggccaggtgacgattagcgctgataaatctgtcaacaccgcctaccttcaatggtccagcctgaaggcgtctgacacagctatgtattactgtgcccgcagacggaattggggcaacgcctttgatatctgggggcagggaaccatggtgacagtttccagcgcttctaccaagggcccctccgtgttccctctcgcccccagctccaaatctacaagcgggggaaccgctgccctgggctgccttgtcaaggactattttcctgagcccgtgacggtttcctggaatagcggggcgctgacctctggagtgcacacattccctgccgtcctccagtccagcggcctgtactctctgagctccgtggtgaccgtcccgtctagctccctcggcacacagacctacatttgtaacgttaatcataaacccagcaacacgaaggtggataaacgcgtggaacctaagtcttgcgacaagacacacacctgtcccccttgccccgctccggagctgcttgggggaccttccgtctttctgtttccccctaaacccaaggatacactcatgatcagcagaacccccgaggtgacctgtgttgtggtcgacgtgtctcatgaagatcctgaggttaaattcaattggtatgtggacggcgtcgaagtgcacaacgccaagacaaaaccgcgggaggagcaatacaattccacgtatcgcgtcgtgagcgttctgaccgtgcttcatcaggattggctgaacgggaaggaatacaaatgcaaggtctccaataaggctctccccgcccctatcgagaaaacaatttctaaggcgaaaggacagcccagagaacctcaggtgtataccctgcccccgagccgggaggaaatgacaaagaaccaagtttccctgacctgtctcgtgaaaggcttctacccttctgacatcgccgtcgagtgggagagcaatgggcagcccgaaaacaattataagacgacacctcccgtgctggattccgacggcagctttttcctttactctaagctgaccgtggacaaatcccgctggcagcaaggaaacgtttttagctgctctgtcatgcacgaggctctccacaaccattacacccagaagtccctgagcctttctcctggcaaa

SEQ ID NO: 38222 - RNA, 645 nt, synthetic construct
  misc_feature 1..645: note = derived and/or modified sequence opt5 from Actoxumab_LightChain1
  source 1..645: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttccacctggacatttggccagggcaccaaagtggagatcaagagaacggtggctgcccctagcgtcttcatttttcccccttctgatgaacagctcaaatccgggaccgctagcgtggtttgcctgctgaacaatttctacccgcgggaggccaaggtgcaatggaaagtcgacaacgcgctccagtccggaaattctcaggagagcgtgacagaacaggattccaaggacagcacctattctctgtccagcacacttaccctgtctaaggccgattacgagaaacacaaggtttacgcttgtgaagtgacgcatcaaggcctcagctcccccgtcacaaaatcttttaaccgcggggagtgc

SEQ ID NO: 38223 - RNA, 672 nt, synthetic construct
  misc_feature 1..672: note = derived and/or modified sequence opt5 from Adalimumab_HeavyChain
  source 1..672: mol_type = other RNA
gaggtgcagctggtcgaaagcggcgggggactcgttcaacccggcagatccctgcggctttcttgcgccgctagcgggttcacctttgacgattacgccatgcactgggtgcgccaggcgcctggaaagggcctggagtgggtgtccgctatcacatggaactctgggcatattgactatgccgatagcgtcgaaggaagattcacgatctcccgggacaatgccaaaaactctctctacctgcagatgaatagccttcgcgctgaggataccgccgtgtattactgtgctaaggtttcctatctgagcacagcctcttccctcgactactggggccagggcaccctggtgacagtcagctctgcgtccaccaaagggccgagcgtgtttcccctggccccttcttccaagagcacatccggaggcaccgctgccctcgggtgcctggttaaagattatttccccgaacctgtgacggtctcttggaacagcggagctcttacctccggcgtgcacacatttcccgccgtgctgcaaagctctgggctctactccctgagctctgtcgttaccgtgcctagctcctctcttggaacacagacctacatttgtaatgtgaaccataagccgagcaatacgaaggtcgacaaaaaggtggagcccaaatcctgc

SEQ ID NO: 38224 - RNA, 642 nt, synthetic construct
  misc_feature 1..642: note = derived and/or modified sequence opt5 from Adalimumab_LightChain
  source 1..642: mol_type = other RNA
gacatccagatgacccaaagcccctcctctctgagcgcctccgtgggcgatagagtcacaattacgtgccgggcttctcaggggatccgcaactacctcgcctggtatcagcagaagcctggaaaagcgccgaagctgcttatttacgctgccagcaccctgcaatccggcgttccctctagattcagcgggtccggaagcggcacagactttaccctcacaatctcttccctgcagcctgaggatgtggccacctattactgtcagcggtataatcgcgctccctacacattcgggcagggaaccaaagtggaaattaagagaacggtcgccgctcctagcgtgtttatctttcccccttctgacgagcaacttaaatccggcaccgccagcgttgtgtgcctgctcaacaatttctatccgcgggaagcgaaggtccagtggaaggtggataacgccctgcagtctggcaattcccaggagagcgttacagaacaagactccaaagattctacctacagcctgtccagcacactcaccctgtctaaggctgactacgagaaacacaaggtgtatgcctgtgaggtcacgcatcaggggctttccagccccgtgacaaaatctttcaaccgcggagaatgc

SEQ ID NO: 38225 - RNA, 1359 nt, synthetic construct
  misc_feature 1..1359: note = derived and/or modified sequence opt5 from Aducanumab_HeavyChain1
  source 1..1359: mol_type = other RNA
caggtgcaactggtcgagagcggcgggggagttgtgcagcccggcagatccctccggctgtcttgcgccgctagcgggttcgccttttcctcttacggaatgcactgggtgcgccaggcgcctggcaaggggcttgaatgggtcgctgtgatctggttcgacggaaccaaaaagtattacacagatagcgttaaaggcagatttacgatttcccgggacaactctaagaataccctgtatctccagatgaacacactgcgcgccgaggataccgccgtgtactattgtgctagagaccggggcatcggggcccgcagaggaccgtactatatggatgtctggggcaaagggacaaccgtgacagttagctccgctagcaccaagggaccctctgtgttccctcttgccccctccagcaagtctacgtccggcgggaccgcggccctgggatgcctcgtcaaagactactttcctgaacccgtgacagtgagctggaatagcggcgctctgacctccggcgtccatacattccctgccgttctgcaaagctccgggctctactctctgagctccgtggtgaccgtcccgtcttcttcccttggaacgcagacatatatttgtaacgtgaatcacaagcccagcaacaccaaagttgataagcgggtggagcctaaatcttgcgacaagacacatacctgtcccccttgccccgctccggaactgctcggcgggcctagcgtctttctgtttccccctaagcccaaagatacccttatgatctcccgcacacccgaggtgacgtgtgttgtggtcgacgtgtctcacgaggatcctgaagtcaagttcaattggtacgtggacggagttgaggtgcataacgccaaaaccaagccgagagaggaacagtataatagcacataccgggtcgtgtccgttctgaccgtgctccaccaggattggctgaacggcaaagagtataagtgcaaagtcagcaataaggcgctgcccgcccctattgaaaagacaatctctaaagctaaggggcaaccccgcgagcctcaggtgtacacccttcccccgtccagagaagagatgacgaaaaaccaggtgagcctgacatgtcttgttaagggattctatccttctgacatcgccgtcgaatgggagtccaatggccagcccgagaacaattacaaaaccacccctcccgtgctggacagcgatggctcctttttcctctactctaagctgacagtggacaagagccggtggcaacaggggaacgtcttttcctgctctgtgatgcacgaagctctccataaccactatacccagaaaagcctgtccctcagccctgga

SEQ ID NO: 38226 - RNA, 642 nt, synthetic construct
  misc_feature 1..642: note = derived and/or modified sequence opt5 from Aducanumab_LightChain1
  source 1..642: mol_type = other RNA
gacatccagatgacccaaagcccctcctctctgagcgcctccgtgggcgatagagtcacaattacgtgccgggcttctcagagcatctcctcttacctcaactggtatcagcagaaacctgggaaagccccgaagctgcttatttacgcggctagctccctgcaaagcggagttccctctcgcttctccggcagcgggtctggaaccgactttacactcaccatctccagcctgcagcctgaggatttcgccacatattactgtcagcagtcttattccacaccccttacctttggcgggggaaccaaagtggaaattaagagaacggtggccgctcctagcgtcttcatctttcccccttccgacgagcaactgaaatctggcaccgccagcgtggtttgcctcctgaataacttctacccgcgggaagctaaggtgcagtggaaggtcgataatgccctgcagtccggcaacagccaggagtctgtgacagaacaagactccaaagatagcacctattctctcagctccacactgaccctttctaaggcggactacgagaaacacaaggtttacgcctgtgaggtgacgcatcaggggctgagctcccccgtcacaaagagctttaatcgcggagaatgc

SEQ ID NO: 38227 - RNA, 1359 nt, synthetic construct
  misc_feature 1..1359: note = derived and/or modified sequence opt5 from Afasevikumab_HeavyChain1
  source 1..1359: mol_type = other RNA
gaggtgcagctggtcgaaagcggcgggggactcgttcaacccggcagatccctgcggctttcttgcgccgctagcgggttcacctttgacgattacgccatgcactgggtgcgccaggcgcctggaaagggcctggagtgggtgtccgggatcaactggtctagcggaggcattggctatgctgactccgtcaaagggagattcacaatctctcgggataatgccaagaacagcctctacctgcagatgaactcccttcgcgccgaagacacggctctgtattactgtgccagagatattggaggctttggggagttctattggaattttggactctggggccgggggaccctggtgacagttagctctgcttccaccaaaggaccgagcgtgttccccctggccccttcttccaagagcacatctggcggcaccgcggccctcgggtgcctggtcaaagactactttcccgaacctgtgacagtttcctggaatagcggagctcttacctccggcgtgcatacgttccccgccgtcctgcagtctagcgggctctattccctgagctctgtggtgaccgtcccttccagctctcttggaacacaaacctacatctgtaacgttaatcacaagccgagcaacacaaaggtggataaacgcgtggagcccaagtcctgcgacaaaacccatacgtgtcctccctgccctgctcccgagctgctcggcgggccgtctgtctttctgttccctcccaagcctaaagatacactgatgattagcagaacccccgaagtgacatgtgttgtggtcgacgtgtcccacgaggatcccgaagttaagtttaattggtacgtggacggagtcgaggtgcataacgccaagaccaaacctcgggaggaacagtataatagcacctaccgcgtcgtgtctgttctcacagtgctgcaccaggattggcttaacggcaaggagtataaatgcaaggtctccaataaagcgctgccggcccccatcgaaaagacgatcagcaaagctaagggccagcctagagagccccaagtgtacaccctccctccctctcgggaagagatgacaaagaaccaggtttccctgacctgtcttgtgaaagggttctatccgagcgacattgccgtcgagtgggaatccaatggacagcctgagaacaactacaagacaacgccccctgtgctggactctgatggcagctttttcctctattccaaactgaccgtggacaagtctcgctggcagcaagggaatgttttcagctgctccgtcatgcacgaagctctgcataaccactacacacagaaaagcctctctctgtcccccggaaag

SEQ ID NO: 38228 - RNA, 645 nt, synthetic construct
  misc_feature 1..645: note = derived and/or modified sequence opt5 from Afasevikumab_LightChain1
  source 1..645: mol_type = other RNA
gagatcgtgctgacccagagccccgccacactctccctgtctcctggcgaaagagctacgcttagctgccgggcctcccaatctgtccgcagctacctggcgtggtatcagcagaagccggggcaggctcccagactcctgatttacgacgcctccaaccgggccaccggaatccctgctcgcttctctggcagcgggtccggaacagattttacccttacaattagctctctggagcccgaagacttcgccgtttattactgtcaacagagatccaattggcctcccgctacctttggcgggggaacaaaagtggagatcaagcggaccgtggccgcgcctagcgtcttcatttttccgccctctgatgaacagctcaaatccggcacggccagcgtggtttgcctgctgaacaatttctatcctcgcgaggctaaggtgcagtggaaagtcgacaacgccctccaatctggcaattcccaggagagcgtgaccgaacaggattccaaggactctacatacagcctgtccagcacccttacactgtctaaggctgattatgagaaacacaaggtttacgcctgtgaagtgacccatcaggggctctccagccccgtcacgaaatcttttaacagaggagagtgc

SEQ ID NO: 38229 - RNA, 1293 nt, synthetic construct
  misc_feature 1..1293: note = derived and/or modified sequence opt5 from Aflibercept_Fusion_protein1
  source 1..1293: mol_type = other RNA
agcgacaccggcagacccttcgtggagatgtactccgaaatccctgagattatccacatgacagaagggcgggagctggtcattccgtgccgcgttacgtctcccaacatcaccgtgacactcaagaaatttcctctggatacccttattcccgacggaaagagaatcatctgggatagccggaaaggcttcattatctccaatgccacatataaggaaattgggctgctcacctgtgaggctacagtgaacggacatctgtacaaaaccaattatcttacgcaccgccagaccaacacaatcattgacgtcgtgctgtctcctagccatggcatcgagctctccgttggggaaaagctggtgctgaattgcaccgccagaacagagctcaacgtcggaattgattttaattgggaatacccctctagcaagcaccaacataaaaagctggtgaaccgggaccttaaaacccagtccggcagcgagatgaagaaattcctgtctacgctcacaatcgatggcgttacccgctccgaccaggggctgtatacatgtgcggctagctctggacttatgaccaagaaaaattccacctttgtgagagtccacgagaaggataagacacacacgtgccctccgtgtcccgcccctgaactgctcggcgggcccagcgtgttcctgtttcctcccaaaccgaaggacaccctgatgatctctcggacacctgaggtgacctgcgtcgttgtggatgtgtcccatgaagaccccgaggtcaaattcaactggtacgtggatggagttgaagtgcacaatgccaagacaaaacctcgcgaggagcagtataacagcacctacagagtcgtgtccgttctcacggtgctgcatcaagactggcttaatggcaaggaatacaagtgtaaagtctctaacaaggctctgcccgcccccattgagaaaacaatcagcaaggctaaagggcagcctcgggaaccccaggtgtataccctcccgccttcccgcgacgagctgaccaagaatcaggtcagccttacatgcctggtgaagggattttacccctctgatattgccgttgaatgggagtccaacggccaacctgagaacaattataaaaccacacccccggtgctcgacagcgatggctctttctttctgtacagcaagctgacggtcgacaaatccagatggcagcaggggaacgtgttctcttgtagcgttatgcacgaagcgctccacaatcattatacccagaagtccctgagcctttctcctgga

SEQ ID NO: 38230 - RNA, 1332 nt, synthetic construct
  misc_feature 1..1332: note = derived and/or modified sequence opt5 from Afutuzuab_HeavyChain1
  source 1..1332: mol_type = other RNA
caggtgcaactggtccagagcggcgccgaggttaagaaacccgggtcctctgtgaaggtgagctgcaaggcttccggatacgccttctcttatagctggatcaactgggtcagacaggcgcctggccaggggctcgaatggggacggatttttccgggcgacggggataccgactacaatggaaaattcaaaggccgcgtgacaatcacggctgataagtccacctctacagcctatgagctgagctcccttagaagcgaagacaccgccgtttactattgtgctcggaacgtgtttgatggctactggctggtctattgggggcaaggaacactcgtgaccgtttcttccgccagcacaaagggcccctctgtgttccctctggctccctccagcaaatctacctccgggggaacggccgcgcttggctgcctggtcaaggactactttcctgagcccgtgaccgtgagctggaactccggggccctcacatctggagtccacaccttccctgctgttctgcagagctccggcctgtacagcctctcttccgtggtgacagtcccgagctctagcctgggcacccagacgtatatttgtaatgtgaatcataaaccctccaacacaaaggttgataaaaaggtggaacctaagtcttgcgacaaaacccacacatgtcccccttgccccgccccggagcttctcgggggacctagcgtctttctgtttccccctaagcccaaagataccctgatctcccgcacccccgaggtgacatgtgttgtggtcgacgtgagccatgaagatcctgaggtcaagttcaattggtacgtggacggcgttgaagtgcacaacgctaaaacgaagccgagagaggagcagtataattctacctaccgggtcgtgtccgttcttacagtgctgcatcaagattggctcaacgggaaagaatataagtgcaaggtcagcaataaagccctgcccgcgcctattgagaagaccatctctaaagccaagggacagccccgcgaacctcaggtgtacacactgcccccgtccagagacgagctcaccaaaaaccaggtgagcctgacgtgtcttgttaagggcttctatccttccgacatcgctgtcgaatgggagtctaatgggcaacccgagaacaattacaagacaacccctcccgtgctggatagcgacggatcctttttcctctactctaaactgaccgtggataagagccggtggcagcagggcaacgtcttttcctgcagcgtgcacgaagcccttcacaaccattatacacaaaaatctctgtccctcagccctggc

SEQ ID NO: 38231 - RNA, 651 nt, synthetic construct
  misc_feature 1..651: note = derived and/or modified sequence opt5 from Afutuzuab_LightChain1
  source 1..651: mol_type = other RNA
gacatcgtgacccagacacccctgagcctccctgtcacgccgggcgagcccgcctccatttcttgcagaagctccaagtctctgcttcacagcaacgggatcacctacctgtattggtacctccaaaaacctggacagtctccccagctgcttatttatcagtccaatctggttagcggcgtgcctgatcggttctccgggagcggatctggcacagactttaccctcaagatctcccgcgtggaagctgaggatgtcggggtgtactattgtgcccaaaacctggaactgccctacacattcggaggcggcaccaaagttgagattaagagaacagtggcggctcctagcgtctttatcttcccgccctctgacgaacagctcaaatccgggaccgccagcgtggtttgcctgcttaataacttttatcctcgggaggccaaggtgcagtggaaggtcgataatgctctgcagtctggaaactcccaagagagcgtgacggaacaggactccaaagattctacctacagcctctccagcacactgaccctttctaaggccgactacgagaaacataaggtgtatgcttgtgaagtcacacaccagggcctgtccagccccgttaccaaatctttcaatcgcggggagtgc

SEQ ID NO: 38232 - RNA, 1347 nt, synthetic construct
  misc_feature 1..1347: note = derived and/or modified sequence opt5 from Afutuzumab_HeavyChain1
  source 1..1347: mol_type = other RNA
caggtgcaactggtccagagcggcgccgaggttaagaaacccgggtcctctgtgaaggtgagctgcaaggcttccggatacgccttctcttatagctggatcaactgggtcagacaggcgcctggccaggggctcgaatggatgggacggatttttccgggcgacggggataccgactacaatggaaaattcaaaggccgcgtgacaatcacggctgataagtccacctctacagcctatatggagctgagctcccttagaagcgaagacaccgccgtttactattgtgctcggaacgtgtttgatggctactggctggtctattgggggcaaggaacactcgtgaccgtttcttccgccagcacaaagggcccctctgtgttccctctggctccctccagcaaatctacctccgggggaacggccgcgcttggctgcctggtcaaggactactttcctgagcccgtgaccgtgagctggaactccggggccctcacatctggagtccacaccttccctgctgttctgcagagctccggcctgtacagcctctcttccgtggtgacagtcccgagctctagcctgggcacccagacgtatatttgtaatgtgaatcataaaccctccaacacaaaggttgataaaaaggtggaacctaagtcttgcgacaaaacccacacatgtcccccttgccccgccccggagcttctcgggggacctagcgtctttctgtttccccctaagcccaaagataccctgatgatctcccgcacccccgaggtgacatgtgttgtggtcgacgtgagccatgaagatcctgaggtcaagttcaattggtacgtggacggcgttgaagtgcacaacgctaaaacgaagccgagagaggagcagtataattctacctaccgggtcgtgtccgttcttacagtgctgcatcaagattggctcaacgggaaagaatataagtgcaaggtcagcaataaagccctgcccgcgcctattgagaagaccatctctaaagccaagggacagccccgcgaacctcaggtgtacacactgcccccgtccagagacgagctcaccaaaaaccaggtgagcctgacgtgtcttgttaagggcttctatccttccgacatcgctgtcgaatgggagtctaatgggcaacccgagaacaattacaagacaacccctcccgtgctggatagcgacggatcctttttcctctactctaaactgaccgtggataagagccggtggcagcagggcaacgtcttttcctgcagcgtgatgcacgaagcccttcacaaccattatacacaaaaatctctgtccctcagccctggcaag

SEQ ID NO: 38233 - RNA, 657 nt, synthetic construct
  misc_feature 1..657: note = derived and/or modified sequence opt5 from Afutuzumab_LightChain1
  source 1..657: mol_type = other RNA
gacatcgtgatgacccagacacccctgagcctccctgtcacgccgggcgagcccgcctccatttcttgcagaagctccaagtctctgcttcacagcaacgggatcacctacctgtattggtacctccaaaaacctggacagtctccccagctgcttatttatcagatgtccaatctggttagcggcgtgcctgatcggttctccgggagcggatctggcacagactttaccctcaagatctcccgcgtggaagctgaggatgtcggggtgtactattgtgcccaaaacctggaactgccctacacattcggaggcggcaccaaagttgagattaagagaacagtggcggctcctagcgtctttatcttcccgccctctgacgaacagctcaaatccgggaccgccagcgtggtttgcctgcttaataacttttatcctcgggaggccaaggtgcagtggaaggtcgataatgctctgcagtctggaaactcccaagagagcgtgacggaacaggactccaaagattctacctacagcctctccagcacactgaccctttctaaggccgactacgagaaacataaggtgtatgcttgtgaagtcacacaccagggcctgtccagccccgttaccaaatctttcaatcgcggggagtgc

SEQ ID NO: 38234 - RNA, 684 nt, synthetic construct
  misc_feature 1..684: note = derived and/or modified sequence opt5 from Alacizumab_pegol_HeavyChain1
  source 1..684: mol_type = other RNA
gaggtgcagctggtcgaaagcggcgggggactcgttcaacccggcgggtccctgagactttcttgcgccgctagcggattcaccttttcctcttacggcatgagctgggtgcggcaggcccctgggaagggactggagtgggtggcgacaatcacgtccggcggctcttatacctactatgtcgacagcgtgaaagggcgcttcacaatttccagagataacgctaagaataccctctacctgcagatgaacagccttcgggccgaagacacagccgtttattactgtgtgcgcatcggagaggatgctctggactattggggccaggggaccctcgtcacagtgtcttccgccagcaccaaaggaccgtctgtttttcccctggctccttccagcaagtctacgtccggcgggaccgccgcgctgggatgcctcgtgaaagattacttccccgaacctgtcacagtgagctggaactccggcgccctgacctctggcgtgcacacatttcccgctgtccttcaaagctccgggctgtacagcctctcttccgttgtgaccgtgcctagctctagcctgggaacgcagacatatatttgtaatgtcaatcataagccgtccaacaccaaggtggacaaaaaggttgagcccaaatcttgcgataagacacacacctgtgccgct

SEQ ID NO: 38235 - RNA, 642 nt, synthetic construct
  misc_feature 1..642: note = derived and/or modified sequence opt5 from Alacizumab_pegol_LightChain1
  source 1..642: mol_type = other RNA
gacatccagatgacccaaagcccctcctctctgagcgcctccgtgggcgatagagtcacaattacgtgccgggcttctcaggacatcgccgggagcctcaactggctgcagcagaagcctggaaaagcgattaagcgccttatctacgctacctcctctctggatagcggcgttccgaaaagattctccgggagccggtctggatccgactatacactcaccattagctctctgcaacccgaggattttgccacatactattgtcttcagtacggctccttccctcccacctttgggcagggaacaaaggtggaaatcaaacgcaccgtggccgctcctagcgtcttcatctttcccccttctgacgagcagctgaagtccggcacggccagcgtggtttgcctcctgaataacttctatccgagagaagctaaggtgcaatggaaagtcgataatgccctgcagtccggcaactctcaggagagcgtgaccgaacaggactccaaggatagcacatactctctctccagcaccctgacactttctaaagcggactatgagaagcacaaagtttacgcctgtgaggtgacccatcaagggctgagctcccccgtcacgaagtcttttaatcggggagaatgc

SEQ ID NO: 38236 - RNA, 1353 nt, synthetic construct
  misc_feature 1..1353: note = derived and/or modified sequence opt5 from Alemtuzumab_HeavyChain
  source 1..1353: mol_type = other RNA
caggtgcaactgcaggagagcggccccgggctcgtcagaccttcccagaccctgtctcttacatgcacggttagcggattcacctttacagacttctacatgaactgggtgcggcagccgcccggccgcgggctggaatggatcggatttattagagataaggccaaaggctataccacagagtacaatccttccgtgaaggggcgggtcaccatgctcgtggacacatctaaaaaccaattcagcctgcgcctttcctctgttaccgctgccgatacggcggtgtattactgtgctagagaaggacacaccgccgccccctttgactattggggccagggcagcctggtcacagtgtccagcgcttctaccaaggggccttccgttttccccctcgcccctagctctaaatccacaagcggaggcaccgctgccctggggtgcctggtgaaggattactttccggagcccgtcacggtgtcttggaactccggagcgctcacaagcggcgtgcataccttccctgccgtcctgcagtcctctgggctttatagcctgtccagcgttgtgacagtgccctcttccagcctcggaacccagacctacatctgtaatgtcaatcacaagccttctaacacaaaagtggacaagaaagttgaacccaagagctgcgataaaacgcatacctgtccgccttgccccgctcctgagctgcttggcggcccctccgtgtttctgtttccccctaagccgaaggacacactcatgatttctcggacccccgaggtcacatgtgtggttgtggatgtcagccacgaagaccctgaggtgaaatttaattggtacgtcgatggggtggaagttcataacgccaagaccaaaccccgcgaggagcaatataattccacgtacagagtggtcagcgtgctgacagttctgcaccaggactggctcaacggaaaggaatataaatgcaaggtgtctaataaagctctgcctgcccccatcgagaagaccatttccaaggcgaaaggccagccgcgggaacctcaggtctacacccttccccctagccgcgatgagctgacaaagaaccaagtgtctctcacctgtctggtgaaagggttctatccctccgacatcgccgttgaatgggagagcaatggacagcctgagaacaattacaagacaacgcccccggtccttgactccgatggctctttcttcctgtatagcaaactcaccgtggacaagtccagatggcagcaagggaacgtgttctcttgcagcgtcatgcacgaagctctgcataaccactacacacagaagtccctgagcctctctcctggaaaa

SEQ ID NO: 38237 - RNA, 657 nt, synthetic construct
  misc_feature 1..657: note = derived and/or modified sequence opt5 from Alemtuzumab_HeavyChain_variant_1bey_H
  source 1..657: mol_type = other RNA
caggtgcaactgcaggagagcggccccgggctcgtcagaccttcccagaccctgtctcttacatgcacggttagcggattcacctttacagacttctacatgaactgggtgcggcagccgcccggccgcgggctggaatggatcggatttattagagataaggccaaaggctataccacagagtacaatccttccgtgaaggggcgggtcaccatgctcgtggacacatctaaaaaccaattcagcctgcgcctttcctctgttaccgctgccgatacggcggtgtattactgtgctagagaaggacacaccgccgccccctttgactattggggccagggcagcctggtcacagtgtccagcgcttctaccaaggggccttccgttttccccctcgcccctagctctaaatccacaagcggaggcaccgctgccctggggtgcctggtgaaggattactttccggagcccgtcacggtgtcttggaactccggagcgctcacaagcggcgtgcataccttccctgccgtcctgcagtcctctgggctttatagcctgtccagcgttgtgacagtgccctcttccagcctcggaacccagacctacatctgtaatgtcaatcacaagccttctaacacaaaagtggacaagaaagtt

SEQ ID NO: 38238 - RNA, 660 nt, synthetic construct
  misc_feature 1..660: note = derived and/or modified sequence opt5 from Alemtuzumab_HeavyChain_variant_1ce1_H
  source 1..660: mol_type = other RNA
caggtgcaactgcaggagagcggccccgggctcgtcagaccttcccagaccctgtctcttacatgcacggttagcggattcacctttacagacttctacatgaactgggtgcggcagccgcccggccgcgggctggaatggatcggatttattagagataaggccaaaggctataccacagagtacaatccttccgtgaaggggcgggtcaccatgctcgtggacacatctaaaaaccaattcagcctgcgcctttcctctgttaccgctgccgatacggcggtgtattactgtgctagagaaggacacaccgccgccccctttgactattggggccagggcagcctggtcacagtgtccagcgcttctaccaaggggccttccgttttccccctcgcccctagctctaaatccacaagcggaggcaccgctgccctggggtgcctggtgaaggattactttccggagcccgtcacggtgtcttggaactccggagcgctcacaagcggcgtgcataccttccctgccgtcctgcagtcctctgggctttatagcctgtccagcgttgtgacagtgccctcttccagcctcggaacccagacctacatctgtaatgtcaatcacaagccttctaacacaaaagtggacaagaaagttgaa

SEQ ID NO: 38239 - RNA, 1311 nt, synthetic construct
  misc_feature 1..1311: note = derived and/or modified sequence opt5 from Alemtuzumab_HeavyChain_variant_8005_H
  source 1..1311: mol_type = other RNA
caggtgcaactgcaggagagcggccccgggctcgtcagaccttcccagaccctgtctcttacatgcacggttagcggattcacctttacagacttctacatgaactgggtgcggcagccgcccggccgcgggctggaatggatcggatttattagagataaggccaaaggctataccacagagtacaatccttccgtgaaggggcgggtcaccatgctcgtggacacatctaaaaaccaattcagcctgcgcctttcctctgttaccgctgccgatacggcggtgtattactgtgctagagaaggacacaccgccgccccctttgactattggggccagggcagcctggtcacagtgtccagcgcttctaccaaggggccttccgttttccccctcgcccctagctctaaatccacaagcggaggcaccgctgccctggggtgcctggtgaaggattactttccggagcccgtcacggtgtcttggaactccggagcgctcacaagcggcgtgcataccttccctgccgtcctgcagtcctctgggctttatagcctgtccagcgttgtgacagtgccctcttccagcctcggaacccagacctacatctgtaatgtcaatcacaagccttctaacacaaaagtggacaagaaagttgaagctcccgagctgcttggcggcccgagcgtgtttctgttccctcccaagcctaaagatacgctcatgatttcccggacccccgaggtcacatgcgtggttgtggacgtctctcatgaagatcccgaggtgaagtttaattggtacgtcgacggggtggaagttcacaacgccaagaccaaacctcgcgaggagcaatataatagcacatacagagtggtctccgtgctgaccgttctgcatcaggattggctcaacggaaaggaatataaatgtaaggtgagcaataaagctctgccggcccccatcgagaagacgatttctaaagcgaagggccagcctcgggaaccccaggtctacacacttcctccctcccgcgacgagctgaccaagaaccaagtgagcctgacctgcctcgtgaaagggttctatccgtctgatatcgccgttgaatgggagtccaatggacagcctgagaacaattacaagacaacaccccctgtccttgacagcgacggctcctttttcctgtattctaaactcaccgtggataagagcagatggcagcaagggaacgtgttctcctgttctgtcatgcacgaagctctgcacaaccattacacgcagaaaagcctgtccctcagccccggaaag

SEQ ID NO: 38240 - RNA, 633 nt, synthetic construct
  misc_feature 1..633: note = derived and/or modified sequence opt5 from Alemtuzumab_LightChain
  source 1..633: mol_type = other RNA
gacatccagatgacccaaagcccctcctctctgagcgcctccgtgggcgatagagtcacaattacgtgcaaggcttctcagaacatcgacaaatacctcaattggtatcagcagaagcctgggaaagccccgaagctgcttatttacaacaccaataacctgcaaacaggagttcccagccggttctccggctctgggagcggaaccgattttacattcaccatctccagcctccagcctgaggacattgcgacatattactgtctgcagcacatctctcgccccagaacctttggccaggggacgaaagtggaaatcaagcggaccgtggctgccccttccgtcttcatttttccccctagcgatgagcaacttaagtctggaacagcctccgtggtttgcctgctcaataacttctatccgcgcgaagctaaagtgcagtggaaggtcgacaatgccctgcagagcggcaactctcaggagtccgtgaccgaacaagatagcaaagactccacatactctctgagctccaccctcacgctgagcaaggctgattatgagaaacataaggtttacgcctgtgaggtgacacaccagggcctttcttcccccgtcaccaagagctttaataga

SEQ ID NO: 38241 - RNA, 642 nt, synthetic construct
  misc_feature 1..642: note = derived and/or modified sequence opt5 from Alemtuzumab_LightChain_variant_8005_L
  source 1..642: mol_type = other RNA
gacatccagatgacccaaagcccctcctctctgagcgcctccgtgggcgatagagtcacaattacgtgcaaggcttctcagaacatcgacaaatacctcaattggtatcagcagaagcctgggaaagccccgaagctgcttatttacaacaccaataacctgcaaacaggagttcccagccggttctccggctctgggagcggaaccgattttacattcaccatctccagcctccagcctgaggacattgcgacatattactgtctgcagcacatctctcgccccagaacctttggccaggggacgaaagtggaaatcaagcggaccgtggctgccccttccgtcttcatttttccccctagcgatgagcaacttaagtctggaacagcctccgtggtttgcctgctcaataacttctatccgcgcgaagctaaagtgcagtggaaggtcgacaatgccctgcagagcggcaactctcaggagtccgtgaccgaacaagatagcaaagactccacatactctctgagctccaccctcacgctgagcaaggctgattatgagaaacataaggtttacgcctgtgaggtgacacaccagggcctttcttcccccgtcaccaagagctttaatagaggggaatgc

SEQ ID NO: 38242 - RNA, 1341 nt, synthetic construct
  misc_feature 1..1341: note = derived and/or modified sequence opt5 from Alirocumab_HeavyChain1
  source 1..1341: mol_type = other RNA
gaggtgcagctggtcgaaagcggcgggggactcgttcaacccggcgggtccctgagactttcttgcgccgctagcggattcacctttaacaattacgccatgaactgggtgcggcaggcgcctggcaaggggctggactgggtgtccacaatctctggaagcggcggcacgaccaattatgctgattccgtcaaagggcgcttcattatctctagagacagctccaagcacacactctacctgcagatgaacagccttcgggccgaggataccgccgtgtattactgtgctaaagactctaattggggaaactttgatctgtggggccgcgggacactcgttaccgtgtccagcgcctctacaaagggaccgtccgtcttccccctggctcctagctctaaatccaccagcggcgggacggccgcgctgggatgcctcgtgaaggactattttcccgaacctgttaccgtgtcctggaactctggcgccctgacaagcggcgtccataccttccccgctgtgcttcagtccagcgggctgtactctctctccagcgtggtcacagttccttctagctccctgggaacccaaacgtatatttgtaatgtgaatcacaagccgtctaacacaaaagtggataagaaagtcgagcccaagagctgcgacaaaacccatacatgtcctccctgccctgcccccgaacttctgggcgggccgtccgtgtttctcttccctcccaagcctaaggataccctgatgatcagcagaacccccgaggttacatgtgtggtcgtggacgtttctcacgaggatcccgaagtgaaatttaattggtacgtcgacggagtggaggtccataacgctaagacgaaacctcgggaggaacagtacaattccacctatcgcgtggttagcgtgctgacagtcctccaccaggattggctgaacggcaaggagtacaaatgcaaggtgtctaataaagcccttccggcgcccattgaaaagaccatctccaaggccaaagggcagcctagagagccccaagtttatacactgcctcccagccgggacgaactcaccaagaaccaggtgtccctgacgtgtcttgtcaaaggattctacccgtctgacatcgctgtggagtgggaaagcaacggccagcctgagaataactataagacaacaccccctgtgctggattccgacggcagctttttcctctactctaaactgaccgttgataagtcccgctggcagcaagggaatgtctttagctgctctgtgatgcacgaggccctgcataaccactatacccagaagtccctcagcctgtctcccgga

SEQ ID NO: 38243 - RNA, 660 nt, synthetic construct
  misc_feature 1..660: note = derived and/or modified sequence opt5 from Alirocumab_LightChain1
  source 1..660: mol_type = other RNA
gacatcgtgatgacccagagccccgattccctggccgtctctctcggcgagagagctacaattaactgcaagagctcccaatctgttctgtaccggagcaataaccgcaatttccttgggtggtatcagcagaaacctggacagccgcccaacctgctcatctactgggcctccacgagagaatctggcgtgcctgaccggtttagcgggtccggaagcggcaccgatttcacactgaccatttcttcccttcaagcggaggacgtggctgtctattactgtcagcagtattacacaaccccctatacatttgggcagggaaccaagctggaaatcaaacgcacggtggccgcccctagcgttttcatttttcccccttctgatgagcaactcaagtccggcaccgctagcgtggtctgcctgctgaataacttctacccgagagaagccaaagtgcagtggaaggttgacaatgctctccagtctggcaactcccaggagagcgtgacagagcaagattccaaggactctacctacagcctgtccagcacacttaccctgtctaaagccgattatgaaaagcacaaagtctacgcgtgtgaggtgacgcatcaggggctctccagccccgtgacaaagtcttttaatcggggagaatgc

SEQ ID NO: 38244 - RNA, 735 nt, synthetic construct
  misc_feature 1..735: note = derived and/or modified sequence opt5 from ALX-0061_HeavyChain1
  source 1..735: mol_type = other RNA
gaggtgcagctggtcgaaagcggcgggggactcgttcaacccggcgggtccctgagactttcttgcgccgctagcggatccgtgttcaagatcaacgtgatggcctggtaccggcaggcgcctggcaaagggcgcgagctggtcgctggaattatctctggcggcagcacctcctatgccgactctgtgaaggggagatttacaattagccgggataatgccaaaaacacgctctacctgcagatgaactcccttcgcccggaagacaccgctgtttattactgtgccttcatcacaaccgagagcgattatgacctgggaagacggtactggggccaggggacactcgtgaccgtctcttccggaggcgggggaagcggcggcgggtctgaagtgcaactggttgagtccggaggcgggctggtgcagcccggaaatagcctccgcctgtcttgcgctgcctccggctttacattcagctcctttgggatgtcttgggtcagacaggcgcctggaaagggccttgagtgggtgagctccattagcggctctgggtccgataccctgtatgccgacagcgtgaaaggacggttcacgatctctcgcgataatgctaagaccacactctacctgcagatgaacagccttagacccgaagacaccgccgtctactattgtacaatcggcgggtccctgtctcggagctcccaaggaaccctcgttacggtgagctct

SEQ ID NO: 38245 - RNA, 1347 nt, synthetic construct
  misc_feature 1..1347: note = derived and/or modified sequence opt5 from Amatuximab_HeavyChain1
  source 1..1347: mol_type = other RNA
caggtgcaactgcagcagagcggccccgagctcgaaaagcctggggcctccgtcaaaatctcttgcaaggctagcggatactccttcaccggctatacaatgaactgggttaaacagtctcacggaaagagcctggagtggattgggcttatcacgccgtacaatggcgcctcctcttataaccaaaaatttagagggaaggcgaccctgacagtggacaagagctccagcaccgcttacatggatctcctgtctcttacatccgaagacagcgccgtgtatttctgtgcccggggaggctacgatggccgcgggtttgactattggggatctggcacccccgtcacagtgtccagcgcttctaccaaagggccttccgttttccccctggcccctagctccaagtctacgagcggaggcaccgctgccctcgggtgcctggtgaaagattactttcccgagcctgtcacagtgtcctggaatagcggagcgctgacctctggcgttcatacattcccggccgtgctccagtccagcggcctgtactctcttagctccgtcgtgaccgtgccctctagctccctggggacgcagacatatatttgtaacgtcaatcacaagcctagcaacaccaaagttgacaagaaggtggaacccaaatcttgcgataagacacatacctgtcctccctgcccggctcctgagctcctgggaggcccctccgtgtttcttttccctcccaaacccaaggacaccctgatgatcagcagaacacctgaggtcacgtgtgtggttgtggatgtctctcacgaagacccggaggtgaaatttaattggtacgttgatggggtggaagtccataacgccaagaccaaaccccgggaggagcagtataattccacataccgcgtggtcagcgtgctcaccgttctgcaccaagactggctgaacggaaaggaatataagtgcaaagtgtccaataaggctctccctgcccccattgagaaaacaatctctaaggcgaaaggccagcctagagaaccccaggtctacaccctgccgcctagccgggatgagcttacgaagaaccaggtgtccctgacatgtctcgttaaggggttctatccctctgacatcgccgtggaatgggagagcaatggacaacctgagaacaattacaaaaccacaccccctgtcctggactccgatggcagctttttcctttactctaagctgaccgtggacaaatcccgctggcagcagggcaacgtgtttagctgctctgttatgcacgaagctctccataaccactatacccaaaagtccctgagcctgtctcccgggaaa

SEQ ID NO: 38246 - RNA, 639 nt, synthetic construct
  misc_feature 1..639: note = derived and/or modified sequence opt5 from Amatuximab_LightChain1
  source 1..639: mol_type = other RNA
gacatcgagctgacccagagccccgccattatgtccgcttctcctggcgaaaaggtgacaatgacgtgcagcgcctcctctagcgtctcctacatgcactggtatcaacagaaatctgggaccagcccgaagagatggatctacgatacatccaaactcgcgagcggagttcccggccggttctctgggtccggaagcggcaactcttattccctgaccattagctctgtggaggctgaagacgatgccacatactattgtcagcagtggtccaagcatcctcttacctttgggagcggaacaaaagtggagatcaagcgcaccgtcgccgctccctccgtgttcatttttcctccctctgacgaacaactcaagagcggcacggcctccgttgtgtgcctgctgaataacttctaccctagagaggctaaagtccagtggaaggtggataatgcccttcagagcggcaactctcaggagtccgttaccgaacaagacagcaaagattctacatatagcctgtcctctaccctcacactgagcaaggcggactacgagaaacacaaggtgtacgcctgtgaagtcacccatcaggggctgtccagcccggtgacgaagtcttttaatcggggagagtgc

SEQ ID NO: 38247 - RNA, 1350 nt, synthetic construct
  misc_feature 1..1350: note = derived and/or modified sequence opt5 from Anetumab_ravtansine_HeavyChain1
  source 1..1350: mol_type = other RNA
caggtggagctggtccaaagcggcgccgaagttaagaaacccggggagtccctcaagatctcttgcaaaggaagcggctactccttcacctcttattggattgggtgggtgagacaggctcctggaaagggcctggaatggatggggatcattgacccgggagatagccggacacgctactccccctcttttcagggccaggtgacgatcagcgccgacaaatccattagcaccgcgtatcttcaatggtcttccctgaaggctagcgatacagccatgtactattgtgccagaggccagctctacgggggaacctatatggacggctgggggcagggaacactggtcaccgtgtcttccgctagcacaaagggcccttctgttttcccccttgccccttccagcaaatccacctctgggggaacggctgccctgggctgcctcgtgaaggattactttcccgagcctgtcaccgtgagctggaactccggcgcgctgacaagcggggttcacaccttcccggccgtgctgcagtcttccggactctacagcctgtctagcgtcgtgacagtgccctcctctagccttggcacccaaacgtatatctgtaatgtcaaccataaaccttccaatacaaaggttgacaaaaaggtggaacccaagagctgcgataaaacccacacatgtcctccctgcccggctcctgagctgctcgggggaccctctgtgtttctgttccctcccaagcccaaagacacccttatgatctcccggacccctgaggtcacatgtgtggttgtggatgtcagccatgaagacccggaggtgaagtttaactggtacgttgatggcgtggaagtccacaatgccaaaacgaagccccgcgaggagcagtataactctacctacagagtggtctccgtgctgacagttctccatcaggactggctgaatgggaaagaatataagtgcaaggtgagcaacaaagctctgcctgcccccattgagaagaccatctccaaagcgaagggacagcctcgggaaccccaagtctacacactcccgccttctcgcgatgagctgaccaaaaatcaggtgagccttacgtgtctggttaagggcttctatccctccgacattgccgtggaatgggagtctaacggccagcctgagaataactacaagacaacaccccctgtcctcgacagcgatgggtcctttttcctgtacagcaaacttaccgtggacaagtctagatggcaacagggaaatgtgttttcctgcagcgttatgcacgaagctctgcacaaccattatacccagaaatctctctccctgagccccggcaag

SEQ ID NO: 38248 - RNA, 651 nt, synthetic construct
  misc_feature 1..651: note = derived and/or modified sequence opt5 from Anetumab_ravtansine_LightChain1
  source 1..651: mol_type = other RNA
gacatcgccctgacccagcccgctagcgtgtccggctctcctgggcaaagcattacaatctcctgcacgggaacctctagcgatattggcgggtacaactccgtctcttggtatcagcagcacccgggaaaggcccccaaactcatgatctacggcgttaataacagacctagcggggtgtccaatcggttcagcggatctaagtccggcaacacagcgagcctgaccatttctggccttcaggctgaggacgaagccgattattactgttccagctatgacatcgagtctgccacacccgtgtttgggggaggcaccaaactgacagtcctcgggcaacctaaggctgccccctccgtgaccctgttccctccgagctccgaggaacttcaggctaataaagccacgctggtttgcctcatctctgatttttaccccggagcggtgaccgtcgcctggaagggcgacagctcccctgtgaaggctggggttgaaacaaccacacccagcaaacagtctaacaataagtatgccgcttccagctacctgtctctgacccctgagcagtggaaaagccatcgctcctactcttgtcaagtgacgcacgagggaagcacagtcgaaaagaccgtggcccccacagagtgctcc

SEQ ID NO: 38249 - RNA, 1341 nt, synthetic construct
  misc_feature 1..1341: note = derived and/or modified sequence opt5 from Anifrolumab_HeavyChain1
  source 1..1341: mol_type = other RNA
gaggtgcagctggtccaaagcggcgccgaagttaagaaacccggggagtccctcaagatctcttgcaaaggaagcggctacattttcaccaactattggatcgcttgggtgagacagatgcctgggaagggactggaatccatgggcattatctacccgggggactctgatattcggtatagcccctcctttcagggacaggtgacaatctctgccgacaaaagcatcacgaccgcgtaccttcaatggtccagcctgaaggcttctgatacagccatgtattactgtgcccgccacgacattgagggcttcgattattggggcagagggaccctcgtcacagtgtccagcgcttctaccaagggaccttccgtttttcccctggcccctagctctaaatccacaagcggcgggaccgctgcccttggatgcctggtgaaggactacttccccgaacctgtcacggtgtcctggaactctggcgcgctcaccagcggggttcatacatttccggccgtgctgcagtccagcggactgtactctctctccagcgtcgtgaccgtgccctctagctccctgggcacacagacctatatctgtaatgtcaatcacaaaccttctaacacgaaggttgataaacgggtggagcccaagagctgcgacaagacacatacctgtcctccctgcccggctcctgagttcgaaggcgggccctccgtgtttcttttccctcccaaacccaaggatacactgatgattagccgcacccctgaggtcacctgtgtggttgtggacgtctctcacgaagatccggaggtgaaatttaattggtacgttgacggagtggaggtccataacgccaagacaaaacccagagaggaacagtataattccacgtaccgggtggtcagcgtgctcaccgttctgcaccaagattggcttaacggcaaggaatataaatgcaaggtgtctaataaggctctgcctgcctccatcgagaaaacaattagcaaggcgaaagggcagccccgcgaacctcaggtctacacccttcccccgtccagagaggagatgacaaagaaccaggtgtctctgacctgtctggttaaaggattctatcctagcgacatcgccgtggaatgggagtccaatggccaacccgaaaacaattacaagacgacacctcccgtcctcgactctgatgggagctttttcctgtactccaagctcaccgtggacaaaagccggtggcagcagggaaacgtgttttcttgctccgttatgcacgaggctctgcataatcactatacccaaaagagcctctctctgtcccctggcaaa

SEQ ID NO: 38250 - RNA, 645 nt, synthetic construct
  misc_feature 1..645: note = derived and/or modified sequence opt5 from Anifrolumab_LightChain1
  source 1..645: mol_type = other RNA
gagatcgtgctgacccagagccccggcacactctccctgtctcctggggaaagagccacgcttagctgccgggcttcccaatctgtcagctcctctttctttgcctggtaccagcagaagccgggacaggcgccccgcctgctcatttatggcgctagctccagagccaccgggatccctgaccggctgagcggatctggctccgggacagatttcacccttacaattacccgcctggagcccgaagactttgccgtttactattgtcaacagtacgatagctctgctatcacattcggacagggcaccagactcgagattaaacggacggtggccgctccttccgtgtttatctttccccctagcgacgaacagctgaagtctggcaccgcctccgtcgtgtgcctgctcaacaatttctatccgcgcgaggcgaaagttcaatggaaggtggataacgccctgcagagcggaaattcccaggagtctgtcacagaacaggacagcaaagattccacctacagcctttcttccacactgaccctcagcaaggctgactatgagaagcacaaagtgtacgcctgtgaagttacgcatcaagggctgtctagccccgtgacaaagtccttcaacagaggcgagtgc

SEQ ID NO: 38251 - RNA, 1344 nt, synthetic construct
  misc_feature 1..1344: note = derived and/or modified sequence opt5 from Anrukinzumab_HeavyChain1
  source 1..1344: mol_type = other RNA
gaggtgcagctggtcgaaagcggcgggggactcgttcaacccggcgggtccctgagactttcttgcgccgctagcggattcacctttatctcctacgccatgtcttgggtgcggcaggcgcctggcaaggggctggagtgggtggctagcatttcctctggaggcaacacatattacccggacagcgtcaaaggccgcttcacgatctccagagataatgccaagaacagcctctatctgcagatgaactctcttcgggccgaagacaccgctgtgtactattgtgcccgcctggatgggtactattttggattcgcttactggggccaggggacactcgttaccgtgtccagcgcctctacaaaaggaccctccgtctttcctctggcgcccagctctaagtccaccagcggcgggacagccgctctgggatgcctcgtgaaagactacttccctgagcccgttaccgtgtcctggaactctggcgccctgacgagcggcgtccacacctttcctgctgtgcttcaatccagcgggctgtattctctctccagcgtggtcacagttccgtctagctccctgggaacccagacatacatttgtaatgtgaatcataagccctctaataccaaggtggataaaaaggtcgaacctaaaagctgcgacaagacgcacacatgtcccccttgccccgccccggaggcgcttggcgccccttccgtgttcctgtttccccctaaacccaaggataccctcatgatcagcagaacacccgaggttacctgtgtggtcgtggacgtttctcatgaagatcctgaggtgaagttcaactggtatgtcgacggggtggaagtccacaatgctaaaaccaagccgcgggaggagcagtacaactccacatatcgcgtggttagcgtgctgacggtcctgcatcaggattggctcaatggaaaagaatacaagtgcaaagtgtctaacaaggccctgcccgctcctattgagaaaaccatctccaaggccaagggccaacccagagaacctcaggtttatacacttcccccgagccgggaggaaatgaccaaaaatcaggtgtccctgacatgtctcgtcaaggggttttacccttctgacatcgccgtggagtgggagagcaacggacagcccgaaaataactacaaaaccacgcctcccgtgctggattccgacggctctttctttctttatagcaagctgacagttgacaaatcccgctggcaacagggcaacgtcttcagctgctctgtgatgcacgaggctctccacaatcattacacccagaagtccctgagcctgtctcctgggaag

SEQ ID NO: 38252 - RNA, 654 nt, synthetic construct
  misc_feature 1..654: note = derived and/or modified sequence opt5 from Anrukinzumab_LightChain1
  source 1..654: mol_type = other RNA
gacatccagatgacccaaagcccctcctctctgagcgcctccgtgggcgatagagtcacaattacgtgcaaggcttctgagagcgttgacaactacgggaaatccctcatgcactggtatcagcagaagcctggaaaagccccgaagctgcttatctaccgggcgtctaatctggaaagcggcgtgccctcccgcttcagcgggtctggatccggcaccgattttacactcaccattagctctctgcagcctgaggacttcgctacatattactgtcaacagtccaacgaagatccctggacctttgggggaggcacaaaagtggagatcaagagaaccgtcgccgcccctagcgtgttcatttttcccccttctgacgaacagcttaagtccggcacggctagcgttgtgtgcctgctcaataacttctatccgcgggaggccaaagtccagtggaaggtggataatgctctgcaatccgggaactctcaggagagcgttaccgaacaggactccaaagatagcacatactctctgtccagcaccctcacactgtctaaggccgactatgagaaacataaggtgtacgcgtgtgaagtcacccaccagggacttagctcccccgtgacgaagtcttttaatcgcggcgagtgc

SEQ ID NO: 38253 - RNA, 1338 nt, synthetic construct
  misc_feature 1..1338: note = derived and/or modified sequence opt5 from Apolizumab_HeavyChain1
  source 1..1338: mol_type = other RNA
caggtgcaactgcaggagagcggccccgggctcgtcaagccttccgaaaccctgtctcttacatgcacggttagcggattctccctgaccaactacggcgtgcactgggtgagacagtctccggggaaaggactcgagtggatcggcgtcaagtggagcgggggatccacagaatataatgccgcttttatttctcggctgaccatcagcaaagacacatccaagaaccaggtgagccttaaactcaattctctcaccgccgcggatacagctgtttactattgtgcccgcaacgacagatacgccatggattattggggccaaggcaccctggtgacggtctccagcgcttctaccaaggggccctccgtgttccctctggcccccagctctaagtccacaagcggaggcaccgctgccctcgggtgcctggttaaagactactttcctgagcccgtgacagtctcctggaactctggagcgcttaccagcggcgtgcatacgttccctgccgtgctgcagtccagcgggctctattctctgtccagcgtcgttacagtgccgtctagctcccttggaacccagacatacatttgtaatgtgaatcacaagccctctaacaccaaagtcgataagaaagtggaacctaagagctgcgacaagacccatacatgtcccccttgccccgctccggagctgctcggcggcccttccgtttttctgtttccccctaaacccaaggatacgctgatgatcagccggacccccgaggtgacatgtgtcgtggttgacgtgtctcacgaagatcctgaggtcaaatttaattggtacgtggacggggtcgaagtgcataacgccaagaccaaaccgcgcgaggagcagtataattccacatacagagttgtgagcgtcctcaccgtgctgcaccaagattggcttaacggaaaggaatataaatgcaaggtttctaataaggctctgcccgcccctattgagaaaacgatctccaaggcgaaaggccagccccgggaacctcaggtgtacacactgcccccgagccgcgacgagctgaccaagaaccaggtctcccttacctgtctggtgaaagggttctatccttctgatatcgccgtggaatgggagagcaatggacaacccgagaacaactacaagacaacccctcccgttctcgactccgacggctctttcttcctgtatagcaagctgacagtcgataaatccagatggcagcaggggaatgtgtttagctgctctgtgatgcacgaagctctccataaccactacacgcaaaagtccctgagcctttctcctggaaaa

SEQ ID NO: 38254 - RNA, 642 nt, synthetic construct
  misc_feature 1..642: note = derived and/or modified sequence opt5 from Apolizumab_LightChain1
  source 1..642: mol_type = other RNA
gacatccagatgacccaaagcccctcctctctgagcgcctccgtgggcgatagagtcacaattacgtgccgggcttctgagaacatctacagctatctcgcctggtaccagcagaagcctgggaaagcgccgaagctgcttgtttccaatgctaaaaccctggccgaaggagtgccctctcgcttcagcggctccgggagcggaaagcagtttacactcaccatttcttccctgcaacctgaggacttcgccacatattactgtcagcaccattatggcaacagctacccctttgggcagggaaccaaacttgaaatcaagagaacagtggctgccccttctgtcttcatttttcccccttccgatgagcagctcaagagcggcaccgcttctgtggtttgcctgctgaataacttctatccgcgggaagccaaagtgcaatggaaggtcgacaatgcgctgcagtccggcaacagccaggagtccgtgacggagcaggattctaaagacagcacctactccctcagctctacactgaccctttccaaggccgattacgaaaaacacaaggtttatgcttgtgaggtgacacatcaagggctgagctctcccgtcaccaagagctttaatcgcggagaatgc

SEQ ID NO: 38255 - RNA, 378 nt, synthetic construct
  misc_feature 1..378: note = derived and/or modified sequence opt5 from Apomab_HeavyChain
  source 1..378: mol_type = other RNA
gaggtgcagctggtccaaagcggcgggggagttgaaagacccggcgggtccctccggctgtcttgcgccgctagcggattcacctttgacgattacgccatgtgggtgcgccaggcgcctggcaaggggcttgagtgggtgtccggaatcaactggcagggcggctctacagggtatgctgacagcgtcaaaggaagagtgacgatttcccgggataatgccaagaactctctgtacctccagatgaatagcctgcgcgccgaagacaccgctgtttattactgtgccaaaatccttggcgctgggagaggatggtatttcgattactggggcaaggggacaaccgtgacagtctccagcgcctctaccaaaggaccg

SEQ ID NO: 38256 - RNA, 324 nt, synthetic construct
  misc_feature 1..324: note = derived and/or modified sequence opt5 from Apomab_LightChain
  source 1..324: mol_type = other RNA
agcgagctgacccaggaccccgccgtgtccgtcgctctcggccaaacagttagaatcacgtgctctggggatagcctgcggtcctactatgcctcttggtaccagcagaagcctggacaggcgccggtgcttgtgatttatggcgctaacaatcgccccagcgggatccctgacagattctccggatctagctccggcaacaccgccagcctgacaattaccggggcccaagctgaagatgaggccgactactattgtaattctgctgattccagcggaaaccacgtcgtgtttggcggcgggacaaaactcaccgttctggga

SEQ ID NO: 38257 - RNA, 645 nt, synthetic construct
  misc_feature 1..645: note = derived and/or modified sequence opt5 from Aquaporumab_LightChain
  source 1..645: mol_type = other RNA
gagatcgtgctgacccagagccccggcacactctccctgtctcctggggaaagagccacgcttagctgccgggcttcccaaaccgtccgcacaaactacctggcctggttccagcagaaaccgggacaggcgcccagactcctgatttttggcgcttctagccgggccaccgggatccctgaccgcttctccggatctggcagcgggacagattttacccttacaatttccagactggagcccgaagacttcgccgtttattactgtcaacagtatggaagctctccttggacctttggccagggcacgaaagtggagatcaagcggaccgtggctgccccctccgtcttcatttttcctccgagcgatgaacagctcaaatctgggacagcttccgtggtttgcctgctgaataacttctacccccgcgaggccaaggtgcaatggaaagtcgacaatgcgctccagagcggaaactctcaggagtccgtgaccgaacaggatagcaaggactccacatattctctgagctccacccttacgctgagcaaggccgattacgagaaacacaaggtttatgcttgtgaagtgacacatcaaggcctctcttcccctgtcaccaagagctttaatagaggggagtgc

SEQ ID NO: 38258 - RNA, 1326 nt, synthetic construct
  misc_feature 1..1326: note = derived and/or modified sequence opt5 from Arcitumomab_99tc_HeavyChain
  source 1..1326: mol_type = other RNA
gaggtgaagctggtcgaaagcggcgggggactcgttcagcccggcgggtccctgagactttcttgcgccaccagcggattcacatttacggactactatatgaactgggtgcggcaacctccgggcaaagctctggagtggctcgggttcatcggaaataaggccaacggctacaccacagaatattccgcgtctgtgaaaggccgctttaccattagcagagataagtcccagtctatcctgtaccttcagatgaatacactgcgggctgaggacagcgccacctattactgtacacgcgatagagggctccggttctattttgactactggggacagggcaccacgctgaccgtctccagcgccaaaacaacacccccttctgtgtaccccctggctcctgggtccgccgctcaaacaaacagcatggttaccctcggatgcctggtgaagggctatttccccgaacctgtcacggtgacatggaactctgggtcccttagctctggagttcacacctttccggccgtgctgcagtccgatctctacacactgagctcctctgtcaccgtgcccagctcccctcgccccagcgagaccgtgacatgtaatgtcgcgcatcctgcctcttccacgaaggttgacaaaaagattgtgcccagagattgcccgccttgtaaatgccccgctcctaatcttctgggcggccccagcgtgttcatctttccccctaagattaaagacgtcctcatgatctctctgagcccgatcgtgacctgtgttgtggtcgatgtgtccgaggacgatcccgacgttcagatttcttggttcgtgaacaatgtcgaagtgcacacagcccagacccaaacacatcgggaggattataacagcaccctgcgcgtcgtgtccgctctccctatccagcaccaggactggatgagcgggaaggaatttaagtgcaaagttaataacaaggacctgcccgcccctattgagagaacgatctctaaacccaagggatccgtgcgggcgccgcaggtctacgtgcttcctccccctgaggaagagatgaccaaaaagcaagttaccctgacctgtatggtgacagatttcatgcccgaagacatttatgtcgagtggaccaataacggcaaaacagaactcaattacaagaacacggagcctgtgctggatagcgacgggtcttattttatgtactccaaacttcgcgtggagaaaaagaactgggttgaaagaaatagctactcctgctctgtcgtgcatgagggactgcacaaccaccataccacaaagagcttctcccgg

SEQ ID NO: 38259 - RNA, 639 nt, synthetic construct
  misc_feature 1..639: note = derived and/or modified sequence opt5 from Arcitumomab_99tc_LightChain
  source 1..639: mol_type = other RNA
cagaccgtgctgagccaaagccccgccatcctctctgctagccctggcgagaaggtcacaatgacgtgcagagcctcctctagcgttacctacattcactggtatcagcagaaaccggggtcctctcccaagagctggatctacgcgacatccaacctggctagcggagtgcctgcccggttctctggctccgggagcggaacctcttattcccttacaattagccgcgtggaagccgaggacgctgccacctactattgtcagcattggtcttccaaaccccctacatttggcgggggaaccaagctggaaatcaaaagagctgatgccgcgcccacggtcagcattttccctccgtcctctgagcaactcaccagcggcggcgcctccgtggtttgctttctgaataacttctaccccaaggacatcaatgtgaagtggaaaatcgatgggagcgaacggcagaacggagtccttaattcttggacagaccaggattccaaggacagcacctattctatgagctccacactgaccctcacgaaagatgagtacgagcgccacaactcttacacatgtgaagctacccataagacaagcacctcccctattgtgaaatcctttaatagaaacgagtgc

SEQ ID NO: 38260 - RNA, 1329 nt, synthetic construct
  misc_feature 1..1329: note = derived and/or modified sequence opt5 from Ascrinvacumab_HeavyChain1
  source 1..1329: mol_type = other RNA
caggtgcaactgcaggagagcggccccgggctcgtcaagccttcccagaccctgtctcttacatgcacggttagcggaggctccatctctagcggggaatactattggaactggattagacagcacccgggaaaaggcctggagtggatcgggtacatttattactccggatctacctattacaatcccagcctcaagtcccgggtgacaatcagcgtggacacctctaaaaaccaattctccctgaaacttagctctgtcacagccgctgataccgccgtgtattactgtgcgcgcgaatccgttgctggctttgactactggggccaggggacactggtgaccgtcagctctgcctccacgaaaggacctagcgtgttccccctcgccccttgctccagatctaccagcgagtccacagctgccctgggctgtctggttaaggattattttcccgaacctgtgaccgtcagctggaactctggggctctcacatccggagtgcataccttcccggccgtgctgcagagctctggcctttacagcctgtcctctgtcgttacggtgcccagctccaattttgggacacagacctatacatgcaatgtggaccacaagcctagcaacaccaaagtcgataagaccgtggagcggaaatgttgcgttgagtgtcccccttgccccgcgccgcctgtggccggaccctctgtcttcctctttcctcccaagcccaaagacacactgatgatttcccgcacgcctgaagtgacctgtgttgtggtcgatgtgagccatgaggacccggaagtccaattcaattggtacgtggatggcgttgaggtgcacaacgctaagacaaagcccagagaggaacagtttaattctaccttccgggtcgtgtccgttcttacagtggtccatcaggactggctgaacggcaaagagtataagtgcaaagtgagcaataaggggctccctgcccccatcgaaaagaccatctccaagacgaaaggacagcctcgcgagccccaagtgtacacactgccgccttctagagaagagatgaccaagaaccaggttagcctgacctgtctcgtcaagggcttttatccctccgatattgctgtggagtgggaatctaatgggcagcctgagaacaattacaaaacaacaccccctatgctggacagcgatggatccttctttctttacagcaagctgaccgtggacaaatctcggtggcaacagggcaacgtcttctcctgcagcgtgatgcacgaagccctccacaaccattatacgcagaagtctctgtcccttagccccggg

SEQ ID NO: 38261 - RNA, 645 nt, synthetic construct
  misc_feature 1..645: note = derived and/or modified sequence opt5 from Ascrinvacumab_LightChain1
  source 1..645: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcaccagctccagagctacagggatccctgaccggttcagcggatctggctccgggaccgattttacacttaccattagccgcctggagcccgaagacttcgccgtttattactgtcaacagtatggatcttcccctatcacatttggccagggcaccagactcgagattaaacggacggtggccgctcccagcgtgttcatctttcctccgtctgatgaacagctgaagtccgggaccgccagcgtcgtgtgcctgctcaacaatttctacccccgcgaggctaaagttcaatggaaggtggacaacgccctgcagtccggaaattctcaggagagcgtcacagaacaggattccaaagacagcacctattctctttccagcacactgaccctctctaaggcggattacgagaagcacaaagtgtacgcctgtgaagttacgcatcaaggcctgagctcccctgtgacaaagtcttttaacagaggggagtgc

SEQ ID NO: 38262 - RNA, 1314 nt, synthetic construct
  misc_feature 1..1314: note = derived and/or modified sequence opt5 from Aselizuab_HeavyChain1
  source 1..1314: mol_type = other RNA
gaggtgcagctggtcgaaagcggcgggggactcgttcaacccggcgggtccctgagactttcttgcgccgctagcggattcaccttttccacatacgcctcttgggtgcggcaggcgcctggcaaggggctggagtgggtggctagcatctccacgggaggctctacctattacccggacagcgtcaaaggccgcttcacaatttccagagataacgccaagaataccctctatctgcagaacagccttcgggccgaagacacagctgtgtactattgtgcccgcgattacgacgggtattttgattactggggacagggcaccctggttacagtgtcttccgctagcaccaaagggccctctgtcttccctctcgccccctgctccagaagcacgtctgagtccaccgcggccctgggatgtctggtgaaggactactttcctgaacccgttacagtgagctggaactccggcgctctcacctctggggtccacacattccctgccgtgctgcaaagctccggactttatagcctgtcttccgtggtcaccgttccgagctctagcctcggcacgaaaacatatacctgcaatgtggatcataagccctccaatacaaaggtggacaaacgggtcgagtctaagtacggccctccctgtcctagctgccccgctccggagtttcttgggggaccttccgtgttcctgtttccccctaaacccaaggataccctgatcagccgcacccccgaagttacatgtgtggtcgtggacgtttctcaggaggatcctgaagtgcagttcaactggtacgtcgacggcgtggaggtccacaatgccaaaacgaagccgagagaggaacagtttaactccacctatcgggtggttagcgtgctcacagtcctgcatcaagattggctgaatgggaaggagtacaaatgcaaggtgtctaacaaaggactcccctccagcattgaaaagaccatctccaaagcgaagggccagcctcgcgagccccaggtttatacactgcctccctctcaggaagagaccaaaaatcaagtgagccttacgtgtctggtcaaggggttctacccgtccgacattgccgtggagtgggaatctaacggacagcctgagaataactacaagacaacaccccctgtgctcgacagcgatggctcctttttcctgtatagcagacttaccgttgacaaatctcggtggcaggaaggcaatgtcttctcctgcagcgtgcacgaggctctgcataaccactacacccaaaagtctctctccctgagcctggggaaa

SEQ ID NO: 38263 - RNA, 1311 nt, synthetic construct
  misc_feature 1..1311: note = derived and/or modified sequence opt5 from Aselizuab_HeavyChain2
  source 1..1311: mol_type = other RNA
gaggtgcagctggtcgaaagcggcgggggactcgttcaacccggcgggtccctgagactttcttgcgccgctagcggattcaccttttccacatacgcctcttgggtgcggcaggcgcctggcaaggggctggagtgggtggctagcatctccacgggaggctctacctattacccggacagcgtcaaaggccgcttcacaatttccagagataacgccaagaataccctctatctgcagaacagccttcgggccgaagacacagctgtgtactattgtgcccgcgattacgacgggtattttgattactggggacagggcaccctggttacagtgtcttccgctagcaccaaagggccctctgtcttccctctcgccccctgctccagaagcacgtctgagtccaccgcggccctgggatgtctggtgaaggactactttcctgaacccgttacagtgagctggaactccggcgctctcacctctggggtccacacattccctgccgtgctgcaaagctccggactttatagcctgtcttccgtggtcaccgttccgagctctagcctcggcacgaaaacatatacctgcaatgtggatcataagccctccaatacaaaggtggacaaacgggtcgagtctaagtacggccctccctgtcctagctgccccgctccggagtttcttgggggaccttccgtgttcctttttccccctaaacccaaggataccatcagccgcacccccgaagttacatgtgtggtcgtggacgtttctcaggaggatcctgaagtgcagttcaactggtacgtcgacggcgtggaggtccacaatgccaaaacgaagccgagagaggaacagtttaactccacctatcgggtggttagcgtgctgacagtcctccatcaagattggctgaatgggaaggagtacaaatgcaaggtgtctaacaaaggactgccctccagcattgaaaagaccatctccaaagcgaagggccagcctcgcgagccccaggtttatacactccctccctctcaggaagagaccaaaaatcaagtgagcctgacgtgtcttgtcaaggggttctacccgtccgacattgccgtggagtgggaatctaacggacagcctgagaataactacaagacaacaccccctgtgctggacagcgatggctcctttttcctctatagcagactgaccgttgacaaatctcggtggcaggaaggcaatgtcttctcctgcagcgtgcacgaggctctgcataaccactacacccaaaagtctctgtccctcagcctggggaaa

SEQ ID NO: 38264 - RNA, 648 nt, synthetic construct
  misc_feature 1..648: note = derived and/or modified sequence opt5 from Aselizuab_LightChain1
  source 1..648: mol_type = other RNA
gacatccagacccaaagcccctcctctctgagcgcctccgtgggcgatagagtcacaattacgtgcaaggcttctcagagcgttgactacgatggggactcctataactggtaccagcagaaacctggaaaggccccgaaactcctgatctatgcggcttctaatcttgagagcggcattccctcccggttcagcgggtctggatccggcaccgattttacactgaccatcagctctctccaacctgaagacttcgccacatactattgtcagcagtccaacgaggatccctggacctttgggcagggaacaaaggtggaaattaaacgcaccgtggccgctcctagcgtcttcatctttcccccttctgacgagcaactgaagtccggcacggccagcgtggtttgccttctgaataacttctacccgagagaagctaaggtgcagtggaaagtcgataatgccctccagtccggcaactctcaggagagcgtgaccgagcaagactccaaggatagcacatattctctgtccagcaccctgacactctctaaagcggactacgaaaagcacaaagtttacgcctgtgaggtgacccatcaggggctgagctcccccgtcacgaagtcttttaatcggggagaatgc

SEQ ID NO: 38265 - RNA, 1344 nt, synthetic construct
  misc_feature 1..1344: note = derived and/or modified sequence opt5 from Atezolizumab_HeavyChain1
  source 1..1344: mol_type = other RNA
gaggtgcagctggtcgaaagcggcgggggactcgttcaacccggcgggtccctgagactttcttgcgccgctagcggattcaccttttccgactcttggatccactgggtgcggcaggcccctggcaaggggctggagtgggtggcgtggattagcccgtacggaggctccacatattacgctgattctgtcaaaggccgcttcacgatcagcgccgacacctccaagaacacagcctatctccagatgaatagcctgagagctgaagataccgccgtgtactattgtgctcggcgccattggcccgggggatttgactactggggccaggggacacttgttaccgtgtcttccgccagcacaaaaggaccttctgtcttccccctggcgccttccagcaagtctacctccggcgggacggccgctctcggatgcctggtgaaagattattttcccgagcctgttaccgtgagctggaactccggcgccctgacatctggcgtccacaccttcccggctgtgctccaaagctccgggctgtacagcctttcttccgtggtcacagttcccagctctagcctgggaacccagacgtacatttgtaatgtgaaccataagccttccaatacaaaggtggacaaaaaggtcgaacccaaatcttgcgataagacccacacatgtcctccctgcccggcccctgagctcctgggcgggcccagcgtgtttcttttccctcccaaacccaaggacaccctgatgatctccagaacccctgaggttacatgtgtggtcgtggatgttagccatgaagacccggaggtgaagtttaactggtatgtcgatggagtggaagtccacaatgcgaaaacgaagccccgggaggagcagtacgcctctacctatcgcgtggtttccgtgctcacagtcctgcaccaggactggctgaacggcaaagaatacaagtgcaaagtgagcaataaggctctccctgcccccattgagaaaaccatctctaaggctaaggggcaacctagagaaccccaggtttatacactgccgccttcccgggaggaaatgaccaaaaaccaggtgagccttacgtgtctggtcaagggattctacccctccgatatcgccgtggagtgggagtctaatggccagcctgaaaacaattataaaacaacaccccctgtgctcgacagcgacggctcctttttcctgtactctaaacttaccgttgataagagccgctggcaacaggggaacgtcttttcctgcagcgtgatgcatgaggccctgcacaatcattacacccagaagtctctctccctgagccccggaaag

SEQ ID NO: 38266 - RNA, 642 nt, synthetic construct
  misc_feature 1..642: note = derived and/or modified sequence opt5 from Atezolizumab_LightChain1
  source 1..642: mol_type = other RNA
gacatccagatgacccaaagcccctcctctctgagcgcctccgtgggcgatagagtcacaattacgtgccgggcttctcaggacgttagcaccgccgtggcgtggtaccagcagaagcctgggaaagctccgaagctcctgatctattccgcctctttcctttacagcggagtgccctcccgctttagcggctctgggtccggaacagatttcaccctgacaattagctctctccaacctgaggactttgccacctattactgtcagcagtatctgtaccaccccgctacattcggccaggggaccaaagtcgaaatcaagagaacggtggccgctccttccgtttttatttttccccctagcgatgagcaacttaaatctggaaccgcctccgtggtctgcctgctcaacaatttctatccgcgggaagcgaaggtgcagtggaaggttgacaacgccctgcagagcggcaattcccaggagtctgtgacagaacaagatagcaaagactccacctacagcctgtcttccacactcaccctgagcaaggctgattacgagaaacataaggtctatgcctgtgaggtgacgcaccagggcctttctagccccgtgacaaaatccttcaaccgcggggaatgc

SEQ ID NO: 38267 - RNA, 1323 nt, synthetic construct
  misc_feature 1..1323: note = derived and/or modified sequence opt5 from Atinumab_HeavyChain1
  source 1..1323: mol_type = other RNA
gaggtgcagctggtcgaaagcggcgggggactcgttcaacccggcgggtccctgagactttcttgcgccgctagcggattcaccttttccaactactggatgtcttgggtgcggcaggcccctggcaaggggctggagtgggtggcgacaatcaaacaggacggaagccagaagaattatgtcgattccgtgaaaggccgcttcacgatttctagagacaacgctaagaatagcctctacctgcggcttaactccctgcgcgccgaagataccgccgtttattactgtgctacagagctctttgacctgtggggcagagggagcctggtgaccgtctcttccgccagcacaaaaggaccgtctgtgttccccctcgctccttgctcccggagcacctctgaatccacagccgcgctgggctgtcttgttaaggattattttcccgagcctgtgaccgtcagctggaactccggggccctgacgtctggagtgcacaccttccccgctgtgctccaaagctccggcctgtacagcctttcttccgtcgttacagtgcctagctctagcctggggaccaagacatatacctgcaatgtggaccataaaccgtccaatacgaaggtcgataaacgcgtggagtctaagtacggacccccttgtcccagctgccctgcccccgaatttctcggcggcccgtccgttttcctgtttcctcccaaacctaaggacacactgatgatcagcagaacccccgaggtgacatgtgtcgtggttgatgtgtctcaggaagaccccgaggtccagttcaactggtacgtggatggggtcgaggtgcacaatgctaagaccaaacctcgggaggaacagtttaactccacctatcgcgttgtgagcgtcctcacagtgctgcatcaagactggcttaatggaaaggaatacaaatgcaaggtttctaacaaaggcctgccgtccagcattgagaagacgatctccaaagccaaggggcagcccagagaacctcaggtgtataccctgcccccttctcaggaggagatgacaaagaatcaagtcagcctcacctgtcttgtgaaaggattctacccctccgatattgcggtggaatgggagtctaacggccagccggaaaataactataagacaacccctcccgttctggacagcgacgggtcctttttcctctacagccggctgacggtcgataaatctcgctggcaggagggaaacgtgttctcctgcagcgtgatgcacgaagccctgcataatcactatacacaaaagtctctctccctgagccttggcaaa

SEQ ID NO: 38268 - RNA, 642 nt, synthetic construct
  misc_feature 1..642: note = derived and/or modified sequence opt5 from Atinumab_LightChain1
  source 1..642: mol_type = other RNA
gagatcgtgctgacccagagccccgccacactcagcctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctatcacctttggccaggggacaaaactcgagattaagagaaccgtggctgccccctctgtgttcatctttcctccgtccgatgaacagctgaaaagcggaacggcgtctgtcgtgtgcctgctcaacaatttctatccccgggaggccaaggttcaatggaaagtggacaacgctctgcagtccggcaatagccaggagtccgtcaccgaacaggattctaaggacagcacatactcccttagctctaccctgacactctccaaggccgattatgagaaacacaaggtgtacgcttgtgaagttacccatcaaggcctgagctctcctgtgacgaaatcctttaaccgcggggagtgc

SEQ ID NO: 38269 - RNA, 1329 nt, synthetic construct
  misc_feature 1..1329: note = derived and/or modified sequence opt5 from Atlizuab_HeavyChain1
  source 1..1329: mol_type = other RNA
gtgcaactgcaagagagcggccccgggctcgtcagaccttcccagaccctgtctcttacatgcacggttagcggatactccatcacctctgaccacgcctggagctgggtgcggcagccgcccggccgcgggctggaatggattggatatatctcctactctggcattacaacctataaccctagcctcaagtccagagtgacactgcgggataccagcaaaaatcagttctctcttcgcctgtccagcgtcacagctgccgacaccgcggtgtactattgtgctagatctctcgcccggacgaccgccgattactgggggcaaggatccctggttacagtgagctctgcttccaccaagggccccagcgtctttcctctggccccctcctctaaaagcacatccggcgggaccgctgccctcggatgcctggtgaaggactatttccctgagccggttacggtgagctggaactctggcgcgcttacatccggggtccatacctttcccgccgtgctgcagagctctggactctacagcctgtcctctgtggtcacagttcctagctccagccttggcacccagacctacatctgtaatgtgaaccacaaaccctctaatacaaaggtggataagaaagtcgaacctaagtcctgcgacaaaacgcatacctgtcccccgtgccctgctcccgagctgctcgggggacctagcgtgttcctgtttcctcccaagcccaaagatacactgatttctcgcaccccggaagttacatgtgtggtcgtggacgtttcccacgaggatcccgaggtgaagttcaactggtatgtcgacggcgtggaagtccataatgccaagaccaaacctagagaggaacagtacaacagcacgtatcgggtggtttccgtgctcacagtcctgcaccaagattggcttaatggcaaggagtacaaatgcaaggtgtctaacaaagctctgcccgcccctatcgagaagaccatcagcaaagcgaaggggcagccccgcgaaccgcaggtttataccctccctccctccagagacgagctgacaaagaatcaggtgtctcttacctgtctggtcaaaggattttaccctagcgatattgccgtggaatgggagtccaacggccaacccgaaaataactataagacaacgcctcccgtgctcgacagcgacgggtctttctttctgtactccaaactgaccgttgataagagccggtggcagcagggaaatgtcttctcttgctccgtgcacgaggctctccataaccactacacacagaaaagcctgtctcttagcccgggc

SEQ ID NO: 38270 - RNA, 639 nt, synthetic construct
  misc_feature 1..639: note = derived and/or modified sequence opt5 from Atlizuab_LightChain1
  source 1..639: mol_type = other RNA
gacatccagacccaaagcccctcctctctgagcgcctccgtgggcgatagagtcacaattacgtgccgggcttctcaggacatcagctcctacctcaactggtatcagcagaagcctgggaaagccccgaagctgcttatttactatacctctcgcctgcacagcggagttccctccagattcagcggctctgggtccggaacagattttaccttcacaatcagctctctccaacctgaggacattgcgacctactattgtcagcagggcaatacactgccctacacctttgggcagggaacgaaagtggaaatcaagcggaccgtggctgccccttccgtcttcatctttccccctagcgatgagcaacttaaatctggcacagcctccgtggtttgcctgctcaacaatttctatccgcgcgaagctaaggtgcagtggaaggtcgacaacgccctgcagagcggcaattcccaggagtctgtgaccgaacaagatagcaaagactccacatacagcctgtcttccaccctcacgctgagcaaggctgattacgagaaacataaggtttatgcctgtgaggtgacacaccaggggctttctagccccgtcaccaaatcctttaacagaggagaatgc

SEQ ID NO: 38271 - RNA, 792 nt, synthetic construct
  misc_feature 1..792: note = derived and/or modified sequence opt5 from Aurograb_SingleChain
  source 1..792: mol_type = other RNA
atggccaaggtgcagctgctccaaagcgctaccgaggtcaaaaagcccggcgcctccgttaaagtgtcttgcaaggcgtacgggtatacattcacggactacggaatcacctgggtgagacaggctcctggccaggggctggaatggatgggatggattagcgcctataacggctacacaaattatgcccagaaatttcaagatcggatcaccatgacaaccgacgcttccacatctaccgcctacatggagcttcgcagcctgagaccggatgacacggctgtcctctattgtgcccgggatcgcgaagacgcgtccctgcttagagatgggcactggggacagggcaccctggtgacagtttctagcggcgggggaggctccgggggaggcgggagcggaggcggcgggtctggaggcgggggatccgagaccacactcacccagagccccggcacgctgtctctgtcccctggggaacgggccacactcagctgccgcgcttctcagattgtgtccagctcctacctggcctggtaccaacagaagcccggacaggctcctagacttctgatctatggcgcctctagccgggcgaccggcattcccgaccgcttctccgggagcggatctggcacagattttaccctcaccatctccaagctggagcctgaggacttcgccgtctactattgtcagcattacgggagctctagcccgtggacatccagaccccgggatcaatctgacatcaaacgcgctgccgctcttgaacaccatcaccatcaccac

SEQ ID NO: 38272 - RNA, 1350 nt, synthetic construct
  misc_feature 1..1350: note = derived and/or modified sequence opt5 from Avelumab_HeavyChain1
  source 1..1350: mol_type = other RNA
gaggtgcagctgctcgaaagcggcgggggactggtccaacccggcgggtcccttagactgtcttgcgccgctagcggattcaccttttcctcttacatcatgatgtgggttcggcaggcccctggcaaggggctcgagtgggtgagctccatttatccgtctggaggcatcacattctacgcggacacggtgaaaggccgctttaccattagcagagataactccaagaatacactgtatcttcagatgaacagcctgcgggctgaagacaccgccgtctactattgtgcccgcatcaaactcgggacagtgaccacagttgattactggggacagggcaccctggtgacggtctcttccgctagcaccaaggggccctctgtgttccctctggccccctccagcaaatctacatccggaggcaccgctgccctcgggtgcctggttaaggactattttcctgagcccgtgacagtcagctggaactccggagcgcttacctctggcgtgcacacgttccctgccgtgctgcaaagctccggcctctacagcctgtcttccgtcgttacagtgccgagctctagccttgggacccagacatacatttgtaatgtgaatcataagccctccaacaccaaagtcgataagaaagtggaacctaagtcttgcgacaaaacccacacatgtcccccttgccccgctccggagctgctcggaggccctagcgtttttctgtttccccctaagcccaaggatacgctgatgatctccagaacccccgaggtgacatgtgtcgtggttgacgtgagccatgaagatcctgaggtcaaattcaattggtatgtggacggggtcgaagtgcacaacgccaagaccaaaccgcgggaggagcagtacaattctacatatcgcgttgtgtccgtcctcaccgtgctgcatcaggattggcttaacggaaaggaatacaaatgcaaggttagcaataaagctctgcccgcccctatcgagaagacgatttctaaggcgaaaggccaacccagagaacctcaggtgtatacactgcccccgtcccgggacgagctcaccaagaaccaggtcagccttacctgtctggtgaaagggttctacccttccgatatcgccgtggaatgggagtctaatggacagcccgagaacaattataagacaacccctcccgttctcgacagcgacggctcctttttcctgtactctaaactgacagtcgataagagccgctggcaacagggcaacgtgttttcctgcagcgtgatgcacgaagctctccacaaccattacacgcagaagtctctgtcccttagccctgggaaa

SEQ ID NO: 38273 - RNA, 648 nt, synthetic construct
  misc_feature 1..648: note = derived and/or modified sequence opt5 from Avelumab_LightChain1
  source 1..648: mol_type = other RNA
cagagcgccctgacccaacccgcttccgtgtctggcagccctgggcagtccatcacaatttcttgcacgggaaccagctccgacgtcggcgggtacaactatgtttcttggtaccagcagcacccgggaaaggcccccaaactcatgatctatgatgtgagcaatagaccttccggcgtgagcaaccggttctctgggtccaagagcggaaatacagcgtctctgaccatttccggccttcaagctgaggacgaagccgattactattgtagctcttacacatccagctccacccgcgtctttggcacagggaccaaagtgacggttctgggacagcccaaggccaaccctaccgtgacactctttcccccttctagcgaggaactgcaggctaataaagccacccttgtctgcctgatctccgacttctatccgggcgctgtgacagttgcctggaaggcggatgggagccccgtgaaggccggagtcgagaccacgaaaccttctaagcagtccaacaataaatacgctgccagctcttacctcagcctgacacccgaacaatggaagtcccatagatcttatagctgtcaggtgacccacgagggctccacagtggagaaaaccgtcgctcctaccgaatgcagc

SEQ ID NO: 38274 - RNA, 1344 nt, synthetic construct
  misc_feature 1..1344: note = derived and/or modified sequence opt5 from Bapineuzumab_HeavyChain1
  source 1..1344: mol_type = other RNA
gaggtgcagctgctcgaaagcggcgggggactggtccaacccggcgggtcccttagactgtcttgcgccgctagcggattcaccttttccaactacggcatgtcttgggttcggcaggcccctgggaagggactcgagtgggtggcgagcatccgctccggcggcgggagaacatattactctgacaatgtgaaaggacggttcacgattagccgcgataactccaagaataccctgtatcttcagatgaacagcctgagagctgaagacacagccgtctactattgtgtgcggtacgatcactattctggctccagcgactactgggggcagggaaccctcgttacagtgtcttccgccagcaccaaaggcccgtctgtctttcccctggctccttccagcaagtccacatctgggggaaccgccgctctgggctgcctcgtgaaagattacttccccgagcctgttacggtgagctggaactccggcgccctgaccagcggggtccatacatttcccgcggtgcttcaatcttccggactgtatagcctctctagcgtggtcaccgttccttcctctagcctgggcacacagacctacatctgtaatgtgaatcacaagccgtccaacacgaaggtggacaaaaaggtcgaacccaaaagctgcgataagacacatacctgtcctccctgccctgcccccgagcttctcgggggaccgtctgtgttcctgtttcctcccaaacctaaggacacactgatgatttcccgcacccccgaggttacctgtgtggtcgtggatgttagccacgaagaccccgaggtgaagttcaattggtatgtcgatggcgtggaagtccataacgctaaaacaaagcctagagaggagcagtacaattctacgtatcgggtggtttccgtgctgaccgtcctccaccaggactggctgaacgggaaagaatacaagtgcaaagtgagcaataaggcccttccggctcccatcgagaaaacaatttccaaggccaagggacaacctcgcgaaccccaggtttataccctgcctccctctagagaggaaatgaccaaaaaccaggtgagcctcacatgtctggtcaagggcttttacccgtccgatatcgcggtggagtgggagtctaatggccagcctgaaaacaactacaaaacgacaccccctgtgcttgacagcgacgggtccttctttctgtatagcaagctcaccgttgataaatctcggtggcaacagggaaatgtcttctcctgcagcgtgatgcacgaggccctgcataaccactacacccagaagtctctgtccctcagccccggc

SEQ ID NO: 38275 - RNA, 657 nt, synthetic construct
  misc_feature 1..657: note = derived and/or modified sequence opt5 from Bapineuzumab_LightChain1
  source 1..657: mol_type = other RNA
gacgtggtcatgacccagagccccctgtccctccctgttacaccgggcgagcccgcctctatcagctgcaagtcctctcaaagcctgcttgattccgacgggaaaacgtacctgaactggctcctgcagaagcctggacagtctccccagagacttatttatctggtgagcaaactcgattccggcgtgcctgaccggttcagcgggtctggatccggcaccgattttacactgaagatcagccgcgtcgaagctgaggacgtgggggtttactattgttggcaaggaacccacttccccagaacatttggccagggcaccaaagtggaaattaagcggacagtcgccgcgccttctgtgttcatctttccgccctccgatgagcagctcaagagcgggaccgcttctgttgtgtgcctgctgaataacttctaccctcgcgaagccaaagtccagtggaaggtggacaatgcccttcaatccggaaacagccaggagtccgtgacggagcaggattctaaagacagcacctattccctgagctctacactcaccctgtccaaggctgattacgaaaaacataaggtctatgcctgtgaggttacacaccagggccttagctctcccgtgaccaagagctttaatagaggggaatgc

SEQ ID NO: 38276 - RNA, 1338 nt, synthetic construct
  misc_feature 1..1338: note = derived and/or modified sequence opt5 from Basiliximab_HeavyChain
  source 1..1338: mol_type = other RNA
cagctgcaacagagcggcaccgtgctcgccagacccggggcttccgtcaagatgtcttgcaaagccagcggatactccttcacacggtattggatgcactggatcaagcagcgccctggccaggggctggagtggattggagcgatctacccgggcaactctgacacgagctataatcaaaaatttgaagggaaggctaaacttaccgccgttacatccgcctctaccgcttacatggagctgagctccctcacacatgaagatagcgccgtgtattactgttctagagactatggatactacttcgatttttggggccagggcaccacactgaccgtgtccagcgcttctacgaaggggccctccgtcttccctcttgcccccagctctaagtccaccagcggaggcacagcggccctggggtgcctcgtgaaagactattttcctgagcccgttaccgtgtcctggaactctggagctctgacaagcggcgtccacaccttccctgccgtgctgcagtccagcgggctctactctctgtccagcgttgtgacggtcccgtctagctcccttggaacacagacctatatttgtaatgtgaaccataagccctctaatacaaaagtggataagcgggtcgaacctcccaaaagctgcgacaagacccacacctgtcctccctgcccggctcctgagctgctcggcggcccctccgtttttctgttccctcccaagcccaaagatacacttatgatcagccgcacgcctgaggtgacctgtgtggtcgtggacgtttctcatgaagatccggaggtgaagtttaactggtacgtcgacggggtggaagttcacaatgccaaaacaaagcccagagaggagcaatataactccacctaccgggtggtcagcgtgctgacagtcctccaccaggattggctgaatggaaaagaatataagtgcaaagtgtctaacaaggcgctgcctgcccccattgagaagaccatctccaaagctaagggccagcctcgcgaaccccaggtttacacgctcccgcctagcagagacgagctgacaaagaatcaagtgtcccttacctgtctggtcaaggggttctacccctctgatatcgccgtggaatgggagagcaacggacagcctgagaataactataaaaccacaccccctgttctcgactccgacggcagctttttcctgtactctaaacttaccgtggataagtcccggtggcagcaagggaatgtctttagctgctctgtgatgcatgaagctctgcacaaccattatacacagaaatccctcagcctgtctcccggaaag

SEQ ID NO: 38277 - RNA, 630 nt, synthetic construct
  misc_feature 1..630: note = derived and/or modified sequence opt5 from Basiliximab_LightChain
  source 1..630: mol_type = other RNA
cagatcgtgagcacccaatcccccgccattatgtctgctagccctggcgagaaggtcacaatgacgtgctccgcctctagctccagatcttacatgcagtggtatcagcagaaaccggggaccagccccaagcggtggatctacgacacatccaaactggcgagcggagttcctgctcgcttctctggctccgggagcggaacctcttattccctcacaattagctctatggaagccgaggatgccgctacctactattgtcaccaaagatccagctacacatttggcgggggaaccaagctggaaatcaaacggacggtggccgctccctccgtgttcatttttcctccctctgacgagcagcttaagagcggcaccgcctccgtcgtgtgcctgctcaacaatttctatcctcgcgaagcgaaggttcagtggaaagtggataacgccctgcagagcggcaattctcaagagtccgtcacagagcaggacagcaaggattctacctacagcctttcctctacactgaccctcagcaaagctgactacgaaaagcataaagtgtatgcctgtgaggttacgcaccaggggctgtccagcccggtgacaaagtcttttaacagaggagaa

SEQ ID NO: 38278 - RNA, 1350 nt, synthetic construct
  misc_feature 1..1350: note = derived and/or modified sequence opt5 from Bavituximab_HeavyChain
  source 1..1350: mol_type = other RNA
gaggtgcagctgcaacagagcggccccgaactcgagaagcctggggcctccgtcaaactgtcttgcaaggctagcggatactccttcaccggctataacatgaattgggttaaacagtctcacgggaaaagccttgaatggatcggacatattgacccgtactatggcgatacatcctacaaccagaaatttagagggaaggccacgctgaccgtggacaagtctagctccacagcgtatatgcaactcaaaagcctgacctctgaggattccgctgtgtactattgtgtcaagggaggctactacggccactggtatttcgacgtgtggggagccggaacaaccgttacagtgagctctgcctccaccaaaggccccagcgtctttcctcttgctccctcttccaagagcacgtccgggggaaccgccgctctgggctgcctcgtgaaagattacttccctgaacccgttacagtgtcttggaatagcggggccctgacctccggagtccatacatttcctgcggtgctgcagagctctggcctctattccctgagctctgtggtcaccgttccgagctcctctcttggcacgcagacatacatctgtaacgtgaatcacaagcccagcaacaccaaggtggacaaaaaggtcgagcctaaatcctgcgataagacacatacctgtcccccttgccccgccccggagctgctcgggggacctagcgtgttcctgtttccccctaaacccaaggacacccttatgatttctcggacacccgaagttacgtgtgtggtcgtggatgtttcccacgaggaccctgaagtgaaattcaattggtatgtcgatggcgtggaggtccacaacgctaagaccaagccgcgcgaggaacagtacaatagcacatatagagtggtttctgtgctgaccgtcctccatcaagactggctgaacgggaaagagtacaagtgcaaagtgtccaataaggccctgcccgctcctatcgaaaagacaattagcaaggccaagggacagccccgggagcctcaggtttacacccttcccccgtcccgcgatgaactgacgaaaaaccaggtgtctcttacatgtctggtcaagggcttttatcctagcgacatcgcggtggagtgggagtccaatgggcaacccgaaaacaattacaaaaccacccctcccgtgctcgactctgatgggagcttctttctgtattccaagctcacagttgacaaaagcagatggcagcagggcaacgtcttctcttgctccgtgatgcacgaggccctgcataaccactacacccaaaagagcctctctctgtcccctggcaag

SEQ ID NO: 38279 - RNA, 642 nt, synthetic construct
  misc_feature 1..642: note = derived and/or modified sequence opt5 from Bavituximab_LightChain
  source 1..642: mol_type = other RNA
gacatccagatgacccaaagcccctcctctctgagcgcctccctcggcgagagagtgtctctgacatgccgggctagccaggatattgggtcctctcttaactggctgcagcagggacctgacggcacgatcaagcgcctcatttacgccaccagctccctggatagcggggtcccgaaaagattctctggatcccggagcggctctgactattcccttacaatcagctctctggaatccgaggattttgttgactactattgtctccaatacgtgagctctccccctaccttcggggcgggaacaaagctggaactgaaacgcgctgatgccgccccctccgtgtttattttccctcccagcgacgagcagctcaagtccggcaccgctagcgtcgtgtgcctgcttaataacttttatcctagagaagccaaagttcagtggaaggtggataatgctctgcagtctggcaactcccaagagagcgtcacagagcaggactctaaggatagcacctactccctctctagcacgctgaccctttccaaagccgactatgaaaagcacaaagtgtacgcgtgtgaggttacacatcaggggctgagctctccggtgaccaagtccttcaatcggggagaatgc

SEQ ID NO: 38280 - RNA, 624 nt, synthetic construct
  misc_feature 1..624: note = derived and/or modified sequence opt5 from Bavituximab_LightChain_variant_8734_L
  source 1..624: mol_type = other RNA
gacatccagatgacccaaagcccctcctctctgagcgcctccctcggcgagagagtgtctctgacatgccgggctagccaggatattgggtcctctcttaactggctgcagcagggacctgacggcacgatcaagcgcctcatttacgccaccagctccctggatagcggggtcccgaaaagattctctggatcccggagcggctctgactattcccttacaatcagctctctggaatccgaggattttgttgactactattgtctccaatacgtgagctctccccctaccttcggggcgggaacaaagctggaactgaaacgcgctgatgccgccccctccgtgtttattttccctcccagcgacgagcagctcaagtccggcaccgctagcgtcgtgtgcctgcttaataacttttatcctagagaagccaaagttcagtggaaggtggataatgctctgcagtctggcaactcccaagagagcgtcacagagcaggactctaaggatagcacctactccctctctaaagccgactatgaaaagcacaaagtgtacgcgtgtgaggttacgcatcaggggctgagctccccggtgaccaagagcttcaatcggggagaatgc

SEQ ID NO: 38281 - RNA, 1368 nt, synthetic construct
  misc_feature 1..1368: note = derived and/or modified sequence opt5 from Begelomab_HeavyChain1
  source 1..1368: mol_type = other RNA
caggtgcaactgcagcagagcggcgccgagctcgtcaagcccggggcttccgttaaactgtcttgcaaggccagcggatacaccttcagatcctatgacatcaactgggtgcggcagcgccctgaacaaggccttgagtggattgggtggatctttccgggagatggctctacaaaatacaatgaaaagttcaaagggaaggcgacgctgaccacagacaagagctcctctaccgcttatatgcagctcagcagactgacatccgaggatagcgccgtgtacttttgtgcccggtggaccgtcgtgggacccggctatttcgacgtttggggcgctgggacaaccgtgacggtctcttccgccaaaaccacacctcccagcgtgtaccctcttgctcccggatgcggcgataccacagggtcttccgttaccctgggatgtctcgtgaagggctattttcctgaaagcgtcacggtgacatggaactctgggtccctgagctcctctgtgcacaccttcccggccctgctccagagcggactgtacacaatgtccagctctgtcaccgttccctccagcacctggccttctcagacagtgacgtgcagcgtggcgcatcccgcctcctctaccacagtcgacaaaaagctggagcctagcggccccatttccaccatcaatccgtgtcctccctgcaaagagtgtcacaagtgccctgctcccaaccttgaaggcgggcccagcgtgtttattttccctccgaatatcaaggatgttctcatgatctctctgacacccaaagtgacctgtgtcgtggttgacgtgtccgaggatgaccctgatgtccaaattagctggtttgtgaacaatgtcgaagtgcatacggcccagacacagacccaccgcgaggactacaactctaccatcagagttgtgtccacacttcccattcagcatcaagattggatgagcggaaaggagttcaaatgcaaggtcaataacaaagacctgccttcccccatcgaacggaccatttctaagatcaaaggcctcgtgcgcgctccgcaggtttatattctgcctccccctgccgagcagctgagcagaaaggacgtgtccctcacatgtctggtcgtggggtttaatcccggagatatctctgtggaatggacgagcaacggccacaccgaggaaaattacaaggacacagcgcctgttcttgattccgacgggagctatttcatctactctaaactgaacatgaagacctccaaatgggagaagacagatagcttttcttgcaatgtccggcacgagggactcaaaaactattacctgaagaagaccatttcccgcagccccggcaaa

SEQ ID NO: 38282 - RNA, 639 nt, synthetic construct; identical to SEQ ID NO: 38220
  misc_feature 1..639: note = derived and/or modified sequence opt5 from Begelomab_LightChain1
  source 1..639: mol_type = other RNA

SEQ ID NO: 38283 - RNA, 1353 nt, synthetic construct
  misc_feature 1..1353: note = derived and/or modified sequence opt5 from Benralizumab_HeavyChain1
  source 1..1353: mol_type = other RNA
gaggtgcagctggtccaaagcggcgccgaagttaagaaacccggggcttccgtgaaggtgtcttgcaaagccagcggatacaccttcacatcctatgtcatccactgggtgagacagcggcctggccaggggctcgcgtggatgggatacattaacccgtataatgacggcacgaagtacaacgagcgctttaaagggaaggttaccatcacatctgatagaagcacctccacagtgtatatggaactgtctagccttcggtccgaggacaccgctgtctacctgtgtggacgcgaaggcattagatattacggcctcctgggggattactggggacagggcacacttgtgaccgttagctctgcctccacgaaggggcccagcgtgttccctctggccccctcttccaaaagcacctctggaggcacagctgccctcgggtgcctggtcaaggactattttcctgagcccgtgaccgtgtcctggaatagcggagctctgacatccggcgtccataccttccctgccgttctccaatctagcggcctgtactcccttagctctgtggtgacggtcccgtccagctctctggggacacagacctatatctgtaacgtgaatcacaaacccagcaacacaaaggttgataaaaaggtggagcctaagtcctgcgacaaaacccatacctgtcccccttgccccgcgccggaactcctgggaggcccttctgtctttctttttccccctaagcccaaagatacactgatgattagccggacgcccgaggtgacctgtgttgtggtcgacgtgtcccacgaagatcctgaggtcaagttcaattggtacgtggacggggttgaggtgcataacgccaaaacaaagccgcgcgaggaacagtataatagcacctacagagtcgtgtctgttctcacagtgctgcaccaggattggctgaacggaaaagaatataagtgcaaggtctccaataaagctctccccgcccctatcgagaagaccatcagcaaagctaagggccaaccccgggaacctcaggtgtacacgctgcccccgtctcgcgacgagcttaccaaaaaccaggtgtccctgacatgtctcgttaaggggttctaccctagcgatattgccgtcgagtgggaatccaatggacagcccgagaacaattataagaccacacctcccgtgctggactctgacggcagctttttcctttactccaaactgaccgtggataagtctagatggcaacagggcaacgtctttagctgctccgtgatgcacgaagcgctccataaccactatacacagaaaagcctgtctctgtcccctgggaag

SEQ ID NO: 38284 - RNA, 642 nt, synthetic construct
  misc_feature 1..642: note = derived and/or modified sequence opt5 from Benralizumab_LightChain1
  source 1..642: mol_type = other RNA
gacatccagatgacccaaagcccctcctctctgagcgcctccgtgggcgatagagtcacaattacgtgcgggacctctgaggacatcattaactacctcaattggtatcagcagaagcctggaaaagctccgaagctgcttatctaccacacaagccggctgcagtccggcgttccctctcgcttcagcgggtccggaagcggcaccgattttacactcaccatttcttccctgcaacctgaagacttcgccacatattactgtcagcaggggtatacccttccctacacgtttggacagggcaccaaagtggagatcaagagaacagtggcggctcctagcgtcttcatctttcccccttctgatgaacaactgaaatccggcaccgccagcgtggtttgcctcctgaacaatttctatccgcgggaggccaaggtgcagtggaaggtcgacaacgctctgcagtctggaaattcccaggaaagcgtgacagagcaagattccaaagactctacctacagcctctccagcacgctgacactttctaaggccgattacgagaaacataaggtttatgcttgtgaagtgacccaccaggggctgtccagccccgtcacaaaatcttttaaccgcggcgagtgc

SEQ ID NO: 38285 - RNA, 1329 nt, synthetic construct
  misc_feature 1..1329: note = derived and/or modified sequence opt5 from Betalutin_HeavyChain1
  source 1..1329: mol_type = other RNA
gaaatccagctgcaacagagcggccccgaactcgtgaagcctggggcctccgtcaaagtttcttgcaaggctagcggatactccttcaccgactataacatgtactgggtgaaacagtctcacggcaagagcctggagtggattgggtatatcgatccgtacaatggagacacaacgtataaccagaaatttaagggcaaggccacccttacagtggataaatcctctagcaccgcgttcattcatctgaatagcctcacaagcgaagactctgctgtctactattgtgccagatccccctacgggcactacgccatggattattggggacaaggcaccagcgtgacagtttcttccgctaagaccacgcctcccagcgtgtaccctctggcccccggctctgctgcccagaccaactccatggtcacacttgggtgcctggtgaaaggatattttcctgagccggttaccgtgacatggaatagcggctccctctctagcggggtccataccttccccgcggtgctgcagtccgacctgtacacgctctcctcttccgtgacagtccctagctctacctggcccagcgaaacagttacctgtaacgtggcccaccctgcttcctctaccaaggtggataaaaagatcgtcccccgggactgcggatgtaagccgtgcatttgtacagtgcctgaggttagctccgtgtttatctttccccctaaacccaaggatgtcctgacgatcacccttacacccaaagtgacctgcgttgtggtcgacattagcaaggatgaccctgaggtgcagttctcttggttcgtcgatgacgtggaagttcatacagcccaaacccagccgcgcgaggaacagtttaattccacgttcagaagcgtgtctgagctgcccatcatgcaccaggactggctcaacggcaaagagtttaagtgtcgggtcaattccgctgccttccctgcgcccattgaaaagacaatcagcaagaccaaggggcgccctaaagctccccaagtgtataccattccgcctcccaaggagcagatggccaaagataaggtttccctgacatgcatgatcaccgactttttccctgaagatattacagtggagtggcagtggaacggacaacccgccgaaaattacaaaaacacgcagcctatcatggacaccgatggctcttatttcgtctacagcaaacttaatgtgcagaagtccaactgggaggctggcaatacatttacctgttctgtgctgcacgaggggctccataaccaccatacagagaaaagcctgtcccacagccccggaaag

SEQ ID NO: 38286 - RNA, 642 nt, synthetic construct
  misc_feature 1..642: note = derived and/or modified sequence opt5 from Betalutin_LightChain1
  source 1..642: mol_type = other RNA
gacatcgtgatgacccagagccacaagctgctctccacatctgtcggcgatagagttagcattacgtgcaaagcctcccaagacgtgtctaccgctgtggattggtaccagcagaagcccgggcagagccctaaactgcttatcaactgggcctccacacggcataccggagtcccggaccgcttcacaggctctgggagcggaaccgattatacactgaccatttccagcatgcaagcggaggacctcgctctgtactattgtagacagcactactctacgccctttaccttcggctccgggacaaaacttgaaatcaagcgggccgatgccgctcctaccgtgagcatttttcccccttcttccgagcagctgacaagcggaggcgcctctgttgtgtgcttcctcaataacttttatcccaaggacatcaatgtcaagtggaaaatcgatggctccgaacgccagaacggggtgctgaatagctggaccgaccaagattccaaggactctacgtacagcatgtccagcacactgaccctcacaaaagatgagtatgaaagacataactcttacacctgtgaggctacccacaagacatccacgagccctattgttaaatctttcaatcggaacgagtgc

SEQ ID NO: 38287 - RNA, 1344 nt, synthetic construct
  misc_feature 1..1344: note = derived and/or modified sequence opt5 from Bevacituzuab_HeavyChain1
  source 1..1344: mol_type = other RNA
gaggtgcagctggtcgaaagcggcgggggactcgttcaacccggcgggtccctgagactttcttgcgccgctagcggatacaccttcacaaactatggcaattgggtgcggcaggcccctgggaagggactggagtgggtgggctggatcaacacgtacaccggcgaaccgacatatgcggctgactttaaacgcagattcaccttttccctcgatacatctaagagcaccgcctacctgcaaaattcccttcgggccgaggacacagctgtctattactgtgccaaatatccccactactacgggtctagccattggtatttcgatgtgtggggacagggcaccctggttacggtgtccagcgcttctaccaaggggccttccgtctttcccctcgcccctagctctaaatccacaagcggaggcaccgcggccctggggtgcctggtgaaggactacttccccgaacctgttacagtgtcttggaactccggagctctcaccagcggcgtccacacgtttccggccgtgctgcagtcctctggcctttatagcctgtccagcgtggtcacagttccctcttccagcctcgggacccagacatacatttgtaatgtgaaccataagccttctaataccaaagtggataagaaagtcgagcccaagagctgcgacaaaacccacacatgtcctccctgcccggctcctgagctgcttggaggcccctccgtgttcctgtttcctcccaagcccaaggatacgctcatctctcgcacccctgaagttacatgtgtggtcgtggacgttagccatgaggatccggaagtgaaattcaactggtatgtcgacggggtggaggtccacaatgccaagaccaaacccagagaggaacagtacaactccacatatcgggtggttagcgtgctgaccgtcctgcaccaggattggctcaatggaaaggagtacaaatgcaaggtgtctaacaaagcgctgcctgcccccattgaaaagacgatctccaaggctaaaggccaacctcgcgagccccaggtttacacacttccgcctagcagagaagagaccaagaatcaggtgtctctgacctgtctcgtcaaagggttttatccctccgacattgccgtggagtgggaaagcaacggacagcctgagaataactacaagacaacaccccctgtgctggattccgacggctctttctttctttatagcaaactgaccgttgacaagtcccggtggcaacagggcaacgtcttctcttgcagcgtgcatgaagctctccacaatcattacacgcagaagtccctgagcctgtctcccgggaaa

SEQ ID NO: 38288 - RNA, 639 nt, synthetic construct
  misc_feature 1..639: note = derived and/or modified sequence opt5 from Bevacituzuab_LightChain1
  source 1..639: mol_type = other RNA
gacatccagacccaaagcccctcctctctgagcgcctccgtgggcgatcgggtcacaattacgtgctctgctagccaggacatctccaactacctcaattggtatcagcagaaacctgggaaagccccgaaggttctgatttacttcacctctagccttcactccggagtgcccagccggttttctggctccgggagcggaacagatttcaccctgacaatctcttccctccaacctgaggactttgcgacctattactgtcagcagtatagcacagtgccctggaccttcggccaggggacgaaagtcgaaattaagcgcaccgtggctgccccttctgtttttatctttcccccttccgatgagcaactgaaaagcggaacagcctccgtggtctgccttctgaacaatttctacccgagagaagctaaggtgcagtggaaggttgacaacgccctccagtctggcaatagccaggagtccgtgaccgaacaagatagcaaagactctacatattccctgagctctaccctgacgctcagcaaggctgattacgagaaacataaggtctacgcctgtgaggtgacacaccagggcctgtcctctcccgtgaccaagagcttcaacagaggggaatgc

SEQ ID NO: 38289 - RNA, 639 nt, synthetic construct
  misc_feature 1..639: note = derived and/or modified sequence opt5 from Bevacizumab_154-aspartic_acid_LightChain
  source 1..639: mol_type = other RNA
gacatccagatgacccaaagcccctcctctctgagcgcctccgtgggcgatcgggtcacaattacgtgctctgctagccaggacatctccaactacctcaattggtatcagcagaaacctgggaaagccccgaaggttctgatttacttcacctctagccttcactccggagtgcccagccggttttctggctccgggagcggaacagatttcaccctgacaatctcttccctccaacctgaggactttgcgacctattactgtcagcagtatagcacagtgccctggaccttcggccaggggacgaaagtcgaaattaagcgcaccgtggctgccccttctgtttttatctttcccccttccgatgagcaactgaaaagcggaacagcctccgtggtctgccttctgaacaatttctacccgagagaagctaaggtgcagtggaaggttgacaacgccgatcagtctggcaatagccaggagtccgtgaccgaacaagacagcaaagattctacatattccctcagctctaccctgacgctgagcaaggctgactacgagaaacataaggtctacgcctgtgaggtgacacaccagggcctctcctctcccgtgaccaagagcttcaacagaggggaa

SEQ ID NO: 38290 - RNA, 639 nt, synthetic construct; identical to SEQ ID NO: 38289
  misc_feature 1..639: note = derived and/or modified sequence opt5 from Bevacizumab_154-substitution_deriv_LightChain
  source 1..639: mol_type = other RNA

SEQ ID NO: 38291 - RNA, 672 nt, synthetic construct
  misc_feature 1..672: note = derived and/or modified sequence opt5 from Bevacizumab_180-serine_HeavyChain
  source 1..672: mol_type = other RNA
gaggtgcagctggtcgaaagcggcgggggactcgttcaacccggcgggtccctgagactttcttgcgccgctagcggatacaccttcacaaactatggcatgaattgggtgcggcaggcccctgggaagggactggagtgggtgggctggatcaacacgtacaccggcgaaccgacatatgcggctgactttaaacgcagattcaccttttccctcgatacatctaagagcaccgcctacctgcagatgaactcccttcgggccgaggacacagctgtctattactgtgccaaatatccccactactacgggtctagccattggtatttcgatgtgtggggacagggcaccctggttacggtgtccagcgcttctaccaaggggccttccgtctttcccctcgcccctagctctaaatccacaagcggaggcaccgcggccctggggtgcctggtgaaggactacttccccgaacctgttacagtgtcttggaactccggagctctcaccagcggcgtccacacgtttccggccgtgtcccaatctagcggcctgtattcccttagctctgtggtcacagttccctccagctctctggggacccagacatacatttgtaatgtgaatcataagcctagcaataccaaagtggataagaaagtcgagcccaag

SEQ ID NO: 38292 - RNA, 672 nt, synthetic construct; identical to SEQ ID NO: 38291
  misc_feature 1..672: note = derived and/or modified sequence opt5 from Bevacizumab_180-substitution_deriv_HeavyCahin
  source 1..672: mol_type = other RNA

SEQ ID NO: 38293 - RNA, 1359 nt, synthetic construct
  misc_feature 1..1359: note = derived and/or modified sequence opt5 from Bevacizumab_beta_HeavyChain1
  source 1..1359: mol_type = other RNA
gaggtgcagctggtcgaaagcggcgggggactcgttcaacccggcgggtccctgagactttcttgcgccgctagcggatacaccttcacaaactatggcatgaattgggtgcggcaggcccctgggaagggactggagtgggtgggctggatcaacacgtacaccggcgaaccgacatatgcggctgactttaaacgcagattcaccttttccctcgatacatctaagagcaccgcctacctgcagatgaactcccttcgggccgaggacacagctgtctattactgtgccaaatatccccactactacgggtctagccattggtatttcgatgtgtggggacagggcaccctggttacggtgtccagcgcttctaccaaggggccttccgtctttcccctcgcccctagctctaaatccacaagcggaggcaccgcggccctggggtgcctggtgaaggactacttccccgaacctgttacagtgtcttggaactccggagctctcaccagcggcgtccacacgtttccggccgtgctgcaatcctctggcctttatagcctgtccagcgtggtcacagttccctcttccagcctcgggacccagacatacatttgtaatgtgaatcataagccttctaataccaaagtggataagaaagtcgagcccaagagctgcgacaaaacccacacatgtcctccctgcccggctcctgagctgcttggaggcccctccgtgttcctgtttcctcccaagcccaaggatacgctcatgatctctcgcacccctgaagttacatgtgtggtcgtggacgttagccatgaggatccggaagtgaaattcaactggtatgtcgacggggtggaggtccacaatgccaagaccaaacccagagaggaacagtacaactccacatatcgggtggttagcgtgctgaccgtcctgcaccaggattggctcaatggaaaggagtacaaatgcaaggtgtctaacaaagcgctgcctgcccccattgaaaagacgatctccaaggctaaaggccaacctcgcgagccccaggtttacacacttccgcctagcagagaagagatgaccaagaatcaggtgtctctgacctgtctcgtcaaagggttttatccctccgacattgccgtggagtgggaaagcaacggacagcctgagaataactacaagacaacaccccctgtgctggattccgacggctctttctttctttatagcaaactgaccgttgacaagtcccggtggcaacagggcaacgtcttctcttgcagcgtgatgcatgaagctctccacaatcattacacgcagaagtccctgagcctgtctcccgggaaa

SEQ ID NO: 38294 - RNA, 642 nt, synthetic construct
  misc_feature 1..642: note = derived and/or modified sequence opt5 from Bevacizumab_beta_LightChain1
  source 1..642: mol_type = other RNA
gacatccagatgacccaaagcccctcctctctgagcgcctccgtgggcgatcgggtcacaattacgtgctctgctagccaggacatctccaactacctcaattggtatcagcagaaacctgggaaagccccgaaggttctgatttacttcacctctagccttcactccggagtgcccagccggttttctggctccgggagcggaacagatttcaccctgacaatctcttccctccaacctgaggactttgcgacctattactgtcagcagtatagcacagtgccctggaccttcggccaggggacgaaagtcgaaattaagcgcaccgtggctgccccttctgtttttatctttcccccttccgatgagcaactgaaaagcggaacagcctccgtggtctgccttctgaacaatttctacccgagagaagctaaggtgcagtggaaggttgacaacgccctccagtctggcaatagccaggagtccgtgaccgaacaagatagcaaagactctacatattccctgagctctaccctgacgctcagcaaggctgattacgagaaacataaggtctacgcctgtgaggtgacacaccagggcctgtcctctcccgtgaccaagagcttcaacagaggggaatgc

SEQ ID NO: 38295 - RNA, 687 nt, synthetic construct
  misc_feature 1..687: note = derived and/or modified sequence opt5 from Bevacizumab_FcDomain
  source 1..687: mol_type = other RNA
agctgcgacaagacccacacatgtcccccttgcccggcccccgagctgctcggcgggccttccgtgttcctgtttccccctaaacccaaggatacgcttatgatctctagaacccctgaagtcacatgtgttgtggtggacgtcagccatgaggatccggaagtgaaattcaactggtacgttgacggagtggaggtccacaatgctaagaccaaaccccgggaggaacagtataactccacataccgcgtggtttctgtgctgaccgtcctccatcaagattggctgaatggcaaggagtataagtgcaaagtgagcaacaaggcccttcctgcgcccattgaaaagacaatctccaaggctaaagggcagcctagagagccccaggtgtacaccctgccgccttctcgggacgaactcacgaagaatcaggtcagcctgacctgtctggttaagggattttatccctccgatattgccgtggagtgggagagcaacggccaacctgaaaataactacaaaacaacccctcccgtgctcgactctgatgggtccttctttctgtatagcaaacttacagtcgacaaatctcgctggcagcagggaaatgtgttctcctgcagcgttatgcacgaggccctgcataaccactacacccagaagtctctctccctgagccccggcaaa

SEQ ID NO: 38296 - RNA, 672 nt, synthetic construct
  misc_feature 1..672: note = derived and/or modified sequence opt5 from Bevacizumab_HeavyChain
  source 1..672: mol_type = other RNA
gaggtgcagctggtcgaaagcggcgggggactcgttcaacccggcgggtccctgagactttcttgcgccgctagcggatacaccttcacaaactatggcatgaattgggtgcggcaggcccctgggaagggactggagtgggtgggctggatcaacacgtacaccggcgaaccgacatatgcggctgactttaaacgcagattcaccttttccctcgatacatctaagagcaccgcctacctgcagatgaactcccttcgggccgaggacacagctgtctattactgtgccaaatatccccactactacgggtctagccattggtatttcgatgtgtggggacagggcaccctggttacggtgtccagcgcttctaccaaggggccttccgtctttcccctcgcccctagctctaaatccacaagcggaggcaccgcggccctggggtgcctggtgaaggactacttccccgaacctgttacagtgtcttggaactccggagctctcaccagcggcgtccacacgtttccggccgtgctgcaatcctctggcctttatagcctgtccagcgtggtcacagttccctcttccagcctcgggacccagacatacatttgtaatgtgaatcataagccttctaataccaaagtggataagaaagtcgagcccaag

SEQ ID NO: 38297 - RNA, 1428 nt, synthetic construct
  misc_feature 1..1428: note = derived and/or modified sequence opt5 from Bevacizumab_HeavyChain_variant1
  source 1..1428: mol_type = other RNA
gccagcgctaccatgggctggtcctgcatcattctgttcctcgtggccacagcgacgggggtccactctgaggttcagctggtggaaagcggaggcgggcttgtgcaacccggaggctccctgagactctcttgtgctgccagcgggtacacctttacaaactatggaatgaattgggtccggcaggcccctggcaagggcctggagtgggtggggtggatcaacacctacacaggagaaccgacctatgctgccgacttcaaacgcagatttacattctcccttgatacctctaagagcacggcttacctgcagatgaatagcctccgggccgaggacaccgcggtttattactgcgccaaatatccccattactacggctcctctcactggtattttgatgtgtgggggcagggaacactggtcaccgtgtccagcgcttctacaaagggcccttccgttttccccctggcccctagctctaaatccaccagcgggggaacggctgccctcggctgtctggtgaaggactactttcccgaacctgtcacagtgtcctggaactctggcgcgcttaccagcggggtgcatacattcccggccgtcctgcaatccagcggactctattctctgtccagcgttgtgaccgtgccctctagctcccttggcacccagacatacatttgcaatgtcaaccacaagccttctaatacgaaagtggataagaaagttgagcccaagagctgtgacaaaacccatacatgccctccctgtccggctcctgagctgctcgggggaccctccgtgtttctgttccctcccaagcccaaggataccctgatgatcagccgcacacctgaagtgacctgcgtcgttgtggacgtctctcacgaggatccggaagtgaaatttaactggtatgtcgacggcgtggaggttcacaatgccaagacgaaacccagagaggaacagtacaactccacatatcgggtggtcagcgtgctcaccgttctgcatcaggattggcttaatgggaaggagtacaaatgtaaggtgtctaacaaagctctgcctgcccccattgaaaagaccatctccaaggccaaaggacaacctcgcgagccccaggtctacacactcccgcctagcagagaagagatgaccaagaatcaggtgtccctgacatgccttgtgaaaggcttctatccctctgacatcgctgttgagtgggaaagcaacggccagcctgagaataactacaagacgacaccccctgtcctggattccgacgggtctttctttctctatagcaaactgaccgtggacaagtcccggtggcaacagggaaacgtgttcagctgttctgtcatgcacgaagcgctgcataatcactacacccagaagtccctcagcctgtctcccggcaaa

SEQ ID NO: 38298 - RNA, 369 nt, synthetic construct
  misc_feature 1..369: note = derived and/or modified sequence opt5 from Bevacizumab_HeavyChain_V-Region
  source 1..369: mol_type = other RNA
gaggtgcagctggtcgaaagcggcgggggactcgttcaacccggcgggtccctgagactttcttgcgccgctagcggatacaccttcacaaattatggcatgaattgggtgcggcaggcccctgggaagggactggagtgggtgggctggatcaacacgtacaccggcgaaccgacatatgcggctgactttaaacgcagattcaccttttccctcgatacatctaagagcaccgcctacctgcagatgaactcccttcgggccgaggacacagctgtctattactgtgccaaatatccccactactacgggtctagccattggtatttcgatgtgtggggacagggcaccctggttacggtgtccagc

SEQ ID NO: 38299 - RNA, 717 nt, synthetic construct
  misc_feature 1..717: note = derived and/or modified sequence opt5 from Bevacizumab_LightChain1
  source 1..717: mol_type = other RNA
gccagcaagctggctaccatgggctggtcctgcatcattctcttcctggtggccacagcgacgggggtccactctgacatccagatgacccaaagcccctcctctcttagcgcttccgttggagatagagtgacaattacctgtcgggcctctcaggacatcagctcctacctgaactggtatcagcagaaacctggcaaggccccgaaactcctgatttactatacaagccgccttcattctggggtgccctccagatttagcggatctggctccgggaccgatttcacatttaccatcagctctctgcaacctgaggacatcgctacgtactattgccagcagggaaataccctcccctacacattcggccagggcaccaaggtcgaaattaaacggacagtggccgctccttccgtttttatctttccccctagcgatgagcaactgaagtccgggaccgcctctgtggtctgtctgctcaacaatttctatccgcgcgaagcgaaggtgcagtggaaagttgacaacgccctgcagagcggaaattcccaggagagcgtgacggaacaagattctaaggactccacatacagcctttctagcaccctgacactctccaaagctgattacgagaagcacaaagtctatgcctgcgaggtgacccatcagggcctgtctagccccgtgaccaagtccttcaacagaggggaatgt

SEQ ID NO: 38300 - RNA, 711 nt, synthetic construct
  misc_feature 1..711: note = derived and/or modified sequence opt5 from Bevacizumab_LightChain2
  source 1..711: mol_type = other RNA
gccagcgctaccatgggctggtcctgcatcattctgttcctcgtggccacagcgacgggggtccactctgacatccagatgacccaaagcccctcctctctgagcgcttccgttggagatagagtgacaattacctgttctgccagccaggacatctccaactaccttaattggtatcagcagaagcctggcaaagccccgaaggtgctgatttactttacaagctctctccattccggggtccccagccggttctctggatccggcagcgggaccgattttacactgaccatctcttcccttcaacctgaggacttcgctacgtattactgccagcagtatagcaccgtgccctggacatttggacagggcaccaaagttgaaatcaagcgcacagtggccgctccttccgtcttcatttttcccccttctgatgagcaactgaaaagcggcaccgcctccgtggtttgtctcctgaacaatttctacccgagagaagcgaaggtgcagtggaaggtcgacaacgccctgcagagcggaaattctcaggagtccgtgacggaacaagatagcaaagactctacatatagcctctcctctaccctgacacttagcaaggctgattacgagaaacacaaggtgtacgcctgcgaggtcacccatcaggggctgtccagccccgttaccaaatcttttaaccggggcgaatgt

SEQ ID NO: 38301 - RNA, 642 nt, synthetic construct; identical to SEQ ID NO: 38294
  misc_feature 1..642: note = derived and/or modified sequence opt5 from Bevacizumab_LightChain
  source 1..642: mol_type = other RNA

SEQ ID NO: 38302 - RNA, 324 nt, synthetic construct
  misc_feature 1..324: note = derived and/or modified sequence opt5 from Bevacizumab_LightChain_VJ-Region
  source 1..324: mol_type = other RNA
gacatccagatgacccaaagcccctcctctctgagcgcctccgtgggcgatagagtcacaattacgtgctctgctagccaggacatctccaactacctcaattggtatcagcagaagcctgggaaagccccgaaggttctgatttacttcacctctagccttcactccggagtgcccagccggttttctggctccgggagcggaacagatttcaccctgacaatctcttccctccaacctgaggactttgcgacctattactgtcagcagtatagcacagtgccctggaccttcggccaggggacgaaagtcgaaattaagcgc

SEQ ID NO: 38303 - RNA, 321 nt, synthetic construct
  misc_feature 1..321: note = derived and/or modified sequence opt5 from Bevacizumab_LightChain_V-Region
  source 1..321: mol_type = other RNA
gacatccagatgacccaaagcccctcctctctgagcgcctccgtgggcgatagagtcacaattacgtgctctgctagccaggacatctccaactacctcaattggtatcagcagaagcctgggaaagccccgaaggttctgatttacttcacctctagccttcactccggagtgcccagccggttttctggctccgggagcggaacagatttcaccctgacaatctcttccctccaacctgaggactttgcgacctattactgtcagcagtatagcacagtgccctggaccttcggccaggggacgaaagtcgaaattaag

SEQ ID NO: 38304 - RNA, 369 nt, synthetic construct; identical to SEQ ID NO: 38298
  misc_feature 1..369: note = derived and/or modified sequence opt5 from Bevacizumab-rhuMAb-VEGF_HeavyChain_gamma1-Chain_VDJ-Region
  source 1..369: mol_type = other RNA

SEQ ID NO: 38305 - RNA, 321 nt, synthetic construct; identical to SEQ ID NO: 38303
  misc_feature 1..321: note = derived and/or modified sequence opt5 from Bevacizumab-rhuMAb-VEGF_LightChain_VJ-Region
  source 1..321: mol_type = other RNA

SEQ ID NO: 38306 - RNA, 1341 nt, synthetic construct
  misc_feature 1..1341: note = derived and/or modified sequence opt5 from Bevacizumab_gamma1-Chain
  source 1..1341: mol_type = other RNA
gaggtgcagctggtcgaaagcggcgggggactcgttcaacccggcgggtccctgagactttcttgcgctgctagcggatacaccttcacaaactatggcatgaattgggtgcggcaggcccctgggaagggactggagtgggtgggctggatcaacacgtacaccggcgaaccgacatatgcggctgactttaaacgcagattcaccttttccctcgatacatctaagagcaccgcctacctgcagatgaactcccttcgggccgaggacacagctgtctattactgtgccaaatatccccactactacgggtctagccattggtatttcgatgtgtggggacagggcaccctggttacggtgtccagcgcttctaccaaggggccttccgtctttcccctcgcccctagctctaaatccacaagcggaggcaccgcggccctggggtgcctggtgaaggactacttccccgaacctgttacagtgtcttggaactccggagctctcaccagcggcgtccacacgtttccggccgtgctgcaatcctctggcagcctttccagcgtggtcacagttccctcttccagcctggggacccagacatatatttgtaatgtgaatcataagccttctaataccaaagtggataagaaagtcgagcccaagagctgcgacaaaacccacacatgtcctccctgcccggctcctgagctcctgggaggcccctccgtgttcctttttcctcccaagcccaaggatacgctgatgatctctcgcacccctgaagttacatgtgtggtcgtggacgttagccatgaggatccggaagtgaaattcaactggtacgtcgacggggtggaggtccacaatgccaagaccaaacccagagaggaacagtataactcctacgtggttagcgtgctcacagtcctgcaccaggattggctgaatggaaaggagtataaatgcaaggtgtctaacaaagcgctccctgcccccattgaaaagaccatctccaaggctaaaggccaacctcgggagccccaggtttacacgctgccgcctagccgcgacgaacttacaaagaatcaggtgtctctgacctgtctcgtcaaagggttttacccctccgatattgccgtggagtgggagagcaacggacagcctgaaaataactataagaccacaccccctgtgctggactccgacggctctttctttaaaaagctgaccgttgataagagcagatggcaacagggcaacgtcttctcctgctctgtgatgcatgaggcccttcacaatcattacacacagaaaagcctctccctgagccccgggaag

SEQ ID NO: 38307 - RNA, 1359 nt, synthetic construct
  misc_feature 1..1359: note = derived and/or modified sequence opt5 from Bevacizumab_gamma1-Chain_CH3-Region_mutein
  source 1..1359: mol_type = other RNA
gaggtgcagctggtcgaaagcggcgggggactcgttcaacccggcgggtccctgagactttcttgcgccgctagcggatacaccttcacaaactatggcatgaattgggtgcggcaggcccctgggaagggactggagtgggtgggctggatcaacacgtacaccggcgaaccgacatatgcggctgactttaaacgcagattcaccttttccctcgatacatctaagagcaccgcctacctgcagatgaatagccttcgggccgaggacacagctgtctattactgtgccaaatatccccactactacgggtctagccattggtatttcgatgtgtggggacagggcaccctggttacggtgtccagcgcttctaccaaggggccttccgtctttcccctcgcccctagctctaaatccacaagcggaggcaccgcggccctggggtgcctggtgaaggactacttccccgaacctgttacagtgtcttggaactccggagctctcaccagcggcgtccacacgtttccggccgtgctgcaatcctctggcctttatagcctgtccagcgtggtcacagttccctcttccagcctcgggacccagacatacatttgtaatgtgaaccataagccttctaataccaaagtggataagaaagtcgagcccaagagctgcgacaaaacccacacatgtcctccctgcccggctcctgagctgcttggaggcccctccgtgttcctgtttcctcccaagcccaaggatacgctcatgatctctcgcacccctgaagttacatgtgtggtcgtggacgttagccatgaggatccggaagtgaaattcaactggtatgtcgacggggtggaggtccacaatgccaagaccaaacccagagaggaacagtacaactccacatatcgggtggttagcgtgctgaccgtcctgcaccaggattggctcaatggaaaggagtacaaatgcaaggtgtctaacaaagcgctgcctgcccccattgaaaagacgatctccaaggctaaaggccaacctcgcgagccccaggtttgtacacttccgcctagcagagacgaactgaccaagaatcaggtgtctctctcctgcgccgtcaaagggttttaccccagcgatattgctgtggagtgggagtccaacggacagcctgaaaataactataagaccacaccccctgtgctggactctgacggcagcttctttcttgtttccaaactgaccgtcgataagtctcggtggcaacagggcaacgtgttcagctgttccgtgatgcatgaggccctccacaatcattacacacagaagtccctgtctctgtcccccgggaaa

SEQ ID NO: 38308 - RNA, 1347 nt, synthetic construct; identical to SEQ ID NO: 38221
  misc_feature 1..1347: note = derived and/or modified sequence opt5 from Bezlotoxumab_HeavyChain1
  source 1..1347: mol_type = other RNA

SEQ ID NO: 38309 - RNA, 645 nt, synthetic construct; identical to SEQ ID NO: 38222
  misc_feature 1..645: note = derived and/or modified sequence opt5 from Bezlotoxumab_LightChain1
  source 1..645: mol_type = other RNA

SEQ ID NO: 38310 - RNA, 1335 nt, synthetic construct
  misc_feature 1..1335: note = derived and/or modified sequence opt5 from Bimagrumab_HeavyChain1
  source 1..1335: mol_type = other RNA
caggtgcaactggtccagagcggcgccgaggttaagaaacccggggcttccgtgaaggtgtcttgcaaagccagcggatacaccttcacatcctcttatatcaactgggtcagacaggcgcctggccaggggctcgaatggatgggaacgattaatccggtgagcggctccacctcttacgctcaaaagtttcaggggcgggttacaatgacccgcgacacaagcatctccaccgcctatatggagctgagcagacttcggtctgatgacacagccgtgtactattgtgctcgcggaggctggttcgattactggggccaggggaccctggtcacggtgtccagcgcctctaccaaaggaccctccgtttttcctctcgctcccagctctaagtccacaagcggcgggaccgccgcgctgggatgccttgtgaaggactatttccctgaacccgtcacagtgtcctggaactctggcgccctgaccagcggggtgcacacgtttcctgctgtcctccagtccagcggactgtactctctgtccagcgttgtgacagtgccgtctagctccctcggcacccaaacatacatttgtaatgtcaaccataaaccctctaataccaaggtggataaaagagttgagcctaagagctgcgacaaaacccacacatgtcccccttgccccgccccggaagctgccggcgggccttccgtgttcctgtttccccctaagcccaaggatacgcttatgatcagccggacccccgaggtcacatgtgtggttgtggacgtctctcatgaggatcctgaagtgaaattcaactggtatgtcgacggagtggaggttcacaatgcgaagaccaaaccgcgcgaggaacagtacaactccacatatagagtggtcagcgtgctgaccgttctccatcaggattggctgaatggcaaggagtacaaatgcaaggtgtctaacaaagcccttcccgctcctattgaaaagacgatctccaaggccaaagggcagccccgggagcctcaagtctatacactgcccccgagccgcgaagagatgaccaagaatcaggtgtccctcacctgtctggtgaaaggattttacccttctgacatcgctgttgaatgggagagcaacggccagcccgagaataactataagacaacccctcccgtcctggattccgacgggtctttctttctctacagcaaactgacagtggacaagtccagatggcaacagggaaatgtgttcagctgctctgtcatgcacgaagcccttcacaaccattacacgcagaagtccctgagcctctctcctggcaaa

SEQ ID NO: 38311 - RNA, 1332 nt, synthetic construct
  misc_feature 1..1332: note = derived and/or modified sequence opt5 from Bimagrumab_HeavyChain
  source 1..1332: mol_type = other RNA
caggtgcaactggtccagagcggcgccgaggttaagaaacccggggcttccgtgaaggtgtcttgcaaagccagcggatacaccttcacatcctcttatatcaactgggtcagacaggcgcctggccaggggctcgaatggatgggaacgattaatccggtgagcggctccacctcttacgctcaaaagtttcaggggcgggttacaatgacccgcgacacaagcatctccaccgcctatatggagctgagcagacttcggtctgatgacacagccgtgtactattgtgctcgcggaggctggttcgattactggggccaggggaccctggtcacggtgtccagcgcctctaccaaaggaccctccgtttttcctctcgctcccagctctaagtccacaagcggcgggaccgccgcgctgggatgccttgtgaaggactatttccctgaacccgtcacagtgtcctggaactctggcgccctgaccagcggggtgcacacgtttcctgctgtcctccagtccagcggactgtactctctgtccagcgttgtgacagtgccgtctagctccctcggcacccaaacatacatttgtaatgtcaaccataaaccctctaataccaaggtggataaaagagttgagcctaagagctgcgacaaaacccacacatgtcccccttgccccgccccggaagctgccggcgggccttccgtgttcctgtttccccctaagcccaaggatacgcttatgatcagccggacccccgaggtcacatgtgtggttgtggacgtctctcatgaggatcctgaagtgaaattcaactggtatgtcgacggagtggaggttcacaatgcgaagaccaaaccgcgcgaggaacagtacaactccacatatagagtggtcagcgtgctgaccgttctccatcaggattggctgaatggcaaggagtacaaatgcaaggtgtctaacaaagcccttcccgctcctattgaaaagacgatctccaaggccaaagggcagccccgggagcctcaagtctatacactgcccccgagccgcgaagagatgaccaagaatcaggtgtccctcacctgtctggtgaaaggattttacccttctgacatcgctgttgaatgggagagcaacggccagcccgagaataactataagacaacccctcccgtcctggattccgacgggtctttctttctctacagcaaactgacagtggacaagtccagatggcaacagggaaatgtgttcagctgctctgtcatgcacgaagcccttcacaaccattacacgcagaagtccctgagcctctctcctggc

SEQ ID NO: 38312 - RNA, 651 nt, synthetic construct
  misc_feature 1..651: note = derived and/or modified sequence opt5 from Bimagrumab_LightChain1
  source 1..651: mol_type = other RNA
cagagcgccctgacccaacccgcttccgtgtctggcagccctgggcagtccatcacaatttcttgcacgggaaccagctccgacgtcggctcttacaactatgttaattggtaccagcagcacccggggaaggcccccaaactcatgatctatggagtgagcaagagaccttccggcgtgagcaaccggttctctgggtccaaaagcggaaatacagcgtctctgaccatttccggccttcaagctgaggatgaagccgactactattgtggcacatttgccgggggaagctactatggcgtcttcgggggaggcaccaagctgacagtgctcgggcagcccaaagctgccccttctgttaccctgtttcccccttccagcgaggaacttcaggctaacaaggccacgctggtgtgcctcatctccgatttctacccgggagcggtcaccgtggcctggaaggctgactctagccccgttaaagccggcgtggagacaaccacaccttccaagcagagcaataacaaatacgctgcctcttcctatctgagcctgacccccgaacaatggaagtctcatcgcagctactcctgtcaggtcacgcacgagggctctacagtggagaaaaccgtggcgcctacagaatgcagc

SEQ ID NO: 38313 - RNA, 1365 nt, synthetic construct
  misc_feature 1..1365: note = derived and/or modified sequence opt5 from Bimekizumab_HeavyChain1
  source 1..1365: mol_type = other RNA
gaggtgcagctggtcgaaagcggcgggggactcgttcaacccggcgggtccctgagactttcttgcgccgctagcggattcaccttttccgactacaacatggcctgggtgcggcaggcgcctggcaaggggctggagtgggtggctacaatcacgtatgaaggacgcaatacctactatagagattctgtcaaaggccggttcacaattagccgcgacaacgccaaaaattccctctacctgcagatgaactctcttagagccgaggataccgctgtgtattactgtgccagcccgccccagtattacgaaggctccatctaccggctgtggtttgctcactgggggcaaggaacactcgttaccgtgagctctgcctccacaaagggccctagcgtcttccccctggcgccttcttccaagagcacctctgggggaacggccgctctgggctgcctcgtgaaagactattttcccgagcctgttaccgtgtcctggaatagcggggccctgacatccggagtccataccttcccggctgtgcttcagtctagcggcctgtactccctcagctctgtggtcacagttccctccagctctctgggcacccagacgtatatttgtaacgtgaatcacaagcctagcaacacaaaggtggataaaaaggtcgagcccaaatcctgcgacaagacccatacatgtcctccctgcccggcccctgaacttctgggaggaccctctgtgtttctcttccctcccaaacccaaggataccctgatgatcagccgcacccctgaggttacatgtgtggtcgtggacgtttcccacgaagatccggaggtgaagtttaattggtacgtcgacggcgtggaggtccataacgcgaaaacgaagcccagagaggaacagtataatagcacctaccgggtggtttctgtgctgacagtcctccaccaagattggctgaacgggaaagaatataagtgcaaagtgtccaataaggcccttcctgctcccattgagaaaaccatcagcaaggccaagggacagcctcgcgaaccccaggtttacacactgccgccttctagagacgagctcaccaaaaaccaggtgtccctgacgtgtcttgtcaagggcttctaccccagcgatatcgctgtggagtgggaatccaatgggcaacctgagaacaactataaaacaacaccccctgtgctggactctgacgggagctttttcctctactccaagctgaccgttgataaatctcggtggcagcagggcaatgtctttagctgctccgtgatgcacgaagccctgcataaccactatacccaaaagagcctctctctgtcccccggcaag

SEQ ID NO: 38314 - RNA, 642 nt, synthetic construct
  misc_feature 1..642: note = derived and/or modified sequence opt5 from Bimekizumab_LightChain1
  source 1..642: mol_type = other RNA
gccatccagctgacccaaagcccctcctctctcagcgcttccgtgggcgaccgggtcacaattacgtgccgggccgatgagtctgttcgcaccctgatgcactggtaccagcagaagcctgggaaagcgccgaaacttctgatctatctcgtgagcaactccgaaattggagtgcccgacagattctctggcagcgggtccggaacagattttcggctgaccatcagctctcttcagcctgaggacttcgctacatactattgtcaacagacctggtccgatccctggacatttggccaggggaccaaggtcgaaattaagcgcacggtggccgcccctagcgttttcatctttcccccttctgacgagcagctgaaatccggaaccgctagcgtggtctgcctcctgaataacttctacccgagagaagccaaggtgcaatggaaggttgataatgctctgcagtctggcaactcccaggagagcgtgacagagcaggactccaaagattctacctatagcctctccagcacactgaccctttctaaggccgactacgaaaaacataaggtctatgcgtgtgaggtgacgcaccaaggcctgtccagccccgtgacaaaatcttttaatagaggggaatgc

SEQ ID NO: 38315 - RNA, 1344 nt, synthetic construct
  misc_feature 1..1344: note = derived and/or modified sequence opt5 from Bleselumab_HeavyChain1
  source 1..1344: mol_type = other RNA
cagctgcaactccaggagagcggccccgggctgcttaagccttccgaaaccctgtctctcacatgcacggtgagcggaggctccatctctagcccggggtactatggaggctggattagacagccccctgggaaaggactggagtggatcggctccatttacaagtctggcagcacctatcacaacccctcccttaaaagccgggtcacaatctctgttgacacctccaagaatcagttcagcctgaaactctcttccgtgacagccgctgataccgccgtgtactattgtacacgccctgtcgtgagatactttgggtggttcgacccctggggacaaggcaccctggttacggtgagctctgcgtccaccaaggggcctagcgtctttccgctggctccctgctcccggtctacaagcgaatccaccgccgccctcggatgtctggtgaaggattatttccctgagcccgttacagtgagctggaactctggcgctcttacctccggggtccatacgtttcctgccgtgctgcagagctctggactctacagcctgtcctctgtggtcacagttcccagctccagccttggcaccaaaacatacacatgcaatgtggaccacaagccgtctaacaccaaagtggataagcgcgtcgaatccaaatatggccctccctgtcctccctgccccgctcctgagttcgaagggggaccgagcgtgtttctgtttccccctaagcccaaggacacactcatgatttctagaacgcctgaagttacctgtgtggtcgtggatgtttcccaggaggaccccgaagtgcagttcaattggtacgtcgatggcgtggaggtccataacgccaaaacaaagccgcgggaggaacaattcaatagcacctatcgcgtggtttccgtgctgacagtcctgcaccaggactggctcaacgggaaagagtacaagtgcaaagtgtctaataagggactgcctagctccatcgagaaaaccatctctaaggcgaagggccagcccagagagcctcaggtttatacgcttccccctagccaagaagagatgaccaaaaaccaggtgtccctgacctgtctcgtcaaggggttttaccccagcgatattgccgtggagtgggaatctaatggacagccggagaacaattataaaaccacacctcccgtgctggactccgatggcagcttctttctttactctcggctgaccgttgacaagtcccgctggcaagaaggcaacgtcttcagctgctctgtgatgcatgaggctctccacaatcactacacacagaaaagcctgtccctgagcctcgggaag

SEQ ID NO: 38316 - RNA, 639 nt, synthetic construct
  misc_feature 1..639: note = derived and/or modified sequence opt5 from Bleselumab_LightChain1
  source 1..639: mol_type = other RNA
gccatccagctgacccaaagcccctcctctctcagcgcttccgtgggcgacagagtcacaattacgtgccgggcctctcaggggatcagctccgcgctggcttggtaccagcagaagcctggaaaagccccgaaacttctgatttatgatgcctctaacctcgagagcggcgttccctcccgcttcagcgggtctggatccggcaccgactttacactgaccatcagctctcttcaacctgaagatttcgctacatactattgtcagcagtttaattcctaccccaccttcgggcagggaacaaaggtggagattaagagaaccgtggccgctcctagcgtctttatctttcccccttctgacgaacaactgaaatccggcacggccagcgtggtttgcctcctgaacaatttctatccgcgggaggcgaaggtgcagtggaaggtcgataacgccctgcagtccggcaattctcaggaaagcgtgaccgagcaagactccaaagatagcacatactctctctccagcaccctgacactttctaaggctgactatgagaaacacaaggtttacgcctgtgaagtgacccatcaggggctgagctcccccgtcacgaaatctttcaaccgcggagagtgc

SEQ ID NO: 38317 - RNA, 1512 nt, synthetic construct
  misc_feature 1..1512: note = derived and/or modified sequence opt5 from Blinatumomab_HeavyChain1
  source 1..1512: mol_type = other RNA
gacatccagctgacccaaagccccgcctccctcgctgtgtctctgggccagagagccacaattagctgcaaggcgtcccagtctgtcgattacgacggggatagctatcttaactggtaccagcaaatccctggacagccgcccaaactgctcatttatgacgcttccaatctggtttctggcatccctccccggttcagcgggtccggaagcggcacggattttacccttaacattcaccctgtggagaaggtggacgccgccacataccattgtcagcagtctaccgaagatccctggacattcgggggaggcaccaaactggagatcaagggcgggggaggctccgggggaggcgggagcggaggcggcgggtctcaagtccagctccagcagtccggagctgaactggtgcgccctggcagctctgttaaaatctcctgcaaggccagcgggtatgctttttcctcttactggatgaattgggtgaagcaaagaccgggacagggcctggagtggattgggcagatctggcccggagacggcgatacaaactataatggcaaattcaaggggaaagccaccctcacggcggacgaaagctccagcaccgcctacatgcaactgtcttcccttgctagcgaggattctgccgtctacttttgtgctcggcgcgagacaaccacagtgggaagatattactatgccatggactactggggccaggggaccacggttacagtgagctccggaggcgggggctctgatattaagctgcagcagagcggagcggaactcgcccggcctggcgcttccgtcaaaatgagctgcaagacctctgggtatacattcacccgctacaccatgcactgggtgaagcaaagacccggacagggcctggagtggatcgggtatattaacccttcccggggatacacaaattacaaccagaaatttaaggacaaagccacgcttaccacagacaagtctagctccaccgcttatatgcagctgagctccctcacatctgaagatagcgccgtgtactattgtgcccgctactatgacgatcattactgcctggactattggggccaagggaccacgctgacagtctcctctgttgagggcggaagcggcgggtccggaggcagcgggggatctggcggggtggatgacatccagctcacccagtcccccgctattatgagcgcgtctccgggcgagaaagtgaccatgacatgtagagcctccagctctgtcagctacatgaattggtaccagcaaaagtccggaaccagccctaaacggtggatctatgatacatctaaggtggcttccggcgttccctaccgcttcagcgggtccggatctggcacgagctattccctgaccatctctagcatggaagccgaggacgccgctacatactattgccagcagtggtcctctaaccctcttacctttggggccggaacaaagctggaactcaaacaccatcaccaccatcac

SEQ ID NO: 38318 - RNA, 1512 nt, synthetic construct; identical to SEQ ID NO: 38317
  misc_feature 1..1512: note = derived and/or modified sequence opt5 from Blinatumomab_SingleChain
  source 1..1512: mol_type = other RNA

SEQ ID NO: 38319 - RNA, 1512 nt, synthetic construct; identical to SEQ ID NO: 38317
  misc_feature 1..1512: note = derived and/or modified sequence opt5 from Blinatumumab_SingleChain_variable_fragment_fusion_protein_( bite)
  source 1..1512: mol_type = other RNA

SEQ ID NO: 38320 - RNA, 1344 nt, synthetic construct
  misc_feature 1..1344: note = derived and/or modified sequence opt5 from Blontuvetmab_HeavyChain
  source 1..1344: mol_type = other RNA
caggtgcaactgcagcagagcagagccgagctcgtccggcccggcgcttccgttaccctgtcttgcaagcctagcgggtacacattcacggactatgaagtgcactgggtgaaacagaccccggtccatggacttgagtggatcggcgccattgatcccgaaacagggggaaccgcggacaaccaaaagtttaaaggcaaggctatcctgacagccgataaatcctctagcaccgcctacatggagctccgctccctgacatctgaagacagcgctgtgtattactgtaccaatttcgttgatgtgtgggggacgggaaccacagtcaccgtgtccagcgcctctacaaccgctccttccgtttttccccttgcccctagctgcggctctcagtccggcagcacggtggcgctggcctgtctcgtctctgggtatttccccgagcctgtgacagtgtcctggaacagcggatccctgacctctggcgtccacacatttccgagcgttctgcagtccagcgggctctactctctgtccagcatggtgaccgtgccctctagcagatggccttccgagaccttcacatgcaatgtcgctcatcccgcctctaagacgaaggtggacaaacctgttcccaagcgggaaaacggacgcgtgccgagacctcccgattgtcctaaatgccccgctcccgagatgcttggcgggcctagcgtctttattttcccgcccaagcctaaagacaccctgctcatcgcccggacacccgaagtgacctgtgttgtggtcgatctggaccctgaggatcccgaggtgcagatttcctggtttgtcgacggaaagcaaatgcagacagcgaagacccagccgcgcgaggaacagttcaatggcacgtatagagtggttagcgtgcttcctatcggccaccaagattggctgaaagggaagcagtttacatgcaaagtcaacaataaggccctcccctctcctatcgaacggaccatttccaaagctcgcggacaggcccatcaacccagcgtgtacgttctgcctccctctagagaggaactgtccaagaacaccgtgagcctcacatgtctgatcaaagacttctttccgcctgacattgatgtcgagtggcagtccaatggccagcaggagcccgaatctaagtaccggaccacaccccctcaacttgacgaggatgggagctatttcctgtactccaagctctctgtggacaaaagccgctggcagagaggagatacgttcatctgcgctgtgatgcacgaagccctgcacaaccattatacccagaagtcccttagccactctccgggcaaa

SEQ ID NO: 38321 - RNA, 657 nt, synthetic construct
  misc_feature 1..657: note = derived and/or modified sequence opt5 from Blontuvetmab_LightChain
  source 1..657: mol_type = other RNA
gacgtggtcatgagccagtccccctctagcctggccgtttccgtgggcgagaaggtgaccatgtcttgcaaaagctcccaatctctcctgtacagcgggaaccagaagaattatcttgcttggtaccagcagaaacctggacaatccccgagactgctcatctattgggccagcacacgggaatctggcgtccccgatcgcttcacggggtccggaagcggcaccgactttacactgaccatttcttccgtgaaggcggaggatcttgctgttttctactgtcagcagtattacaactatcctctgacatttgggggaggcacccacctcacagtgctgggccagcccaaagccagcccttctgtcaccctgtttcccccttccagcgaggaactcggggccaataaggctacgctggtgtgccttatctccgacttctacccgtctggagttaccgtggcctggaaggctgatggcagccccattacacaaggggtcgaaaccacaaaaccttccaagcagagcaacaataaatacgccgcgtcttcctatctgagcctcacccccgacaagtggaaatctcatagctccttctcttgtctggtgacgcacgagggaagcacagtggagaagaaggtcgcccctgctgaatgctcc

SEQ ID NO: 38322 - RNA, 1332 nt, synthetic construct
  misc_feature 1..1332: note = derived and/or modified sequence opt5 from Blosozumab_HeavyChain1
  source 1..1332: mol_type = other RNA
caggtgcaactggtccagagcggcgccgaggttaagaaacccggggcttccgtgaaggtgtcttgcaaagtcagcggattccctatcaaggacacctttcagcactgggtgagacaggccccgggcaaagggctcgaatggatgggatggtccgatcccgagattggcgacacagaatacgcgtctaagttccaagggcgggttacgatgaccgaggatacaagcaccgacacagcttatatggaactgtcctctcttcgcagcgaggataccgccgtgtactattgtgccacaggagacaccacgtacaagtttgatttctggggccagggcaccacagtcaccgtgtccagcgcttctacaaaagggccttccgtttttcccctggccccttgcagcagatctacctccgagagcacggctgccctcggatgtctggtgaaggactatttccccgaacctgtcacagtgtcttggaactccggcgcgcttaccagcggggtgcatacatttccggccgtcctgcagtcctctggactctacagcctgtccagcgttgtgaccgtgccctcttccagcctgggcaccaaaacatatacgtgcaatgtcgatcacaagccttctaacaccaaagtggacaagcgggttgagagcaagtacgggcccccttgtcccccgtgccctgctcccgagttcctcggaggcccttccgtgtttctgttccctcccaaacccaaggatacacttatgatctctcgcaccccggaggtcacatgtgtggttgtggacgtcagccaggaggatcccgaagtgcaatttaattggtacgtcgacggcgtggaggttcataacgccaaaaccaagcctagagaagaacagttcaattccacgtatcgggtggtcagcgtgctgacagttctccaccaggactggctgaacgggaaagaatacaagtgcaaagtgtctaataagggacttccctccagcattgagaagaccatctctaaagctaagggccagcctcgcgagccccaagtctataccctgccgccttcccaggaagagatgaccaaaaaccaggtgagcctcacatgtctggtgaaggggttttacccctccgatattgccgttgaatgggagtctaatggacaacctgaaaacaattataaaacaacgccccctgtcctggacagcgatggctccttcttcctctactctagactgaccgtggacaagagccggtggcaggaggggaacgtgttttcctgcagcgtcatgcatgaggcgcttcacaatcactatacacagaagtctctgtccctcagcctggga

SEQ ID NO: 38323 - RNA, 642 nt, synthetic construct
  misc_feature 1..642: note = derived and/or modified sequence opt5 from Blosozumab_LightChain1
  source 1..642: mol_type = other RNA
gacatccagatgacccaaagcccctcctctctgagcgcctccgtgggcgatagagtcacaattacgtgcaaggcttctcaggacgttcacaccgccgtggcgtggtaccagcagaaacctgggaaggctccgaaactcctgatctattgggccagcacacggtggaccggagtgccctcccgcttctctggcagcgggtccggaacagattttacccttacaattagctctctgcaacctgaggacttcgccacctactattgtcagcagtactccgattatccctggacgtttggcgggggaaccaaggtcgaaatcaaaagaacagtggctgcccctagcgttttcatttttcccccttctgacgagcagctcaagtccggcaccgctagcgtggtctgcctgcttaacaatttctacccgcgggaagccaaggtgcaatggaaagttgataacgcgctgcagtctggcaattcccaggagagcgtgacagaacaggactccaaggattctacctatagcctctccagcacgctgacactgtctaaagccgactacgagaagcataaagtctacgcttgtgaggtgacccaccaagggctctccagccccgtgacaaagtcttttaaccgcggagaatgc

SEQ ID NO: 38324 - RNA, 1332 nt, synthetic construct
  misc_feature 1..1332: note = derived and/or modified sequence opt5 from Bococizumab_HeavyChain1
  source 1..1332: mol_type = other RNA
caggtgcaactggtccagagcggcgccgaggttaagaaacccggggcttccgtgaaggtgtcttgcaaagccagcggatacaccttcacatcctattacatgcactgggtcagacaggcgcctggccaggggctcgaatggatgggagagatctctccgtttggcgggcggacgaactataatgaaaagttcaaaagccgcgtgaccatgacaagagacacctccacatctaccgtttacatggagctgagctcccttcggagcgaagatacagctgtgtattactgtgcccgcgagagacccctgtatgcctctgacctctggggacaaggcaccacggtcaccgtgtccagcgcttctacaaagggcccttccgtttttcccctggccccttgcagccggtctacctccgagagcacagctgcccttgggtgtctggtgaaggattacttccccgaacctgtcaccgtgtcctggaactctggagcgctcacgagcggcgtgcatacatttccggccgtcctgcagtccagcgggctgtactctctctccagcgttgtgaccgtgccctctagcaatttcggaacacagacctatacctgcaacgtcgaccacaaaccttccaatacaaaggtggataaaacggttgagcgcaagtgttgcgtggaatgtcccccttgccccgctccgcctgtcgccggcccctctgtgtttctgttccctcccaaacccaaggacacccttatgattagcagaacacctgaggttacctgtgtggtcgtggatgtctcccatgaggacccggaagtgcagtttaactggtacgttgatggggtggaggtccacaatgctaagacaaaaccccgggaggaacaattcaacagcacctttcgcgtggtttctgtgctgacggtcgtgcatcaggactggctcaatggaaaggaatataaatgcaaggtgtccaacaaaggcctgcctagctctatcgagaagacaatttccaaaaccaagggccagcccagagagcctcaggtttacacccttcccccgagccgggaagagatgacaaagaatcaagtctccctgacctgtctcgtgaaagggttctatccttctgatatcgccgtggaatgggagagcaacggacagcccgaaaataactacaagacaacgcctcccatgctggactccgatggcagctttttcctgtattctaaactcaccgtcgacaagtcccgctggcagcaagggaatgtgttcagctgctctgttatgcacgaggcgctgcacaaccattacacacagaaatcccttagcctgtctcctggaaag

SEQ ID NO: 38325 - RNA, 642 nt, synthetic construct
  misc_feature 1..642: note = derived and/or modified sequence opt5 from Bococizumab_LightChain1
  source 1..642: mol_type = other RNA
gacatccagatgacccaaagcccctcctctctgagcgcctccgtgggcgatagagtcacaattacgtgccgggcttctcaggggatcagctccgccctcgcgtggtaccagcagaagcctggaaaagctccgaagctgcttatttattctgccagctaccgctataccggcgttccctccagattcagcgggtctggatccggcacagactttaccttcacaatcagctctctgcaacctgaggatattgccacctactattgtcagcagcggtactccctctggcgcacatttgggcagggaaccaaactggaaatcaagagaacggtggctgcccccagcgtgttcatctttcctccctctgacgagcaacttaaatccggcaccgctagcgtcgtgtgcctgctcaacaatttctatcctcgggaagccaaggttcagtggaaggtggataacgcgctgcagtccggcaattctcaggagagcgtcacagaacaagactccaaagatagcacctactctctgtccagcacactcaccctgtctaaggccgactacgagaaacacaaggtgtatgcttgtgaggttacgcatcaggggcttagctccccggtgacaaaatcttttaaccgcggagaatgc

SEQ ID NO: 38326 - RNA, 1338 nt, synthetic construct
  misc_feature 1..1338: note = derived and/or modified sequence opt5 from Brentuximab_vedotin_HeavyChain1
  source 1..1338: mol_type = other RNA
cagatccaactgcagcagagcggccccgaggtggtcaagcctggggcctccgttaaaatttcttgcaaggctagcggatacaccttcacagactattacatcacgtgggtgaaacagaagccgggccaagggctcgaatggattggatggatctatcccggctccgggaacaccaaatacaatgagaagtttaagggaaaagccacactgaccgtggatacatctagctccaccgcgttcatgcagctttctagcctgacatccgaagacaccgctgtctatttttgtgccaactacggcaattattggttcgcctactggggccaggggacccaggtgacggttagcgctgcctctacaaagggaccttccgtgtttcccctcgctcctagctctaaatccaccagcggcgggacagccgcgctgggatgccttgtcaaggattacttccccgagcctgtgaccgtttcttggaactccggcgccctgacgagcggggtgcacacatttccggctgtcctccaatcctctggactgtatagcctgtccagcgtggtgaccgtcccctcttccagcctcggcacacagacctacatttgtaatgttaaccataaaccttctaataccaaggtggacaagaaagtggaacccaagagctgcgataaaacacacacgtgtcctccctgcccggcccctgagctgcttggcgggccctccgtcttcctgtttcctcccaagcccaaagacaccctcatgatctctagaacacctgaggtgacctgtgttgtggtcgatgtgagccatgaagacccggaggttaagttcaactggtatgtggatggagtcgaagtgcacaatgctaaaacaaagccccgggaggagcagtacaactccacctatcgcgtcgtgagcgttctgacggtgcttcatcaggactggctgaatggcaaggaatacaaatgcaaggtctctaacaaagccctccctgcgcccatcgagaagacaatttccaaagccaaggggcaacctagagaaccccaggtgtataccctgccgcctagccgggatgagctgaccaagaatcaggtttctctcacatgtctggtgaaaggattttacccctccgacatcgctgtcgaatgggagagcaacggccaacctgagaataactacaagaccacaccccctgtgcttgattccgacgggtctttctttctgtatagcaaactcacggtggacaagtcccgctggcagcagggaaacgttttctcttgcagcgtcatgcacgaagccctgcacaatcattacacccagaaatcccttagcctgtctcccggc

SEQ ID NO: 38327 - RNA, 654 nt, synthetic construct
  misc_feature 1..654: note = derived and/or modified sequence opt5 from Brentuximab_vedotin_LightChain1
  source 1..654: mol_type = other RNA
gacatcgtgctgacccagagccccgcctccctcgctgtctctctgggccaaagagccacaattagctgcaaggcgtcccagtctgttgatttcgacggggatagctacatgaactggtatcagcagaaacctggacaaccgcccaaggtgcttatctacgctgcctccaatctggagtctggcattcctgcccggtttagcgggtccggaagcggcacggacttcaccctcaacatccaccccgtggaagaggaagatgctgccacatattactgtcagcagtctaatgaggacccttggacctttgggggaggcacaaaactggaaattaagcgcaccgtcgctgccccctccgtgttcatctttcctccgagcgatgagcagcttaaatctggcacagcgtccgttgtgtgcctgctcaacaatttctatcccagagaggccaaggtccaatggaaggtggacaacgctctgcagagcgggaatagccaggaatccgttaccgagcaggatagcaaagactccacgtactctctgagctccaccctcacactgagcaaggccgattatgaaaaacataaggtgtacgcttgtgaggtcacccaccaaggactttcttcccctgtgacaaaatcttttaaccggggcgagtgc

SEQ ID NO: 38328 - RNA, 1335 nt, synthetic construct
  misc_feature 1..1335: note = derived and/or modified sequence opt5 from Briakinumab_HeavyChain1
  source 1..1335: mol_type = other RNA
caggtgcaactggtcgagagcggcgggggagttgtgcagcccggcagatccctccggctgtcttgcgctgctagcgggttcaccttttcctcttacggaatgcactgggtgcgccaggcccctggcaaggggcttgaatgggtcgcgttcatcagatatgacggaagcaacaaatactatgctgattccgtgaagggccggtttacaatttctcgcgacaatagcaaaaacacgctgtacctccagatgaactccctgagagccgaggataccgccgtttattactgtaagacacatggcagccacgacaattgggggcaaggaaccatggtgacagtctcttccgctagcaccaaaggcccgtctgtgttcccccttgccccttccagcaagtctacatccgggggaaccgctgccctgggctgcctcgttaaggattattttcccgaacctgtgacggtcagctggaactccggggcgctgacctctggagtgcatacattccccgccgtgctgcagagctccggcctctacagcctgtcttccgtcgttaccgtgcctagctctagccttggcacacagacctacatctgtaatgtgaatcacaaaccgtccaacacgaaggtcgacaaaaaggtggagcccaaatcttgcgataagacacatacctgtcctccctgccctgctcccgaactgctcgggggaccgagcgtttttctgttccctcccaagcctaaagacacacttatgatttcccggacccccgaggtgacctgtgtcgtggttgatgtgagccacgaggaccccgaagtcaagtttaattggtatgtggatggcgtcgaggtgcacaacgccaaaacaaagcctcgcgaggaacagtacaattctacgtatagagttgtgtccgtcctgaccgtgctccatcaagactggctgaacgggaaagagtacaagtgcaaagttagcaataaggctctgccggcccccatcgaaaagacaatttctaaagcgaagggacagcctcgggagccccaggtgtataccctccctccctcccgcgaagagatgaccaaaaaccaggtcagcctgacatgtcttgtgaagggcttctacccgtccgatatcgccgtggaatgggagtctaatgggcaacctgagaacaactataaaacgacaccccctgttctggacagcgacggatcctttttcctctactctaagctgaccgtcgataagagcagatggcagcagggcaatgtgttttcctgcagcgtgatgcacgaagcccttcataaccactacacccaaaaatctctgtccctcagccccggcaag

SEQ ID NO: 38329 - RNA, 651 nt, synthetic construct
  misc_feature 1..651: note = derived and/or modified sequence opt5 from Briakinumab_LightChain1
  source 1..651: mol_type = other RNA
cagagcgtgctgacccaacccccttccgtctctggcgccccggggcagagagttacaatcagctgctccggatctcggagcaacattggctccaatacggtgaagtggtaccagcagctccccgggaccgctcctaaactgcttatctattacaacgaccaacgcccctctggagtgcctgatagattcagcggctccaagagcgggacatctgcctccctggcgattaccggactccaggctgaggacgaagccgattattactgtcagagctatgaccggtacacacaccccgccctgctttttggcaccggcacaaaagtcaccgtgctggggcagcctaaggctgccccgtctgttacgctctttcccccttccagcgaggaactgcaagctaataaagccaccctggtgtgcctcatctctgatttctatcccggagcggtcacagtggcctggaaggctgactccagccctgttaaggccggcgtggagaccacaaccccctccaaacagtctaacaataagtacgctgccagctcctacctgagccttacgccggaacagtggaaatctcatcgctcctatagctgtcaggtcacacacgaggggtctaccgtggagaagacagtggcgcctaccgaatgcagc

SEQ ID NO: 38330 - RNA, 1326 nt, synthetic construct
  misc_feature 1..1326: note = derived and/or modified sequence opt5 from Brodalumab_HeavyChain1
  source 1..1326: mol_type = other RNA
caggtgcaactggtccagagcggcgctgaggttaagaaacccggggcttccgtgaaggtgtcttgcaaagccagcggatacaccttcacaagatatggcatctcctgggtccggcaggcgcctgggcagggactcgaatggatgggctggatttctacgtacagcgggaacaccaattatgctcaaaagctgcagggacgcgtgacaatgaccacagacacctccacatctaccgcctacatggagcttagaagcctgcggtccgatgacacggccgtttattactgtgctcgcagacagctctattttgattactggggccagggcaccctggtgacagtcagctctgcctccaccaaagggccgagcgtgttcccccttgctccttgctctcggtccacaagcgaatctaccgccgcgctgggatgtctcgttaaggactactttcccgagcctgtgacggtctcctggaacagcggcgccctgacatccggggtgcacaccttccccgctgtgctgcaatctagcggactctattccctgagctctgtcgttacagtgccttccagcaattttggcacccagacctacacatgcaacgtggatcataagccgtctaatacgaaagtcgacaagaccgtggaacgcaaatgttgcgttgagtgtcccccttgccccgcccctcccgtggctgggccgagcgtcttcctttttcctcccaagcctaaagatacactgatgatctccagaacccccgaggtgacatgtgttgtggtcgacgtgtctcacgaagatcccgaggtccagttcaactggtatgtggacggagttgaagtgcataatgccaagaccaagcctcgggaggagcagtttaacagcacgttccgcgtcgtgtccgttctcacagtggtccaccaagattggctgaatggcaaagaatacaagtgcaaagtgagcaacaagggccttccggcgcccattgagaaaaccatctctaagaccaaagggcagcctagagaaccccaggtgtatacactgcctccctcccgggaggaaatgaccaagaatcaagttagcctcacatgtctggtcaagggattttacccgtctgacattgccgtggagtgggagtccaacggccagcctgaaaataactataaaacgacaccccctatgctggatagcgacgggtccttctttctctactctaagctgaccgtggacaaaagccgctggcagcagggaaatgtcttctcctgctctgtgatgcatgaggcccttcacaaccactacacccaaaagagcctgtccctcagccccggcaaa

SEQ ID NO: 38331 - RNA, 642 nt, synthetic construct
  misc_feature 1..642: note = derived and/or modified sequence opt5 from Brodalumab_LightChain1
  source 1..642: mol_type = other RNA
gagatcgtgatgacccagagccccgccacactgtccgtctctcctggcgaaagagctacgctcagctgccgggcctcccaatctgttagctccaacctggcgtggttccagcagaaaccggggcaggctccccgccctcttatttacgacgcctctaccagagccacaggagtgcccgctcggtttagcggctccgggagcggaaccgatttcacactgaccatctcttccctccaaagcgaggactttgccgtgtattactgtcagcagtatgataattggcctctgacattcggcgggggaaccaaagtcgaaattaagcgcacggtggctgccccctctgtttttatcttccctccgtccgacgagcagcttaaaagcggcaccgcgtctgtggtctgcctgctcaacaatttttaccccagagaagccaaggtgcaatggaaagttgataacgctctgcagtccggcaatagccaggagtccgtgacagagcaggactctaaggatagcacctattccctgagctctacactcaccctgtccaaggccgactacgaaaaacacaaggtctatgcttgtgaggtgacgcatcaagggcttagctctcctgtgacaaagagcttcaaccggggagaatgc

SEQ ID NO: 38332 - RNA, 756 nt, synthetic construct
  misc_feature 1..756: note = derived and/or modified sequence opt5 from Brolucizumab_HeavyChain1
  source 1..756: mol_type = other RNA
atggagatcgtgatgacccagagcccctccacactgtctgccagcgtcggcgacagagttattatcacgtgccaggcttccgaaattatccactcttggctcgcctggtaccaacagaagcctgggaaagcgccgaagctgcttatttatctggctagcaccctcgcctccggagtgccctctcggttcagcggctccgggagcggagccgagtttacactgaccatctcttcccttcagcctgatgacttcgctacatactattgtcaaaacgtgtacctggccagcaccaatggcgctaactttgggcagggaacaaaactcaccgtcctgggcggcgggggaggctctgggggaggcgggtccggaggcggcgggagcggaggcgggggatctgaagtgcagctggttgagtccggcgggggactcgtgcagcccggcggcagcctgcgcctttcctgcacggcctctgggttcagcctgaccgattattactatatgacatgggtcagacaagcgcctggaaagggcctcgaatgggtggggtttatcgaccccgatgacgatccttactacgccacctgggctaaaggacggttcacaatttcccgcgacaatagcaagaacaccctgtatcttcagatgaactctctgagagccgaggatacggctgtttactattgtgccggcggggaccataattccggctggggactcgatatctggggccaggggacactggtgaccgtcagctct

SEQ ID NO: 38333 - RNA, 756 nt, synthetic construct; identical to SEQ ID NO: 38332
  misc_feature 1..756: note = derived and/or modified sequence opt5 from Brolucizumab_scFv_fragment
  source 1..756: mol_type = other RNA

SEQ ID NO: 38334 - RNA, 1341 nt, synthetic construct
  misc_feature 1..1341: note = derived and/or modified sequence opt5 from Brontictuzumab_HeavyChain1
  source 1..1341: mol_type = other RNA
caggtgcaactggtccagagcggcgccgaggttaagaaacccggggcttccgtgaagatctcttgcaaagtgagcggatacaccctcagaggctattggattgaatgggtccggcaggcccctgggaagggactggagtggatcggccagattcttccggggacaggacgcacgaactacaatgaaaaattcaagggcagagtgaccatgacagcggacacctccacagataccgcttatatggagctgtctagcctccggtccgaagacacagccgtttactattgtgcccgctttgatggcaactacgggtattacgctatggactactggggacaaggcaccacggtgaccgtctctagcgcctccacaaaggggcccagcgtgttccctctggctccctgctctagatccaccagcgagtctacagccgcgcttggatgtctggttaaagattattttcctgagcccgtgaccgtctcctggaatagcggcgccctcacgtctggggtgcacacattccctgctgtgctgcagtccagcggactgtactccctctctagcgtcgttaccgtgccgtccagcaactttggcacacagacctatacctgcaatgtggaccataagccctctaacacaaaagtcgataagacggtggaacggaaatgttgcgttgagtgtcctccctgccctgctcccccggtggccggcccttccgtcttcctgtttccccctaagcccaaggacacccttatgatcagccgcacacccgaagtgacctgtgttgtggtcgatgtgtctcacgaggaccctgaggtccagttcaattggtacgtggatggggttgaagtgcataacgccaaaacaaagccgagagaggaacaatttaatagcaccttccgggtcgtgtccgttctgacggtggtccaccaggactggctcaacggaaaagagtataagtgcaaagtgtctaataagggcctgcccgcgcctattgaaaagacaatcagcaagaccaaggggcagccccgcgagcctcaggtgtacacccttcccccgtccagagaggaaatgaccaaaaaccaagttagcctgacatgtctcgtcaagggattttatccttctgatatcgccgtggagtgggaatccaatggccagcccgagaacaattacaaaacaacgcctcccatgctggacagcgacgggtctttctttctgtactccaagctcaccgtggataaaagccggtggcagcaaggaaacgtcttctcctgctctgtgatgcatgaagctctgcacaaccactatacacagaaaagcctttccctgtctcctggcaag

SEQ ID NO: 38335 - RNA, 645 nt, synthetic construct
  misc_feature 1..645: note = derived and/or modified sequence opt5 from Brontictuzumab_LightChain1
  source 1..645: mol_type = other RNA
caggccgtggtcacccaagagcccagcctgacagtttcccctggcgggacggtgaccctcacatgcagatctagcaccggagctgtgacaacctccaactacgccaattggttccagcagaagccgggccaggcgccccggacactgatcgggggaaccaacaatcgcgctcctggcgtccccgccagattttctgggagccttctgggaggcaaagccgctctcacgctgtccggcgcccaacctgaagacgaggctgaatattactgtgccctttggtattctaaccactgggtgttcgggggaggcaccaagctgacagttctcgggcagcccaaagcggcccctagcgtgaccctgtttccgccctccagcgaggaactgcaggctaataaggccacactcgtctgcctggtgtctgatttctaccctggagctgttaccgtggcctggaaagcggacggctcccccgtcaaggtgggggtggagacgacaaagcctagcaaacagtctaacaataagtatgccgcttccagctacctttctctgacccccgagcaatggaaatcccatcggagctattcctgtcgcgtcacacacgaaggatctaccgttgagaagaccgtggccccggctgaatgcagc

SEQ ID NO: 38336 - RNA, 1332 nt, synthetic construct
  misc_feature 1..1332: note = derived and/or modified sequence opt5 from BTT-1023_HeavyChain1
  source 1..1332: mol_type = other RNA
caggtgcaactggtcgagagcggcgggggagttgtgcagcccggcagatccctccggctgtcttgcgccgctagcgggttcacctttttctcctacgccatgcactgggtgcgccagacacctggaaagggccttgaatgggtcgcggtgatctggtttgacgggtctaacgagaattatgttgatagcgtgaaaggaagattcacgatttcccgggacaactctaagaataccctgtacctccagatgaacacactgcgcgctgaagataccgccgtctattactgtgccagagacgcttggagctattttgattactggggccaaggcacacttgtgaccgtttccagcgcctctacaaaagggccgtccgtgttccccctggctccttgcagccggtctacctccgagagcacggccgcgctcggatgtctggtcaaggactattttcccgaacctgtgaccgtgtcttggaactccggcgccctgacaagcggggtccataccttccccgctgttctccagtcctctggactgtacagcctttccagcgtggtgacagtcccttcttccagcctgggcaccaaaacgtacacatgcaatgtggatcacaagccgtctaataccaaggttgacaaacgcgtggagagcaagtatgggcccccttgtcccccttgccccgccccggagtttgctggaggcccttccgtcttcctctttccccctaaacccaaggatacactgatgatctctagaacccccgaagtgacctgtgttgtggtcgacgtgagccaggaggatcctgaagtccagttcaactggtacgtggacggcgttgaggtgcataatgccaaaacaaagccgcgggaggaacaatttaactccacgtatcgcgtcgtgagcgttcttaccgtgctgcaccaggattggctcaatgggaaggagtacaaatgcaaggtctctaacaaaggactgccctccagcattgaaaagacaatctctaaagcgaagggccagcctagagagccccaggtgtataccctgcctccctcccaagaagagatgaccaaaaatcaggtgagcctcacatgtctggttaaggggttctacccgtccgacattgccgtcgagtgggaatctaacggacagcctgagaataactataagacgacaccccctgtgcttgacagcgatggctccttctttctgtactctcggctcaccgtggacaaaagccgctggcaagaagggaacgtcttctcctgcagcgtgatgcatgaggctctgcacaatcactacacccagaagtctctttccctgagcctcggaaaa

SEQ ID NO: 38337 - RNA, 642 nt, synthetic construct
  misc_feature 1..642: note = derived and/or modified sequence opt5 from BTT-1023_LightChain1
  source 1..642: mol_type = other RNA
gtgatccagctgacccaaagcccctcctctctcagcgcctccgtcggcgacagagttacaattacgtgccgggcttctcaggggatcagccgcgccctggcgtggtaccagcagaagcctggaaaaggcccgaaacttctgatttatgatgcttcctctctcgagagcggggtgccctccagattcagcggatctggctccgggaccgactttacactgaccatcagctctcttcaacctgaagatttcgccacatactattgtcagcagtttaactcctaccccctgaccttcggaggcggcacaaaggtggagattaagcggaccgtcgccgctcctagcgtgtttatctttcccccttctgacgaacagctcaaatccgggacggccagcgttgtgtgcctgctgaataacttctatccgcgcgaggctaaggtccaatggaaggtggataatgccctccagtccggaaactctcaggaaagcgttaccgagcaggactccaaagatagcacatactctctgtccagcacccttacactgtctaaggcggactatgagaaacacaaggtgtacgcctgtgaagtcacccatcaaggcctcagctcccccgtgacgaaatctttcaatagaggggagtgc

SEQ ID NO: 38338 - RNA, 1341 nt, synthetic construct
  misc_feature 1..1341: note = derived and/or modified sequence opt5 from Burosumab_HeavyChain1
  source 1..1341: mol_type = other RNA
caggtgcaactggtccagagcggcgccgaggttaagaaacccggggcttccgtgaaggtgtcttgcaaagccagcggatacaccttcacaaaccactatatgcattgggtcagacaggcgcctggccaggggctcgaatggatgggaatcattaatccgatctccggctctacgagcaacgctcaaaagtttcaggggcgggtgaccatgacacgcgacacctccacatctaccgtttacatggagctgagctcccttagaagcgaagatacagccgtgtattactgtgcccgggacattgtcgatgctttcgacttttggggacagggcaccatggtgacggtttcttccgccagcaccaaaggcccctctgtgttccctctggctccctccagcaagtctacatccgggggaaccgccgcgctcggctgcctggtcaaggattattttcctgagcccgtgacagtgagctggaactccggggcccttacctctggagtccacacgttccctgctgttctgcagagctccggcctctacagcctgtcttccgtggtgacagtcccgagctctagcctggggacccaaacatatatctgtaatgtgaatcataaaccctccaacaccaaggttgacaaaaaggtggaacctaaatcttgcgataagacccacacatgtcccccttgccccgccccggagctcctgggaggccctagcgtctttctttttccccctaagcccaaagacacgctgatgatttcccgcacccccgaggtgacatgtgttgtggtcgatgtgagccatgaagaccctgaggtcaagttcaattggtacgtggatggcgttgaagtgcacaacgctaaaaccaagccgagagaggagcagtacaattctacatatcgggtcgtgtccgttctcaccgtgctgcaccaggactggcttaacgggaaagaatacaagtgcaaagtcagcaataaggccctgcccgcgcctatcgagaagacgatctctaaagccaagggacagccccgcgaacctcaagtgtatacactgcccccgtccagagatgagctcaccaaaaaccaggtgagcctgacctgtctcgttaagggcttctacccttccgacattgctgtcgaatgggagtctaatgggcagcccgagaacaattataaaacaacccctcccgtgctggacagcgatggatcctttttcctttactctaagctgacagtggacaagagccggtggcaacagggcaacgtcttttcctgcagcgtgatgcatgaagccctccacaaccattatacgcagaaatctctgtcccttagccctgggaag

SEQ ID NO: 38339 - RNA, 639 nt, synthetic construct
  misc_feature 1..639: note = derived and/or modified sequence opt5 from Burosumab_LightChain1
  source 1..639: mol_type = other RNA
gccatccagctgacccaaagcccctcctctctcagcgcttccgtgggcgacagagtcacaattacgtgccgggcctctcaggggatcagctccgcgctggtttggtaccagcagaagcctggaaaagctccgaaacttctgatttatgatgcctctagcctcgagtccggcgtgcccagccgcttctctgggtccggaagcggcaccgactttacactgaccatctcttcccttcaacctgaagatttcgccacatactattgtcagcagtttaacgactacttcacctttgggcccggaacaaaggtggatattaagagaaccgtcgctgcccctagcgtgttcatctttcccccttctgacgagcagctgaaatccggcacggctagcgttgtgtgcctcctgaataacttctatccgcgggaagccaaggtccaatggaaggtggataatgcgctgcagtccggcaactctcaggagagcgttaccgaacaggactccaaagatagcacatactctctctccagcaccctgacactttctaaggccgactatgagaaacacaaggtgtacgcttgtgaggtcacccatcaagggctgagctcccccgtgacgaaatcttttaatcgcggagaatgc

SEQ ID NO: 38340 - RNA, 1344 nt, synthetic construct
  misc_feature 1..1344: note = derived and/or modified sequence opt5 from Canakinumab_HeavyChain1
  source 1..1344: mol_type = other RNA
caggtgcaactggtcgagagcggcgggggagttgtgcagcccggcagatccctccggctgtcttgcgccgctagcgggttcaccttttccgtgtacggaatgaactgggtccgccaggcccctggcaaggggcttgaatgggtggcgatcatttggtatgacggagataatcagtactatgctgactctgttaaaggcagattcacaatcagccgggataactccaagaatacgctgtacctccaaatgaacggcctgcgcgccgaggacaccgccgtgtattactgtgctagagatcttcggacagggccgtttgactattggggacagggcaccctggtcacagtgtctagcgcctccaccaaagggcccagcgttttccctctcgctccctcttccaagagcacatctggaggcaccgccgcgctggggtgcctggtgaaagattactttcctgaacccgtcacggtgtcctggaatagcggagccctcacctctggcgtgcacacattccctgctgtcctgcagtccagcggcctttactccctgtctagcgttgtgaccgtgccgtccagctctctcgggacacagacctatatttgtaacgtcaatcataagccctccaacacgaaggtggacaaacgcgttgagcctaagagctgcgataaaacacacacctgtcccccttgccccgccccggaactgcttggaggcccttctgtgtttctgtttccccctaagcccaaagacacactcatgatcagcagaacccccgaggtcacctgtgtggttgtggatgtctcccatgaggaccctgaagtgaagttcaattggtacgtcgatggggtggaggttcacaacgctaagacaaaaccgcgggaggaacaatataattctacgtaccgcgtggtcagcgtgctgaccgttctgcatcaggactggctcaacggaaaggagtataaatgcaaggtgtccaataaagccctgcccgcgcctattgaaaagacaatcagcaaagccaagggccagcccagagagcctcaggtctacacccttcccccgtctcgggaagagatgacaaagaaccaagtgtccctgacctgtctcgtgaaagggttctatcctagcgacatcgctgttgaatgggagtctaatggacagcccgagaacaactacaagacgacacctcccgtcctggattccgacggcagctttttcctttactccaaactgaccgtggataagtctcgctggcagcaaggcaatgtgtttagctgctccgtcatgcacgaagccctccacaaccattatacccagaaatctctgagcctgtcccctgggaag

SEQ ID NO: 38341 - RNA, 1344 nt, synthetic construct; identical to SEQ ID NO: 38340
  misc_feature 1..1344: note = derived and/or modified sequence opt5 from Canakinumab_HeavyChain
  source 1..1344: mol_type = other RNA

SEQ ID NO: 38342 - RNA, 642 nt, synthetic construct
  misc_feature 1..642: note = derived and/or modified sequence opt5 from Canakinumab_LightChain1
  source 1..642: mol_type = other RNA
gagatcgtgctgacgcagagccccgacttccaatccgtcacacctaaggaaaaagttacgattacctgcagagcctctcagagcatcggctcctctctccactggtaccagcagaagccggatcaaagccccaaactgcttattaagtatgcttcccagtcttttagcggggtgccttcccggttcagcggatctggctccgggacagactttaccctgacaatcaacagcctcgaggccgaagatgcggctgcctactattgtcatcagtcttccagcctgcccttcacctttggacctggcacaaaagtggacattaagcgcaccgtcgccgctccctctgtgttcatctttcctccgtccgatgagcagcttaagagcgggacggcctccgttgtgtgcctgctcaataacttctaccccagagaagctaaagtccaatggaaggtggacaatgccctgcagtctggaaacagccaggagtccgttaccgagcaggatagcaaagactctacatattccctgagctctaccctcacactgagcaaggcggattacgaaaaacacaaggtgtatgcctgtgaggtcacccatcaaggcctttcctctcctgtgaccaagagctttaatcggggcgaatgc

SEQ ID NO: 38343 - RNA, 642 nt, synthetic construct; identical to SEQ ID NO: 38342
  misc_feature 1..642: note = derived and/or modified sequence opt5 from Canakinumab_LightChain
  source 1..642: mol_type = other RNA

SEQ ID NO: 38344 - RNA, 1182 nt, synthetic construct
  misc_feature 1..1182: note = derived and/or modified sequence opt5 from Canakinumab_LightChain_variant_8836_L
  source 1..1182: mol_type = other RNA
caggtgcaactggtcgagagcggcgggggagttgtgcagcccggcagatccctccggctgtcttgcgccgctagcgggttcaccttttccgtgtacggaatgaactgggtccgccaggcccctggcaaggggcttgaatgggtggcgatcatttggtatgacggagataatcagtactatgctgactctgttaaaggcagattcacaatcagccgggataactccaagaatacgctgtacctccaaatgaacggcctgcgcgccgaggacaccgccgtgtattactgtgctagagatcttcggacagggccgtttgactattggggacagggcaccctggtcacagtgtctagcgcctccaccaaagggcccagcgttttccctctcgctccctcttccaagagcacatctggaggcaccgccgcgctggggtgcctggtgaaagattactttcctgaacccgtcacggtgtcctggaatagcggagccctcacctctggcgtgcacacattccctgctgtcctgcagtccagcggccttgagattgttctgacccagtccccggactttcaatctgtgacacccaaggaaaaggtgaccatcacgtgtcgcgccagccagtccattgggagctctctccattggtaccagcagaaacctgatcaatcccccaagctgcttatcaaatatgctagccagtctttcagcggagtcccttccagattttctggcagcgggtccggaacagacttcaccctgacaatcaacagcctcgaggccgaggatgcggccgcttactattgccaccagtcttccagcctgccctttaccttcggcccggggaccaaggtggacattaaacggacagttgccgctccttctgtgtttatctttcccccttccgatgaacaacttaagagcggaacggcctccgtcgtgtgtctcctgaataacttctacccccgcgaggccaaggttcagtggaaagtggacaatgctctgcagtctggcaacagccaggaatccgtcaccgagcaagactctaaggatagcacatattccctgagctctaccctcacactgtccaaagcggactacgagaagcataaagtgtatgcctgcgaagtcacccaccagggccttagctctcccgtgacgaagtccttcaatagaggggagtgt

SEQ ID NO: 38345 - RNA, 1197 nt, synthetic construct
  misc_feature 1..1197: note = derived and/or modified sequence opt5 from Cantuzumab_HeavyChain1
  source 1..1197: mol_type = other RNA
atcgacaccacaacgggcgagcccacctacgcccagaagttccaagggagaattgcttttagcctggaaacatccgcctctaccgcgtatctccagatcaaaagcctgaagtccgaggatacagctacctacttctgcgcccggcgcggaccttataactggtactttgacgtgtggggccaggggacaaccgtcacggtttctagcgcctccaccaaaggaccgtctgtgttcccccttgctcctagctccaagagcacatctggcgggaccgccgctctgggatgtctcgtgaaagattattttcccgaacctgtcacagtgtcctggaatagcggcgccctgacctctggcgttcacacgttccccgcggtgcttcagtccagcgggctgtactctctctccagcgtcgtgacagttccttcctctagcctgggaacccaaacatatatttgcaacgtgaatcataagccgtccaacaccaaggtcgacaaaaaggtggagcccaaaagctgtgataagacccacacatgccctccctgtcctgcccccgaactgctcggcgggccgtctgtgtttctgttccctcccaaacctaaggacacgcttatgatctccagaacccccgaggtcacatgcgttgtggtggatgtcagccatgaggaccccgaagtgaagtttaattggtacgttgatggagtggaggtccacaacgctaaaaccaagcctcgggaggaacagtacaattctacatatcgcgtggttagcgtgctgaccgtcctccatcaggactggctgaacggcaaagagtacaagtgtaaagtgtccaataaggcccttccggctcccattgaaaagacgatctctaaggccaaggggcagcctagagagccccaagtctatacactgcctcccagccgggatgaactcaccaaaaaccaggtgtccctgacctgcctggttaagggattctacccgagcgacatcgcggtggagtgggaatctaatggccagcctgagaacaattataaaacaacaccccctgtcctcgattccgacggcagctttttcctgtactctaaacttaccgtggacaaatcccgctggcagcaagggaacgtttttagctgttccgtgatgcacgaggccctgcacaatcattatacgcagaagtctctcagcctgtcccccggaaag

SEQ ID NO: 38346 - RNA, 1347 nt, synthetic construct
  misc_feature 1..1347: note = derived and/or modified sequence opt5 from Cantuzumab_HeavyChain
  source 1..1347: mol_type = other RNA
caggtgcaactggtccagagcggcgccgaggttaagaaacccggggaaaccgtgaagatctcctgcaaggcttctgactacacattcacgtattacggaatgaactgggtgaaacaggcccctggccaggggctcaaatggatgggatggattgataccacaaccggcgagccgacatatgcgcaaaagtttcaggggagaatcgctttcagcctggaaacctccgcctctacagcctaccttcagattaagagcctgaaatccgaggacaccgctacgtatttttgtgcccggcgcggaccctacaattggtatttcgatgtctggggccagggcaccacagtgaccgtttctagcgcttccacaaaggggcctagcgtgtttcccctcgccccttcttccaaaagcacctctggaggcacggcggccctggggtgccttgtcaaggactacttccccgaacctgtgacagtttcctggaacagcggagctctgacctctggcgtgcacacatttccggccgtcctccaatccagcgggctgtactccctgtctagcgtggtgaccgtcccctccagctctctcggaacccagacatatatctgtaatgttaaccataaaccttccaatacgaaggtggataagaaagtggagcccaagagctgcgacaaaacccacacatgtcctccctgcccggctcctgagctgcttggcggcccctctgtcttcctgtttcctcccaagcccaaagataccctcatgattagcagaacacctgaagtgacctgtgttgtggtcgacgtgtcccatgaggatccggaagttaagttcaactggtacgtggacggggtcgaggtgcacaatgccaaaacgaagccccgggaggaacagtataactctacataccgcgtcgtgagcgttctgaccgtgcttcatcaggattggctgaatggaaaggagtataaatgcaaggtctccaacaaagcgctccctgcccccatcgaaaagaccatcagcaaagctaagggccaacctagagagccccaggtgtacacactgccgccttctcgggacgaactgaccaagaatcaggtttccctcacatgtctggtgaaagggttttatcccagcgatattgccgtcgagtgggagtctaacggacaacctgaaaataactacaagacgacaccccctgtgcttgactccgacggcagcttctttctgtactccaaactcaccgtggataagtctcgctggcagcaggggaatgttttcagctgctccgtcatgcacgaggctctgcacaaccattatacccagaaatctcttagcctgtcccccggaaag

SEQ ID NO: 38347 - RNA, 657 nt, synthetic construct
  misc_feature 1..657: note = derived and/or modified sequence opt5 from Cantuzumab_LightChain1
  source 1..657: mol_type = other RNA
gacatcgtgatgacccagagccccctgtccgtccctgttacaccgggcgagcccgtgtctattagctgcagatcctctaaaagcctcctgcactccaacgggaatacgtacctttattggttcctgcaacggcctggacagtctccccagctcctgatctaccgcatgagcaaccttgtgtccggcgtccctgatagatttagcgggtctggatccggcaccgccttcacactgcggattagccgcgtggaagctgaggacgttggggtgtattactgtctccagcatctggaatatccctttaccttcggacctggcacaaaactggagctcaagagaaccgtcgccgcgccgtctgtgtttatctttcccccttccgatgaacaactgaaaagcggcacagcttctgttgtgtgccttctgaataacttctacccccgggaggccaaggtccagtggaaagtggacaatgccctccagtccgggaacagccaggagtccgtgaccgaacaagattctaaggacagcacgtattccctgagctctacccttacactgtccaaggctgattacgagaaacacaaggtctacgcctgtgaagttacccatcagggactcagctctcctgtgacaaagagcttcaatcgcggcgagtgc

SEQ ID NO: 38348 - RNA, 1344 nt, synthetic construct
  misc_feature 1..1344: note = derived and/or modified sequence opt5 from Cantuzumab_mertansine_HeavyChain1
  source 1..1344: mol_type = other RNA
gtgcagctggtccaaagcggcgccgaggttaagaaacccggggaaaccgtgaagatctcctgcaaggcttctgactacacattcacgtattacggaatgaactgggtgaaacaggcccctggccaggggctcaaatggatgggatggattgataccacaaccggcgagccgacatatgcgcagaagtttcaagggagaatcgctttcagcctggaaacctccgcctctacagcctaccttcagattaagagcctgaaatccgaggacaccgctacgtatttttgtgcccggcgcggaccctacaattggtatttcgatgtctggggccagggcaccacagtgaccgtttctagcgcttccacaaaggggcctagcgtgtttcccctcgccccttcttccaaaagcacctctggaggcacggcggccctggggtgccttgtcaaggactacttccccgaacctgtgacagtttcctggaacagcggagctctgacctctggcgtgcacacatttccggccgtcctccagtccagcgggctgtactccctgtctagcgtggtgaccgtcccctccagctctctcggaacccaaacatatatctgtaatgttaaccataaaccttccaatacgaaggtggataagaaagtggagcccaagagctgcgacaaaacccacacatgtcctccctgcccggctcctgagctgcttggcggcccctctgtcttcctgtttcctcccaagcccaaagataccctcatgattagcagaacacctgaagtgacctgtgttgtggtcgacgtgtcccatgaggatccggaagttaagttcaactggtacgtggacggggtcgaggtgcacaatgccaaaacgaagccccgggaggaacagtataactctacataccgcgtcgtgagcgttctgaccgtgcttcatcaggattggctgaatggaaaggagtataaatgcaaggtctccaacaaagcgctccctgcccccatcgaaaagaccatcagcaaagctaagggccagcctagagagccccaagtgtacacactgccgccttctcgggacgaactgaccaagaatcaggtttccctcacatgtctggtgaaagggttttatcccagcgatattgccgtcgagtgggagtctaacggacagcctgaaaataactacaagacgacaccccctgtgcttgactccgacggcagcttctttctgtactccaaactcaccgtggataagtctcgctggcaacaggggaatgttttcagctgctccgtcatgcacgaggctctgcacaaccattatacccagaaatctcttagcctgtcccccggaaag

SEQ ID NO: 38349 - RNA, 657 nt, synthetic construct; identical to SEQ ID NO: 38347
  misc_feature 1..657: note = derived and/or modified sequence opt5 from Cantuzumab_mertansine_LightChain1
  source 1..657: mol_type = other RNA

SEQ ID NO: 38350 - RNA, 1347 nt, synthetic construct; identical to SEQ ID NO: 38346
  misc_feature 1..1347: note = derived and/or modified sequence opt5 from Cantuzumab_ravtansine_HeavyChain1
  source 1..1347: mol_type = other RNA

SEQ ID NO: 38351 - RNA, 657 nt, synthetic construct; identical to SEQ ID NO: 38347
  misc_feature 1..657: note = derived and/or modified sequence opt5 from Cantuzumab_ravtansine_LightChain1
  source 1..657: mol_type = other RNA

SEQ ID NO: 38352 - RNA, 777 nt, synthetic construct
  misc_feature 1..777: note = derived and/or modified sequence opt5 from Caplacizumab
  source 1..777: mol_type = other RNA
gaggtgcagctggtcgaaagcggcgggggactcgttcaacccggcgggtccctgagactttcttgcgccgctagcggacggaccttctcctacaatcctatgggctggtttcgccaggccccggggaagggaagagagctggtggcggctatctctcggacaggcggcagcacgtattaccccgactccgtggaagggcgcttcaccatttctagagataatgccaaacggatggtctatctccagatgaacagcctgcgcgccgaggacacagctgtgtactattgtgccgctgccggagttagagcggaagatggccgggtgcgcacccttccttccgagtacacattttgggggcagggaacccaagtcacagtgagctctgccgctgccgaggttcagctggtggaatccggcgggggactcgtccagcccggcggcagcctgagactgtcttgcgctgcctccgggcggaccttcagctataatcctatgggatggtttcgccaggcgcccggcaaggggagagagctcgtggccgctatctctcggacgggaggctccacctactaccctgacagcgtggaagggcgcttcacaatttccagagataacgccaaacggatggtctatctgcaaatgaactctcttagagctgaggacaccgccgtttactattgtgccgctgcgggagtgcgcgccgaggatggccgggtgagaacactgccgagcgaatacaccttttggggccaggggacgcaggtcacagtgtccagc

SEQ ID NO: 38353 - RNA, 777 nt, synthetic construct; identical to SEQ ID NO: 38352
  misc_feature 1..777: note = derived and/or modified sequence opt5 from Caplacizumab_HeavyChain1
  source 1..777: mol_type = other RNA

SEQ ID NO: 38354 - RNA, 777 nt, synthetic construct; identical to SEQ ID NO: 38352
  misc_feature 1..777: note = derived and/or modified sequence opt5 from Caplacizumab_HeavyChain1
  source 1..777: mol_type = other RNA

SEQ ID NO: 38355 - RNA, 1347 nt, synthetic construct
  misc_feature 1..1347: note = derived and/or modified sequence opt5 from Carlumab_HeavyChain1
  source 1..1347: mol_type = other RNA
caggtgcaactggtccagagcggcgctgaggttaagaaacccgggtcctctgtgaaggtgagctgcaaggcttccggaggcaccttctctagctacgggatctcctgggtcagacaggcccctggacagggcctcgaatggatgggagggattatcccgatttttggcacagcgaactatgctcaaaaattccagggccgggtgacgatcaccgccgacgagtctacaagcaccgcctacatggaactgtccagccttcgctctgaggatacagctgtttattactgtgccagatatgacgggatttacggagaactggatttttggggccaggggaccctcgtgacagtctccagcgcttctaccaaaggaccctccgtgttccctctggcccccagctctaagtccacgagcggcgggaccgcggcccttggatgcctggttaaggactattttcctgagcccgtgacagtctcctggaactctggcgctctcaccagcggcgtgcacacattccctgccgtgctgcagtccagcgggctgtactctctctccagcgtcgttaccgtgccgtctagctccctgggaacgcaaacatacatctgtaatgtgaatcataaaccctctaacaccaaggtcgataaaaaggtggagcctaaaagctgcgacaagacacacacctgtcccccttgccccgctccggaacttctgggcgggccttccgtttttctctttccccctaagcccaaagataccctgatgatcagccggacacccgaggtgacgtgtgtcgtggttgacgtgtctcatgaagatcctgaggtcaagtttaattggtatgtggacggagtcgaggtgcacaacgccaaaaccaagccgcgcgaggaacagtacaattccacatatagagttgtgagcgtccttaccgtgctgcatcaggattggctcaacggcaaagaatacaagtgcaaagtttctaataaggcgctgcccgcccctattgagaagacaatctccaaagctaaggggcagccccgggaacctcaagtgtataccctgcccccgagccgcgacgagctcacgaaaaaccaggtctccctgacatgtcttgtgaagggattctacccttctgatattgccgtggagtgggaaagcaatggccagcccgagaacaattataaaaccacccctcccgttctggactccgacggctctttcttcctctacagcaagctgacagtcgataagtccagatggcaacaggggaacgtgtttagctgctctgtgatgcacgaagcccttcacaatcattacacccagaaatccctgagcctctctcctggaaag

SEQ ID NO: 38356 - RNA, 648 nt, synthetic construct
  misc_feature 1..648: note = derived and/or modified sequence opt5 from Carlumab_LightChain1
  source 1..648: mol_type = other RNA
gagatcgtgctgacccagagccccgccacactcagcctgtctcctggcgaacgggctacgcttagctgccgggcctcccaatctgtcagcgacgcgtacctggcttggtatcagcagaagccggggcaggctccccgcctcctgatttacgatgcctcctctagagccaccggagttcctgcccggttcagcggctccgggagcggaacagactttacccttacaatctcttccctggagcccgaagatttcgctgtgtattactgtcaccaatatattcagctccatagctttaccttcggccaggggacaaaagtggagatcaagcgcaccgtcgccgcgccttctgtgtttatttttcccccttccgacgaacagctgaaaagcggaacggcctctgttgtgtgcctgctcaacaatttctacccgagagaggctaaggtccaatggaaagtggataacgccctgcagtccggcaatagccaggagtccgttaccgaacaggactctaaggatagcacatattcccttagctctaccctgacactctccaaggctgactacgagaaacacaaggtgtacgcctgtgaagtcacccatcaaggcctgagctctcccgtgacgaaatccttcaacagaggggagtgc

SEQ ID NO: 38357 - RNA, 1353 nt, synthetic construct
  misc_feature 1..1353: note = derived and/or modified sequence opt5 from Cergutuzumab_amunaleukin_HeavyChain1
  source 1..1353: mol_type = other RNA
caggtgcaactggtccagagcggcgccgaggttaagaaacccggggcttccgtgaaggtgtcttgcaaagccagcggatacaccttcacagaatttggcatgaactgggtcagacaggcgcctgggcagggactcgagtggatgggctggatcaatacgaagaccggggaagctacatatgtggaggagttcaaaggacgggttacctttacaaccgacacatccacctctacggcctacatggagctgcgcagccttagatccgatgacaccgccgtgtattactgtgctcggtgggatttcgcctattacgtcgaggctatggactattggggccaaggcacaaccgtgacagtttctagcgcctccaccaaggggccgagcgtgtttcccctggcgccttcttccaagagcacgtctggaggcacagccgctctcgggtgcctggtcaaagattacttccccgaacctgtgaccgtgtcctggaacagcggagcccttacatctggcgtccacacctttcccgctgttctgcagtccagcgggctctactccctgtctagcgtggtgaccgtcccttccagctctctgggaacacagacgtatatttgtaatgtgaaccataagccgtccaataccaaagttgacaagaaagtggagcccaagagctgcgataagacacacacctgtcctccctgccctgcccccgaagcggccggcggcccgtctgtcttcctctttcctcccaaacctaaggacacactgatgatcagccgcacccccgaggtgacgtgtgttgtggtcgatgtgtcccatgaggaccccgaagtcaaattcaactggtacgtggatggggttgaggtgcacaatgctaagacaaaacctagagaagaacagtataactctacctaccgggtcgtgagcgttcttaccgtgctgcatcaagactggctcaatggaaaggaatataaatgcaaggtctccaacaaggccctgggcgctccgattgagaaaacaatcagcaaggccaaagggcagccccgcgagcctcaggtgtgtacccttcccccttctagagatgaactgacaaagaatcaggtgtccctcagctgcgccgttaaaggattttacccctctgacattgctgtcgagtgggaatccaacggccaaccggagaataactataagacgacccctcccgtgctggacagcgatgggtccttctttctggtgtctaagctcacagtcgacaaaagccggtggcagcagggaaatgtgttctcctgttctgttatgcacgaagcgctgcacaaccattacacccaaaagagcctttccctgagccctggcaaa

SEQ ID NO: 38358 - RNA, 1794 nt, synthetic construct
  misc_feature 1..1794: note = derived and/or modified sequence opt5 from Cergutuzumab_amunaleukin_HeavyChain2
  source 1..1794: mol_type = other RNA
caggtgcaactggtccagagcggcgccgaggttaagaaacccggggcttccgtgaaggtgtcttgcaaagccagcggatacaccttcacagaatttggcatgaactgggtcagacaggcgcctgggcagggactcgagtggatgggctggatcaatacgaagaccggggaagctacatatgtggaggagttcaaaggacgggttacctttacaaccgacacatccacctctacggcctacatggagctgcgcagccttagatccgatgacaccgccgtgtattactgtgctcggtgggatttcgcctattacgtcgaggctatggactattggggccaaggcacaaccgtgacagtttctagcgcctccaccaaggggccgagcgtgtttcccctggcgccttcttccaagagcacgtctggaggcacagccgctctcgggtgcctggtcaaagattacttccccgaacctgtgaccgtgtcctggaacagcggagcccttacatctggcgtccacacctttcccgctgttctgcagtccagcgggctctactccctgtctagcgtggtgaccgtcccttccagctctctgggaacacagacgtatatttgtaatgtgaaccataagccgtccaataccaaagttgacaagaaagtggagcccaagagctgcgataagacacacacctgtcctccctgccctgcccccgaagcggccggcggcccgtctgtcttcctctttcctcccaaacctaaggacacactgatgatcagccgcacccccgaggtgacgtgtgttgtggtcgatgtgtcccatgaggaccccgaagtcaaattcaactggtacgtggatggggttgaggtgcacaatgctaagacaaaacctagagaagaacagtataactctacctaccgggtcgtgagcgttcttaccgtgctgcatcaagactggctcaatggaaaggaatataaatgcaaggtctccaacaaggccctgggcgctccgattgagaaaacaatcagcaaggccaaagggcagccccgcgagcctcaggtgtacacccttcccccttgtagagatgaactgacaaagaatcaggtgtctctctggtgcctggttaaaggattttatccctccgacattgccgtcgagtgggaaagcaacggccaaccggagaataactacaagacgacccctcccgtgctggactctgatgggtccttctttctctacagcaagctgacagtggacaaatcccggtggcagcagggaaatgtcttctcttgtagcgtgatgcacgaagctctgcacaaccattatacccaaaagtccctgtctctcagccctggcggcgggggaggctccgggggaggcgggagcggcggaggcgggtctgcgcccgcctccagctctaccaaaaagacacagctgcagcttgagcaccttctcctggatctgcagatgatcctcaacggaatcaataactacaaaaatcctaagctgacgcgcatgcttaccgctaagttcgccatgcccaaaaaggccacagagctgaaacatctccaatgcctggaagaggaacttaagccgctggaggaagttctcaacggcgctcagtccaaaaattttcacctgagacctcgggacctgattagcaacatcaatgtgattgtcctcgagctgaaggggtctgagaccacattcatgtgcgaatatgccgatgagaccgcgacgatcgtggaatttcttaaccgctggattacattcgctcagagcatcatttccaccctgaca

SEQ ID NO: 38359 - RNA, 645 nt, synthetic construct
  misc_feature 1..645: note = derived and/or modified sequence opt5 from Cergutuzumab_amunaleukin_LightChain1
  source 1..645: mol_type = other RNA
gacatccagatgacccaaagcccctcctctctgagcgcctccgtgggcgatagagtcacaattacgtgcaaggcttctgccgcggttgggacctacgtggcttggtatcagcagaaacctggaaaggccccgaaactcctgatctacagcgcctcctatcggaagcgcggcgtgccctctagattcagcgggtccggaagcggcacagactttacccttacaatttcttccctgcagcctgaggatttcgctacctactattgtcaccaatactatacataccccctctttaccttcgggcagggaacgaaactggaaatcaagcggaccgtcgccgctcctagcgtgtttatttttcccccttctgacgagcagcttaagtccggcacagccagcgttgtgtgcctgctcaacaatttctacccgcgcgaagcgaaagtccagtggaaggtggataacgccctgcaatctggcaattcccaggagagcgttaccgaacaggactccaaagattctacatatagcctgtccagcaccctcacgctgtctaaggctgactacgagaaacataaggtgtatgcctgtgaggtcacacaccaggggctttccagccccgtgaccaagtctttcaacagaggagaatgc

SEQ ID NO: 38360 - RNA, 687 nt, synthetic construct
  misc_feature 1..687: note = derived and/or modified sequence opt5 from Certolizumab_pegol_HeavyChain1
  source 1..687: mol_type = other RNA
gaggtgcagctggtcgaaagcggcgggggactcgttcaacccggcgggtccctgagactttcttgcgccgctagcggatacgtgttcaccgactatggcatgaactgggtgcggcaggcccctgggaagggactggagtggatgggctggatcaatacatacattggcgaaccgatctatgcggattccgtcaaagggcgctttacgttctctctcgacaccagcaagtccacagcttacctgcagatgaactctcttagagccgaggataccgccgtgtattactgtgctcggggatatcgcagctacgccatggactactggggccaggggacactggttaccgtgtccagcgcttctacaaaaggaccctccgtctttcctctcgcccccagctctaagtccaccagcggcgggacggcggccctgggatgcctggtgaaagattatttccctgaacccgttaccgtgtcttggaactccggcgctctcacaagcggcgtccacacctttcctgccgtgctgcaatcctctgggctttacagcctgtccagcgtggtcacagttccgtcttccagcctcggaacccagacgtatatttgtaatgtgaatcataagccctctaacacaaaggtggacaaaaaggtcgagcctaaaagctgcgataagacccacacatgtgctgcc

SEQ ID NO: 38361 - RNA, 687 nt, synthetic construct; identical to SEQ ID NO: 38360
  misc_feature 1..687: note = derived and/or modified sequence opt5 from Certolizumab_pegol_HeavyChain
  source 1..687: mol_type = other RNA

SEQ ID NO: 38362 - RNA, 642 nt, synthetic construct
  misc_feature 1..642: note = derived and/or modified sequence opt5 from Certolizumab_pegol_LightChain1
  source 1..642: mol_type = other RNA
gacatccagatgacccaaagcccctcctctctgagcgcctccgtgggcgatagagtcacaattacgtgcaaggcttctcagaacgttgggaccaatgtggcctggtaccagcagaaacctggaaaggcgccgaaagctctcatctatagcgcctccttcctgtactctggcgtgccctatcggtttagcgggtccggaagcggcacagacttcacccttacaatttcttccctgcaacctgaggattttgccacctactattgtcagcagtacaacatctatcccctcacattcgggcagggaaccaaggtcgaaattaaacgcacggtggctgcccctagcgtttttatctttcccccttctgacgagcaactgaagtccggcaccgctagcgtggtctgccttctgaataacttctacccgagagaagccaaggtgcagtggaaagttgataatgcgctccagtctggcaactcccaggagagcgtgacagaacaagactccaaggattctacctacagcctgtccagcacactgaccctctctaaagccgactatgagaagcacaaagtctacgcttgtgaggtgacgcatcaggggctgtccagccccgtgacaaagtctttcaatcggggagaatgc

SEQ ID NO: 38363 - RNA, 642 nt, synthetic construct; identical to SEQ ID NO: 38362
  misc_feature 1..642: note = derived and/or modified sequence opt5 from Certolizumab_pegol_LightChain
  source 1..642: mol_type = other RNA

SEQ ID NO: 38364 - RNA, 1356 nt, synthetic construct
  misc_feature 1..1356: note = derived and/or modified sequence opt5 from Cetuximab_HeavyChain
  source 1..1356: mol_type = other RNA
caggtgcaactgaagcagagcggccccgggctcgtccagccttcccagtctctgagcatcacatgcacagtttccggattctctcttacgaactacggcgtgcactgggtgagacaaagcccggggaaaggactggagtggctcggcgtcatttggtccgggggaaataccgactataacacaccctttacctctcggctgagcatcaataaggataactccaaaagccaggtgttctttaagatgaactctcttcagtccaatgacacagccatttactattgtgctcgcgccctgacctactatgattacgagttcgcgtattggggccagggcacactcgttaccgtgagcgctgcctctacgaaagggccttccgtctttcccctggcccctagctctaagtccaccagcggaggcacagctgccctggggtgcctcgtgaaggactacttccccgaacctgttaccgtgtcctggaactctggagctctgacaagcggcgtccatacctttccggccgtgcttcaatccagcgggctgtactctctctccagcgtggtcacggttccctctagctccctgggaacacagacctatatctgtaatgtgaatcacaaaccttctaacacaaaggtggataaaagagtcgaacccaagagccctaaatcctgcgacaagacccatacctgtcccccgtgccctgcgcccgagcttctgggcggccctagcgtgttcctctttcctcccaagcccaaagatacactgatgatttctcggacgccggaagttacctgtgtggtcgtggacgtttcccacgaggatcccgaggtgaagttcaattggtacgtcgacggggtggaagtccataacgccaaaacaaagcctcgcgaggaacagtataatagcacctacagagtggtttctgtgctgacagtcctccaccaggattggctgaacggaaaagagtataagtgcaaagtgtccaataaggcccttcccgctcctatcgagaagaccatcagcaaagctaagggccaaccccgggaaccgcaggtttacacgctgcctccctcccgcgacgagctcaccaaaaaccaggtgtctctgacctgtcttgtcaaggggttttatcctagcgatattgccgtggaatgggagtccaacggacaacccgaaaataactacaaaaccacacctcccgtgctggactctgacggcagcttctttctctactccaagctgaccgttgataagagcagatggcagcaggggaatgtcttctcttgctccgtgatgcacgaggcgctgcataaccactatacacagaaaagcctctctctgtccccgggaaag

SEQ ID NO: 38365 - RNA, 1347 nt, synthetic construct
  misc_feature 1..1347: note = derived and/or modified sequence opt5 from Cetuximab_HeavyChain_variant
  source 1..1347: mol_type = other RNA
caggtgcaactgaagcagagcggccccgggctcgtccagccttcccagtctctgagcatcacatgcacagtttccggattctctcttacgaactacggcgtgcactgggtgagacaaagcccggggaaaggactggagtggctcggcgtcatttggtccgggggaaataccgactataacacaccctttacctctcggctgagcatcaataaggataactccaaaagccaggtgttctttaagatgaactctcttcagtccaatgacacagccatttactattgtgctcgcgccctgacctactatgattacgagttcgcgtattggggccagggcacactcgttaccgtgagcgctgcctctacgaaagggccttccgtctttcccctggcccctagctctaagtccaccagcggaggcacagctgccctggggtgcctcgtgaaggactacttccccgaacctgttaccgtgtcctggaactctggagctctgacaagcggcgtccatacctttccggccgtgcttcaatccagcgggctgtactctctctccagcgtggtcacggttccctctagctccctgggaacacagacctatatctgtaatgtgaatcacaaaccttctaacacaaaggtggataaaaaggtcgaacccaaaagctgcgacaagacccatacctgtcctccctgcccggcgcctgagcttctgggcggcccctccgtgttcctctttcctcccaagcccaaagatacactgatgattagcagaacgcctgaagttacctgtgtggtcgtggacgtttctcacgaggatccggaggtgaagttcaattggtacgtcgacggggtggaagtccataacgccaaaacaaagccccgggaggaacagtataattccacctaccgcgtggttagcgtgctgacagtcctccaccaggattggctgaacggaaaagagtataagtgcaaagtgtctaataaggcccttcctgctcccatcgagaagaccatctccaaagctaagggccaacctagagaaccccaggtttacacgctgccgcctagccgggacgagctcaccaaaaaccaggtgtccctgacctgtcttgtcaaggggttttatccctctgatattgccgtggaatgggagagcaacggacaacctgaaaataactacaaaaccacaccccctgtgctggactccgacggctctttctttctctacagcaagctgaccgttgataagtcccgctggcagcaggggaatgtcttcagctgctctgtgatgcacgaggcgctgcataaccactatacacagaaatccctcagcctgtctcccggaaag

SEQ ID NO: 38366 - RNA, 639 nt, synthetic construct
  misc_feature 1..639: note = derived and/or modified sequence opt5 from Cetuximab_LightChain
  source 1..639: mol_type = other RNA
gacatcctgctcacccagagccccgtgattctgtccgtctctcctggcgagagagttagcttctcctgccgggcctctcaaagcatcgggacaaacattcactggtaccagcagcgcacgaatggatccccgagacttctgatcaaatatgcttctgaaagcatttccggcatccccagccggttttctgggtccggaagcggcaccgatttcacactctctatcaactccgtggagagcgaagacattgccgattactattgtcagcaaaataacaattggcctaccacatttggggcgggaaccaaactggagcttaagcgcacagtggctgccccctctgtcttcatctttcctccctccgacgaacagctgaaaagcggcaccgcctccgtggtttgcctcctgaacaatttctaccctagagaggctaaggtgcagtggaaagtcgataacgccctgcagtctggcaatagccaagagtccgtgacggaacaggacagcaaggattctacctattccctcagctctacactgacccttagcaaggctgactacgagaaacataaggtttatgcctgtgaagtgacacaccaggggctgtcctctccggtcaccaagagctttaaccggggagcg

SEQ ID NO: 38367 - RNA, 642 nt, synthetic construct
  misc_feature 1..642: note = derived and/or modified sequence opt5 from Cetuximab_LightChain_variant
  source 1..642: mol_type = other RNA
gacatcctgctcacccagagccccgtgattctgtccgtctctcctggcgagagagttagcttctcctgccgggcctctcaaagcatcgggacaaacattcactggtaccagcagcgcacgaatggatccccgagacttctgatcaaatatgcttctgaaagcatttccggcatccccagccggttttctgggtccggaagcggcaccgatttcacactctctatcaactccgtggagagcgaagacattgccgattactattgtcagcaaaataacaattggcctaccacatttggggcgggaaccaaactggagcttaagcgcacagtggctgccccctctgtcttcatctttcctccctccgacgaacagctgaaaagcggcaccgcctccgtggtttgcctcctgaacaatttctaccctagagaggctaaggtgcagtggaaagtcgataacgccctgcagtctggcaatagccaagagtccgtgacggaacaggacagcaaggattctacctattccctcagctctacactgacccttagcaaggctgactacgagaaacataaggtttatgcctgtgaagtgacacaccaggggctgtcctctccggtcaccaagagctttaaccggggagagtgc

SEQ ID NO: 38368 - RNA, 675 nt, synthetic construct
  misc_feature 1..675: note = derived and/or modified sequence opt5 from Citatuzumab_bogatox_HeavyChain1
  source 1..675: mol_type = other RNA
caccatcaccatcaccatgaggtgcagctggtccaaagcggccccgggctcgttcagcctggaggctccgtgagaatctcttgcgccgctagcgggtacaccttcacaaactatggaatgaattgggtgaagcaggccccgggcaaagggctggaatggatgggatggattaacacgtacaccggcgagtccacatatgcggactcttttaagggccggttcacctttagccttgatacatccgcttctgccgcctacctgcagatcaatagcctccgcgctgaagacaccgccgtctattactgtgctagattcgccattaaaggggattattggggacaaggcacactgcttaccgtgtccagcgcgtctacgaaggggccctccgtttttcctctggcccccagctctaaatccaccagcggaggcacagctgccctcgggtgcctggtgaaggactacttccctgagcccgtcaccgtgtcttggaactccggagctctgacaagcggcgttcacacctttcctgccgtgctccagtcctctggcctgtacagcctttccagcgtcgtgacggtgccgtcttccagcctggggacacagacctatatctgtaatgtcaaccacaagccctctaatacaaaagttgataagaaagtggaacctaagagctgc

SEQ ID NO: 38369 - RNA, 1443 nt, synthetic construct
  misc_feature 1..1443: note = derived and/or modified sequence opt5 from Citatuzumab_bogatox_LightChain1
  source 1..1443: mol_type = other RNA
gacatccagatgacccaaagcccctcctctctgagcgcctccgtgggcgatagagtcacaattacgtgccggtctaccaagagcctcctgcactccaacgggatcacatacctttattggtaccagcagaaacctggaaaggctccgaaactgctcatttatcagatgtctaatctggccagcggcgttccctcccgcttctctagctccgggagcggaaccgactttacacttaccatctcttccctgcaacctgaggatttcgcgacatactattgtgctcagaacctcgaaattcccagaacctttggccaggggacgaaggtggagctgaaacggaccgtggccgcccctagcgtcttcatctttcccccttctgacgaacagctgaagtccggaacagctagcgtggtttgcctcctgaataacttctacccgcgcgaggccaaggtgcaatggaaagtcgataatgcccttcagtccggcaactctcaggaaagcgtgaccgagcaggactccaaggatagcacatattctctgtccagcaccctcacgctgtctaaagctgactacgagaagcataaagtttacgcgtgtgaagtgacacaccaaggccttagctcccccgtcaccaagtcttttaatagaggggagtgcacacggcatcgccagcctagaggatgggaacagctgtataacaccgtgagcttcaatctcggcgaggcctacgagtatcccacctttatccaagatctgcggaacgaactggctaaggggacacctgtgtgtcagctccccgtcacgctgcagaccattgccgacgataaacgcttcgttcttgtggacatcacaaccacatccaagaaaaccgtgaaggtcgctattgatgtgacggacgtttacgtggtcggatatcaggacaaatgggatggcaaggacagagccgtgtttctggataaagttccgacagtggcgaccagcaaactcttccctggggtcaccaatcgggtgacactgacctttgacggatcttaccaaaaacttgtcaacgccgctaaggccgatcgcaaggctctggagctcggcgtgaataagctggagttctccatcgaagccattcacggcaagacaatcaacgggcaggaagccgctaaattctttctgattgttatccagatggtgagcgaggcggccagattcaagtatatcgagacggaagtcgtggaccggggactctacggctcttttaagcccaatttcaaagttctgaaccttgagaacaattggggagatatttccgacgctatccataagagctcccctcagtgcaccacaattaaccccgccctgcaactcatctctcccagcaatgatccttgggtggtcaacaaagtgtcccagatttctccggacatggggatcctgaagtttaaaagctccaag

SEQ ID NO: 38370 - RNA, 1380 nt, synthetic construct
  misc_feature 1..1380: note = derived and/or modified sequence opt5 from Cixutumumab_HeavyChain1
  source 1..1380: mol_type = other RNA
gaggtgcagctggtccaaagcggcgccgaagttaagaaacccgggtcctctgtgaaggtgagctgcaaagcctccggaggcaccttctctagctacgccatctcctgggtcagacaggcgcctgggcagggactcgagtggatgggcgggattatcccgatttttggaacagctaactatgcccagaagttccaaggccgggtgacgatcaccgccgacaaatctacaagcaccgcttacatggaactgtccagccttcgctctgaggatacagccgtttattactgtgctagagctcccctgcggtttctcgaatggtccacccaggaccactattactattactacatggatgtgtggggcaaggggacaaccgtcacggtgagctctgcgtccaccaagggacctagcgttttccccctggccccttcttccaaaagcacatccggcgggaccgctgcccttggatgcctggtgaaggactattttcccgagcctgtcacagtgtcttggaatagcggcgctctcacctccggggtgcatacgttcccggccgtcctgcagagctctggactgtactccctcagctctgttgtgacagtgcccagctcctctctgggcacccagacatatatttgtaacgtcaatcacaaacctagcaacaccaaggtggataaaaaggttgagcccaagtcctgcgacaaaacccatacatgtcctccctgcccggcgcctgaacttctgggcgggcccagcgtgtttctcttccctcccaagcccaaagatacgctgatgatctctcgcacccctgaggtcacatgtgtggttgtggacgtctcccacgaagatccggaggtgaagtttaattggtacgtcgacggagtggaggttcataacgccaaaaccaagcccagagaggaacaatataatagcacataccgggtggtctctgtgcttaccgttctgcaccaggattggctcaacggcaaagaatataagtgcaaggtgtccaataaagctctgcctgcccccatcgagaagacgattagcaaagctaaggggcagcctcgcgaaccccaggtctacacactgccgccttccagagaggagatgaccaaaaaccaagtgtctctcacctgtctggtgaagggattctaccccagcgacatcgccgttgaatgggagtccaatggccagcctgaaaacaattataagacaacaccccctgtccttgattctgacgggagctttttcctgtactccaaactcaccgtggacaagagccggtggcagcaaggaaacgtgttttcttgctccgtcatgcacgaggccctgcataatcactatacgcagaaaagcctttctctgtcccccggcaag

SEQ ID NO: 38371 - RNA, 642 nt, synthetic construct
  misc_feature 1..642: note = derived and/or modified sequence opt5 from Cixutumumab_LightChain1
  source 1..642: mol_type = other RNA
agctccgagctgacccaggaccccgccgtgtctgtcgctctcggccaaacagttagaatcacgtgccagggggatagcctgcggtcctactatgccacctggtaccagcagaagcctggacaagcgccgattcttgtgatctatggcgaaaacaaacgcccctctgggattcctgacagattcagcggatcctctagcggcaatacagcttccctgaccatcacaggggcccaggccgaggatgaagctgactactattgtaagagccgggatggatctggccagcacctcgtgtttggcgggggaaccaaactgacagtccttggccagcccaaggccgctccttccgtgaccctgtttccccctagctctgaggaactccaagccaacaaagcgacgctggtttgcctgatttccgacttctacccgggggccgtgaccgtcgcttggaaggccgatagctctcccgtgaaggctggagttgagacaaccacaccttccaaacagagcaataacaagtatgccgcgtcctcttacctcagcctgacccccgagcagtggaaatcccatcgcagctactcttgtcaggtgacgcacgaaggctccacagtcgagaagaccgtggcccctgctgaatgcagc

SEQ ID NO: 38372 - RNA, 1350 nt, synthetic construct
  misc_feature 1..1350: note = derived and/or modified sequence opt5 from Clazakizumab_HeavyChain1
  source 1..1350: mol_type = other RNA
gaggtgcagctggtcgaaagcggcgggggactcgttcaacccggcgggtccctgagactttcttgcgccgctagcggattctccctgtctaactactatgtgacctgggtgcggcaggcccctggcaaggggctcgagtgggtcggaatcatttacggcagcgacgaaacagcgtatgctacgtccgccatcggccgctttaccatttctagagataatagcaaaaacacactgtaccttcagatgaactccctgcgggccgaggacaccgctgtgtattactgtgcccgcgatgacagctctgattgggacgctaagttcaatctctgggggcagggaacactggttaccgtgtccagcgcctctacaaaaggcccgtccgtctttcccctggcgcctagctctaagtccaccagcgggggaacggccgctctcggctgcctggtgaaagattatttccccgaacctgttaccgtgtcctggaactctggggcccttacaagcggagtccacacctttcccgctgtgctgcaatccagcggcctctactctctgtccagcgtggtcacagttccttctagctcccttggcacccagacgtacatctgtaatgtgaatcataagccgtctaacacaaaggtggacaaaagagtcgagcccaagagctgcgataaaacccacacatgtcctccctgccctgcccccgagctgctcgggggaccgtccgtgttcctgtttcctcccaagcctaaagacaccctgatgattagccggacccccgaagttacatgtgtggtcgtggatgtttctcatgaggaccccgaagtgaagttcaattggtatgtcgatggcgtggaggtccacaacgcgaagacgaaacctcgcgaggaacagtacgcctccacctatagagtggttagcgtgctcacagtcctgcatcaggactggcttaatgggaaggagtacaaatgcaaggtgtctaacaaagctctgccggcccccatcgaaaagaccatctccaaagctaagggacaacctcgggagccccaggtttatacactccctcccagccgcgaagagatgaccaagaatcaggtgtccctgacgtgtcttgtcaaaggcttttacccgtctgacattgccgtggagtgggaaagcaacgggcagcctgagaataactataagacaacaccccctgtgctggattccgacggatctttctttctctacagcaaactgaccgttgataagtccagatggcaacagggcaacgtcttcagctgctctgtgatgcacgaagccctgcacaatcattacacccagaaatccctcagcctgtctcccggcaag

SEQ ID NO: 38373 - RNA, 651 nt, synthetic construct
  misc_feature 1..651: note = derived and/or modified sequence opt5 from Clazakizumab_LightChain1
  source 1..651: mol_type = other RNA
gccatccagatgacccaaagcccctcctctctgagcgcttccgtgggcgacagagtcacaattacgtgccaggcctctcagagcatcaacaatgagctctcctggtaccagcaaaagcctgggaaagcgccgaagctgcttatttatcgggcttctaccctggccagcggagttccctcccgcttcagcggctctgggtccggaacagattttaccctcacaatcagctctctgcagcctgacgatttcgccacctactattgtcagcagggctactcccttagaaacattgacaatgcttttgggggaggcacaaaagtggaaatcaagcggaccgtggccgctcccagcgtcttcatctttcctccctctgatgagcaactgaaatccggcacggccagcgtggtttgcctcctgaacaatttctatcctcgcgaagcgaaggtgcagtggaaggtcgacaacgccctgcagtccggaaattctcaggagagcgtgaccgaacaagattccaaagacagcacatactctctctccagcaccctgacactttctaaggctgattatgagaaacacaaggtttacgcctgtgaggtgacccatcaggggctgagctccccggtcacgaaatcttttaacagaggcgaatgc

SEQ ID NO: 38374 - RNA, 1347 nt, synthetic construct
  misc_feature 1..1347: note = derived and/or modified sequence opt5 from Clivatuzumab_tetraxetan_HeavyChain1
  source 1..1347: mol_type = other RNA
caggtgcaactgcagcagagcggcgctgaggtcaagaaacccggggcttccgttaaggtgtcttgcgaagccagcggatacaccttcccttcctatgtgctccactgggtcaaacaggcgccgggccaagggctggagtggatcggatacattaacccctataatgacggcacacagtacaacgaaaagtttaaagggaaggctacgcttaccagagatacatctatcaataccgcctatatggagctgagccggctccgctccgacgatacagccgtgtactattgtgctagaggattcggcggctcttacgggtttgcctactggggacagggcaccctggttacagtgagctccgctagcaccaaggggccttctgtcttcccccttgccccttccagcaaatctacgtccggaggcaccgcggccctggggtgcctcgtgaaggactattttcccgaacctgttacagtgagctggaactctggagctctgacctccggcgtccatacattcccggccgtgctgcagagctccggcctctactctctgagctccgtggtcaccgttccctctagctcccttgggacgcaaacatatatttgtaatgtgaaccacaaacctagcaataccaaggtggataaacgggtcgagcccaagtcttgcgacaagacacatacctgtcctccctgcccggctcctgagctgctcggaggccccagcgtgtttctgttccctcccaaacccaaggatacccttatgatctcccgcacacctgaagttacgtgtgtggtcgtggacgtttctcacgaggatccggaagtgaaatttaactggtacgtcgacggggtggaggtccataatgccaagaccaaacccagagaggaacagtataacagcacataccgggtggtttccgtgctgaccgtcctccaccaggattggctgaatggaaaggagtataaatgcaaggtgagcaacaaggcgctgcctgcccccattgaaaagacaatctctaaggctaaaggccagcctcgcgagccccaagtttacaccctcccgccttccagagaagagatgacgaagaatcaggtgagcctgacatgtcttgtcaaagggttctacccctctgacatcgccgtggagtgggaatccaacggacagcctgagaataactataagaccacaccccctgtgctggatagcgacggctcctttttcctctactctaagctgaccgttgacaaaagccggtggcaacagggcaacgtcttttcctgctctgtgatgcacgaagcccttcataatcactatacccagaaaagcctgtccctcagccccgggaaa

SEQ ID NO: 38375 - RNA, 645 nt, synthetic construct
  misc_feature 1..645: note = derived and/or modified sequence opt5 from Clivatuzumab_tetraxetan_LightChain1
  source 1..645: mol_type = other RNA
gacatccagctgacccaaagcccctcctctctcagcgcctccgtgggcgatagagtcacaatgacgtgctctgctagctcctctgttagctccagctacctgtattggtaccagcagaagcctgggaaagccccgaaactttggatttattctacctccaacctggcgagcggagtgcccgctcggttctctggctccgggagcggaacagactttaccctcacaatctcttccctgcagcctgaggatagcgcctcctacttctgtcaccaatggaatcgctatccctacacctttggcgggggaacaagacttgaaattaagcggaccgtggccgctccttctgtcttcatctttccccctagcgacgagcagctgaagtccggcacggccagcgtggtttgcctcctgaacaatttctatccgcgcgaagctaaagtgcagtggaaggtcgataacgccctgcagtctggcaattcccaagagagcgtgaccgaacaggactctaaggatagcacatactccctctctagcaccctgacactttccaaagcggactacgagaagcataaagtttatgcctgtgaggtgacccaccaggggctgagctctcccgtcacgaagtcctttaacagaggagaatgc

SEQ ID NO: 38376 - RNA, 1335 nt, synthetic construct
  misc_feature 1..1335: note = derived and/or modified sequence opt5 from Codrituzumab_HeavyChain1
  source 1..1335: mol_type = other RNA
caggtgcaactggtccagagcggcgccgaggttaagaaacccggggcttccgtgaaggtgtcttgcaaagccagcggatacaccttcacagactatgaaatgcactgggtcagacaggcgcctggccaggggctcgagtggatgggagctctggatccgaagacgggcgacaccgcctactcccaaaaatttaaggggcgggtgacacttaccgccgataagtctacaagcaccgcttatatggaactgtcctctctcacaagcgaggacaccgccgtttactattgtacgcgcttctactcctatacctactggggacagggcacactggtgaccgtcagctctgcttccacaaaaggccccagcgtgtttcctcttgccccctcttccaagagcacctctgggggaacggcggccctgggctgcctcgttaaagattacttccctgaacccgtgacagtctcctggaacagcggggctctgacctccggagtgcatacatttcctgccgtgctgcagtctagcggcctctattccctgagctctgtcgttaccgtgccgtccagctctcttgggacccagacatacatctgtaatgtgaaccacaagcccagcaatacgaaagtcgacaagaaggtggagcctaaatcctgcgataagacccatacatgtcccccttgccccgctccggagctgctcggaggcccttctgttttcctgtttccccctaaacccaaggacacccttatgattagcagaacacccgaagtgacctgtgtcgtggttgatgtgtcccacgaggaccctgaagtcaaattcaactggtatgtggatggcgtcgaggtgcataatgccaagacgaaaccgcgggaggaacaatacaacagcacatatcgcgttgtgtctgtcctgaccgtgctccaccaggactggctgaatgggaaggagtacaagtgcaaagtttccaacaaggcgctgcccgcccctatcgaaaagaccattagcaaggctaaaggacagcccagagagcctcaggtgtatacacttcccccgtctcgggatgaactgaccaagaatcaagtctcccttacatgtctggtgaagggcttttaccctagcgacatcgccgtggagtgggagtccaacgggcagcccgaaaataactacaaaacgacccctcccgttctcgactctgatggcagcttctttctgtattccaagctcacagtcgacaaatctcgctggcagcaaggaaatgtgttcagctgctccgtgatgcacgaggctctgcataaccactacacccagaaaagcctctctctgtcccctgggaaa

SEQ ID NO: 38377 - RNA, 657 nt, synthetic construct
  misc_feature 1..657: note = derived and/or modified sequence opt5 from Codrituzumab_LightChain1
  source 1..657: mol_type = other RNA
gacgtggtcatgacccagagccccctgtccctccctgttacaccgggcgagcccgcctctatcagctgcagatcctctcaaagcctggtgcactccaaccggaatacgtaccttcattggtatctgcagaagcctgggcagtctccccagctcctgatttacaaagtgagcaaccgcttctccggagtccctgatagatttagcggctctgggtccggaaccgacttcacacttaagatcagccgggtggaagctgaggatgttggcgtgtattactgttctcaaaatacccacgtgccccctacatttgggcagggaaccaaactggaaattaagcgcacagtcgccgcgccgtccgttttcatctttccccctagcgacgagcagctcaaatctggcaccgcttccgtggtctgcctgctgaacaatttctatcccagagaagccaaggtgcagtggaaggtggataacgccctccaaagcggcaattcccaggagtctgtcacggagcaggacagcaaagattccacctacagcctgtcttccacacttaccctgagcaaggctgactatgaaaaacataaggtttacgcctgtgaggtgacacaccaggggctctctagccctgtgaccaaatcctttaaccggggagaatgc

SEQ ID NO: 38378 - RNA, 1350 nt, synthetic construct
  misc_feature 1..1350: note = derived and/or modified sequence opt5 from Coltuximab_ravtansine_HeavyChain1
  source 1..1350: mol_type = other RNA
caggtgcaactggtccagcccggcgccgaggttgtgaagcctggggctagcgtgaaactctcctgcaagacctctggatacacattcacgagcaactggatgcactgggtcaaacaggccccgggccaggggctggaatggatcggagagattgacccctccgattcttataccaattacaaccaaaattttcagggcaaggcgaaacttacagtggacaagagcacctccacagcttatatggaagtttctagcctgagatccgatgacaccgccgtgtactattgtgcccgggggagcaacccttactattacgctatggattactggggacagggcacatctgtcaccgtgtccagcgcctctacgaagggcccctccgttttccctctcgctcccagctctaaatccaccagcgggggaacagccgcgctgggctgccttgtgaaggactattttcctgagccggtcaccgtgtcctggaactctggggccctgacaagcggagtgcataccttccccgctgtcctccagtccagcggcctgtactctctgtccagcgttgtgacggtgccttctagctccctcgggacacaaacctatatctgtaatgtcaatcacaaaccctctaacacaaaggtggataaaaaggttgaacctaagagctgcgacaaaacccatacctgtcccccgtgccctgcccccgagctgcttggaggcccttccgtgtttctgttccctcccaagcccaaagatacactcatgattagccgcacgccggaggtcacctgtgtggttgtggacgtctctcacgaagatcccgaggtgaagtttaattggtacgtcgacggcgtggaagttcataacgctaaaacaaagcctagagaggagcagtataattccacctaccgggtggtcagcgtgctgacagttcttcaccaggattggctgaacgggaaagaatataagtgcaaggtgtctaataaagccctccccgcgcctatcgagaagaccatttccaaagccaagggacagccccgcgaaccgcaagtctacacgctgcctcccagcagagacgagctgaccaaaaaccaggtgtccctcacatgtctggtgaagggcttctacccttctgacatcgctgttgaatgggagagcaatgggcagcccgagaacaactataagaccacacctcccgtccttgattccgacggatctttctttctgtacagcaaactcaccgtggataagtcccggtggcaacagggcaatgtgtttagctgctctgtcatgcacgaagccctgcataaccactatacacagaaatcccttagcctgtctccggggaag

SEQ ID NO: 38379 - RNA, 633 nt, synthetic construct
  misc_feature 1..633: note = derived and/or modified sequence opt5 from Coltuximab_ravtansine_LightChain1
  source 1..633: mol_type = other RNA
gagatcgtgctgacccagagccccgccattatgtccgcttctcctggcgaacgggtcacaatgacgtgcagcgcctcctctggggttaactacatgcactggtatcaacagaagccgggaaccagcccccggcgctggatctacgacacatccaaactcgcgtctggcgtgcctgctagattcagcgggtccggaagcggcaccgattattctctgacaatttccagcatggagcccgaagacgccgccacctactattgtcatcagcgggggtcttacacatttggaggcggcaccaaacttgagatcaagcgcacggtggctgccccttccgtcttcatttttccccctagcgatgaacagctgaagtctgggaccgcttccgtggtttgcctcctgaataacttctatccgagagaggccaaagtgcaatggaaggtcgacaatgcgcttcagagcggaaactcccaggagtctgtgacagaacaggatagcaaggactccacctacagcctgtcttccacactcaccctgagcaaagccgattacgagaagcacaaagtttatgcttgtgaagtgacgcatcaaggcctgtctagccccgtcacaaagtcctttaatagaggggagtgc

SEQ ID NO: 38380 - RNA, 1356 nt, synthetic construct
  misc_feature 1..1356: note = derived and/or modified sequence opt5 from Conatumumab_CV_HeavyChain
  source 1..1356: mol_type = other RNA
caggtgcaactgcaggagagcggccccgggctcgtcaagccttcccagaccctgtctcttacatgcacggttagcggaggctccatctctagcggggactacttctggtcctggattagacagctgccgggaaaaggcctcgaatggatcgggcacattcataactctggaaccacatattacaatcccagcctgaagtcccgggtgaccatcagcgtggatacatctaaaaagcaattttcccttcgcctgagctctgtcaccgccgctgacacagccgtgtattactgtgcgagagatcggggcggcgactattactatgggatggatgtttggggacagggcaccacggtgaccgtctccagcgcttctacaaaagggccttccgtgttccccctcgcccctagctccaagtctaccagcggaggcacagccgctctggggtgcctggttaaggactactttcccgagcctgtgaccgtctcctggaacagcggagccctcacgtctggcgtgcacacattcccggctgtgctgcagtccagcggcctttactctctgagctccgtcgttaccgtgccctctagctccctcgggacacagacctatatttgtaatgtgaaccataaacctagcaataccaaggtcgataaacgcgtggaacccaagtcttgcgacaaaacacacacgtgtcctccctgcccggcccctgagctgcttggaggcccctccgtttttctgttccctcccaagcccaaggataccctcatgatcagcagaacacctgaagtgacctgtgtcgtggttgacgtgtctcatgaggatccggaggtcaaatttaactggtacgtggacggggtcgaagtgcacaatgcgaagacaaaaccccgggaggaacaatataactccacctaccgcgttgtgagcgtcctgacggtgctgcaccaggattggctcaatggaaaggagtataaatgcaaggtttccaacaaagccctgcctgctcccatcgagaagacaatttctaaggccaaaggccagcctagagaaccccaggtgtacacccttccgcctagccgggaggaaatgaccaagaatcaagtctccctgacatgtctcgtgaaagggttctatccctctgacatcgctgtggagtgggaaagcaacggacagcctgagaataactacaagaccacaccccctgttctggactccgatggcagctttttcctttactctaaactgacggtcgacaagtcccgctggcagcaaggcaatgtgtttagctgctctgtgatgcatgaggccctccacaaccattatacccagaagtccctgagcctgtctcccgggaaa

SEQ ID NO: 38381 - RNA, 645 nt, synthetic construct
  misc_feature 1..645: note = derived and/or modified sequence opt5 from Conatumumab_CV_LightChain
  source 1..645: mol_type = other RNA
gagatcgtgctgacccagagccccggcacactctccctgtctcctggggaaagagccacgcttagctgccgggcttcccaaggaatttctcgcagctacctggcctggtatcagcagaagccgggccaggcgccctccctcctgatctacggggcttctagcagagccaccggcattcctgaccggttctccggaagcgggtctggaacagattttacccttacaatctcccgcctggagcccgaagacttcgccgtctattactgtcaacagtttggcagctctccttggaccttcggccaggggacaaaagttgagattaagagaaccgtggctgccccctccgtgtttatcttccctccgagcgatgaacagctcaaatctggaacggcttccgtcgtgtgcctgctgaacaatttttatccccgggaggccaaggttcaatggaaagtggacaacgcgctccagagcggcaattcccaggagtctgtcaccgaacaggatagcaaggactccacatacagcctgtcttccacccttacactgagcaaggccgattatgagaaacacaaggtgtacgcttgtgaagttacccatcaagggctctctagccctgtgacgaaatccttcaaccgcggagagtgc

SEQ ID NO: 38382 - RNA, 1356 nt, synthetic construct; identical to SEQ ID NO: 38380
  misc_feature 1..1356: note = derived and/or modified sequence opt5 from Conatumumab_HeavyChain1
  source 1..1356: mol_type = other RNA

SEQ ID NO: 38383 - RNA, 1356 nt, synthetic construct; identical to SEQ ID NO: 38380
  misc_feature 1..1356: note = derived and/or modified sequence opt5 from Conatumumab_HeavyChain
  source 1..1356: mol_type = other RNA

SEQ ID NO: 38384 - RNA, 645 nt, synthetic construct; identical to SEQ ID NO: 38381
  misc_feature 1..645: note = derived and/or modified sequence opt5 from Conatumumab_LightChain1
  source 1..645: mol_type = other RNA

SEQ ID NO: 38385 - RNA, 645 nt, synthetic construct; identical to SEQ ID NO: 38381
  misc_feature 1..645: note = derived and/or modified sequence opt5 from Conatumumab_LightChain
  source 1..645: mol_type = other RNA

SEQ ID NO: 38386 - RNA, 1344 nt, synthetic construct
  misc_feature 1..1344: note = derived and/or modified sequence opt5 from Concizumab_HeavyChain1
  source 1..1344: mol_type = other RNA
gaggtgcagctggtcgaaagcggcgggggactcgttaagcccggcgggtccctgagactttcttgcgccgctagcggattcaccttttccaactacgccatgtcttgggtgcggcaaacacctgagaaacgcctggaatgggtggcgacgatcagcagatccggctcttatagctacttcccggactccgtccaggggcggtttaccattagccgcgataatgctaagaactctctctatctgcagatgaatagccttagagccgaggacacagccgtgtactattgtgctcggctgggaggctacgatgaaggcgacgccatggattcctgggggcagggaaccacagttaccgtgtcttccgctagcacaaaaggcccctctgtcttccctctcgccccctgctcccgcagcacctccgagtctacggcggccctggggtgtctggtgaaggactattttcctgagcccgttaccgtgagctggaactccggagctctcacaagcggcgtccacaccttccctgccgtgctgcaatcttccgggctttacagcctgtctagcgtggtcacagttccgtcctctagcctcggaaccaaaacgtacacatgcaatgtggatcataagccctccaacaccaaggtggacaaaagagtcgaaagcaagtatggccctccctgtcctccctgcccggctcctgagtttctgggcgggccctctgtgttcctttttcctcccaaacccaaggatacactgatgatctcccggacccctgaagttacctgtgtggtcgtggacgttagccaggaggatccggaggtgcagttcaattggtacgtcgacggagtggaagtccacaacgccaaaacaaagccccgcgaggaacagtttaattctacgtatagagtggtttccgtgctcaccgtcctgcatcaagattggctgaacggcaaggagtacaaatgcaaggtgagcaataaagggctcccttcctctattgaaaagacaatcagcaaagcgaagggacagccccgggagcctcaggtttataccctgcccccgtcccaggaggaaatgaccaaaaaccaagtgtctcttacatgtctggtcaagggcttctaccctagcgacattgccgtggagtgggaatccaatgggcagcccgagaacaattataagacgacacctcccgtgctcgacagcgatggatctttctttctgtactcccgccttaccgttgacaaaagcagatggcaggaaggcaacgtcttctcttgctccgtgatgcacgaggctctgcataaccactacacccaaaagagcctctctctgagcctgggcaaa

SEQ ID NO: 38387 - RNA, 657 nt, synthetic construct
  misc_feature 1..657: note = derived and/or modified sequence opt5 from Concizumab_LightChain1
  source 1..657: mol_type = other RNA
gacatcgtgatgacgcagacacccctgagcctctccgtcacgcctggccaaccggcctctattagctgcaagtcctctcagagcctgcttgagtccgatgggaaaacctacctgaactggtatctccagaagcccggacagtctcctcaactgcttatctacctggttagcattctcgactccggcgtgcccgatcggttcagcgggtctggatccggcacagactttaccctgaaaatcagccgggtggaagctgaggatgtcggggtgtattactgtctgcaggccacacacttccctcagacctttggaggcggcacaaaggttgaaattaaacgcaccgtggcggctccctctgtcttcatctttcctccgtccgacgagcagctcaagagcgggacggcctctgtggtttgcctgcttaataacttctatcccagagaagccaaggtgcaatggaaagtcgataatgctctgcagtccggaaacagccaggagtccgtgaccgagcaggactctaaggatagcacatactccctcagctctaccctgacactttccaaagccgactatgaaaagcataaagtgtacgcttgtgaggtcacccaccaaggcctgagctctcctgttaccaagagctttaatagaggggaatgc

SEQ ID NO: 38388 - RNA, 1314 nt, synthetic construct
  misc_feature 1..1314: note = derived and/or modified sequence opt5 from Crenezumab_HeavyChain1
  source 1..1314: mol_type = other RNA
gaggtgcagctggtcgaaagcggcgggggactcgttcaacccggcgggtccctgagactttcttgcgccgctagcggattcaccttttcctcttacggcatgagctgggtgcggcaggcccctgggaagggactggagctcgtggcgtccatcaactctaatggcggcagcacatattacccggactccgtcaaagggcgcttcacgattagcagagataacgctaaaaattctctgtatcttcagatgaactccctgcgggccgaagacaccgccgtgtactattgtgctagcggagattactggggccaggggacaaccgttacagtgtcttccgccagcaccaagggaccctctgtctttcctctcgctccctgctcccgcagcacatccgagtctaccgccgcgctgggctgtctggtgaaggactatttccctgaacccgttacggtgagctggaactccggggccctcaccagcggagtccacacatttcctgctgtgctgcaatcttccggcctttacagcctgtctagcgtggtcaccgttccgtcctctagcctcggcacaaaaacctacacgtgcaatgtggatcataagccctccaatacaaaggtggacaaaagagtcgagagcaagtatgggcctccctgtcctccctgcccggcccctgagttcctgggaggcccctctgtgtttcttttccctcccaaacccaaggataccctgatgatctcccggacacctgaagttacctgtgtggtcgtggacgttagccaggaggatccggaagtgcagtttaactggtacgtcgacggggtggaggtccacaatgctaaaaccaagccccgcgaggaacagttcaactctacatatagagtggtttccgtgctcacggtcctgcatcaagattggctgaatggaaaggagtacaaatgcaaggtgagcaacaaaggcctcccttcctctattgaaaagaccatcagcaaagccaaggggcagccccgggagcctcaggtttatacactgcccccgtcccaggaagagatgaccaaaaatcaagtgtctcttacatgtctggtcaagggattttaccctagcgacattgcggtggagtgggaatccaacggccagcccgagaataactataagaccacgcctcccgtgctcgatagcgacggctctttctttctgtactcccgccttacagttgacaaaagcagatggcaggaagggaacgtcttctcttgctccgtgatgcacgaggccctgcataatcactacacccaaaagagcctctctctgagcctggga

SEQ ID NO: 38389 - RNA, 657 nt, synthetic construct
  misc_feature 1..657: note = derived and/or modified sequence opt5 from Crenezumab_LightChain1
  source 1..657: mol_type = other RNA
gacatcgtgatgacccagagccccctgtccctccctgtcacaccgggcgagcccgcctctattagctgcagatcctctcaaagcctggtttactccaacggggatacgtatcttcactggtacctgcagaagcctggacagtctccccagctcctgatctataaagtgagcaatcggttctccggcgtgcctgaccgctttagcgggtctggatccggcaccgatttcacacttaagattagcagagtcgaagctgaggacgtgggggtttactattgttctcaatccacccatgtgccctggacatttggacagggcaccaaagtcgaaatcaagcggacagtggccgcgcctagcgttttcatttttccgccctctgatgagcagctgaaatccggcaccgctagcgtggtctgcctcctgaacaatttctaccctcgcgaagccaaggtgcagtggaaggtggacaacgccctgcaatccggaaattctcaggagagcgtcacggagcaggattccaaagacagcacctattctctctccagcacactgaccctttctaaggctgattacgaaaaacacaaggtttacgcctgtgaggtgacacatcaggggctgagctcccccgtgaccaaatcttttaacagaggcgaatgc

SEQ ID NO: 38390 - RNA, 1365 nt, synthetic construct
  misc_feature 1..1365: note = derived and/or modified sequence opt5 from Crotedumab_HeavyChain1
  source 1..1365: mol_type = other RNA
gaggtgcagctggtcgaaagcggcgggggactcgttcaacccggcgggtccctgagactttcttgcgccgctagcggattcaccttttccaactacctgatgaattgggtgcggcaggcccctggcaaggggctcgagtggctggcgaacatccaggaagacggaattgagaaatattacgtggattctgtcaagggccgcttcacaatcagcagagacaatgctaaaaactccctttatctgcagatgaactctctccgggccgaagatacggccgtgtactattgtgctcgcgagccgagccactacgacattctgaccggctatgattactactatgggatggacgtttggggacaaggcacaaccgtgacagtctccagcgcctctaccaaggggccctccgtgtttcctctggctccctgcagcagatctacatccgagagcaccgccgcgctcggatgtctggttaaagattacttccctgaacccgtgacggtctctaataattccggcgcccttaccagcggggtgcatacatttcctgctgtgctgcagtcctctggactctatagcctgtccagcgtcgttaccgtgccgtcttccagccttggcacaaagacctacacgtgcaacgtggaccacaagccctctaatacaaaagtcgataagcgggtggagagcaaatatggccctccctgtcctccctgcccggcccctgagttcctcgggggaccctccgtttttctgttccctcccaagcccaaagacaccctgatgatctctcgcacacctgaggtgacctgtgtcgtggttgatgtgagccaggaggacccggaagtccagtttaactggtacgtggatggcgtcgaggtgcataatgctaagaccaagcccagagaagaacaattcaactccacatatcgggttgtgagcgtcctgacggtgctccaccaggactggctgaatgggaaagaatacaagtgcaaagtttctaacaagggacttccttccagcattgagaaaaccatctctaaggccaaaggccagccccgcgagcctcaggtgtacacactgcccccgtcccaagaagagatgaccaagaatcaggtcagcctcacatgtctggtgaaggggttttatccttccgacatcgcggtggaatgggagtctaacggacagcccgaaaacaattacaaaaccacgcctcccgttcttgatagcgacggctccttctttctgtattctagactcacagtcgataagagccggtggcaagagggcaacgtgttctcctgcagcgtgatgcatgaggccctgcacaatcactacacccagaaatctctgtccctcagcctggggaag

SEQ ID NO: 38391 - RNA, 1365 nt, synthetic construct
  misc_feature 1..1365: note = derived and/or modified sequence opt5 from Crotedumab_HeavyChain2
  source 1..1365: mol_type = other RNA
gaggtgcagctggtcgaaagcggcgggggactcgttcaacccggcgggtccctgcacctttcttgcgccgctagcggattcaccttttccaactacctgatgaattgggtgagacaggcccctggcaaggggctcgagtggctggcgaacatccaggaagacggaattgagaaatattacgtggattctgtcaagggccggttcacaatcagccgcgacaatgctaaaaactccctttatctgcagatgaactctctcagagccgaagatacggccgtgtactattgtgctcgggagccgagccattacgacattctgaccggctatgattactactatgggatggacgtttggggacaaggcacaaccgtgacagtctccagcgcctctaccaaggggccctccgtgtttcctctggctccctgcagccgctctacatccgagagcaccgccgcgctcggatgtctggttaaagattacttccctgaacccgtgacggtctctaataattccggcgcccttaccagcggggtgcacacatttcctgctgtgctgcagtcctctggactctatagcctgtccagcgtcgttaccgtgccgtcttccagccttggcacaaagacctacacgtgcaacgtggaccataagccctctaatacagaggtcgatgaaagagtggagagcaaatatggccctccctgtcctccctgcccggcccctgagttcctcgggggaccctccgtttttctgttccctcccaagcccaaagacaccctgatgatctctcggacacctgaagtgacctgtgtcgtggttgatgtgagccaggaggacccggaagtccagtttaactggtacgtggatggcgtcgaggtgcacaatgctaagaccaaaccccgcgaagaacaattctggtccacatatagagttgtgagcgtcctgacggtgctccatcaggactggctgaacgggaaggagtacaagtgcaaagtttctaataagggacttccttccagcattgagaaaaccatctctaaggccaaaggccagccccgggagcctcaggtgtacacactgcccccgtcccaagaagagatgaccaagaaccaggtcagcctcacatgtctggtgaaagggttttatccttccgacatcgcggtggaatgggagtctaatggacagcccgagaacaactacaagaccacgcctcccgttcttgatagcgacggctccttctttctgtattctcgcctcacagtcgatgaaagcagatggcaagagcacaatgtgttctcctgcagcgtgatgcacgaagccctgcataaccactacacccagaagtctctgtccctcagcctgggcaaa

SEQ ID NO: 38392 - RNA, 642 nt, synthetic construct
  misc_feature 1..642: note = derived and/or modified sequence opt5 from Crotedumab_LightChain1
  source 1..642: mol_type = other RNA
gacatccagatgacccaaagcccctcctctctgagcgcctccgtgggcgatagagtcacaattacgtgccgggcttctcaggggatccgcaacgacctcggatggtaccagcagaagcctggcaaagccccgaagagactgatttatgcggctagctcccttcaatctggggttcccagccggttctccggaagcggctctgggaccgagtttatcctgacagtgtccagcctccagcctgaagatttcgccacctactattgtctgcagtacaatgagaacccctttacattcggacctggcaccaaagtggacattaagcgcacagtcgccgctccctctgtgtttatcttccctccgtccgatgaacagcttaaaagcggcaccgcctctgttgtgtgcctgctcaataacttttatcccagagaggctaaggtccaatggaaggtggacaatgccctgcagtccgggaacagccaggaatccgttacggagcaggattctaaagacagcacctactccctgagctctacactcaccctgtccaaggcggattatgaggaacacaaagtgtacgcctgtgaggtcacacatcaaggacttagctctcctgtgaccaagagcttcaatcggggcgaatgc

SEQ ID NO: 38393 - RNA, 642 nt, synthetic construct
  misc_feature 1..642: note = derived and/or modified sequence opt5 from Crotedumab_LightChain2
  source 1..642: mol_type = other RNA
gacatccagatgacccaaagcccctcctctctgagcgcctccgtgggcgatagagtcacaattacgtgccgggcttctcaggggatccgcaacgacctcggatggtaccagcagaagcctggcaaagccccgaagagactgatttatgcggctagctcccttcaatctggggttcccagccggttctccggaagcggctctgggaccgagtttatcctgacagtgtccagcctccagcctgaagatttcgccacctactattgtctgcagtacaattctaacccctttacattcggacctggcaccaaagtggacattaagcgcacagtcgccgctccctccgtgtttatcttccctccgagcgatgagcagcttaaatctggcaccgcctccgttgtgtgcctgctcaataacttttatcccagagaagctaaggtccaaaataaggtggacaacgccctgcagagcggaaattcccaggagtctgttacggaacaggatagcaaagactccacctacagcctgtcttccacactcaccctgagcgaggcggattatgagaagcacaaagtgtacgcctgtgaagtcacacatcaagggctttctagccctgtgaccaagtccttcaaccggggcgagtgc

SEQ ID NO: 38394 - RNA, 1332 nt, synthetic construct
  misc_feature 1..1332: note = derived and/or modified sequence opt5 from Dacetuzumab_HeavyChain1
  source 1..1332: mol_type = other RNA
gaggtgcagctggtcgaaagcggcgggggactcgttcaacccggcgggtccctgagactttcttgcgccgctagcggatactccttcaccggctattacatccactgggtgcggcaggcccctgggaagggactggagtgggtggcgcgcgtcattccgaacgctggcggcacatcttataatcagaaatttaaggggagattcacgctcagcgtggacaactccaaaaataccgcctacctgcagatgaactctcttcgggccgaagatacagctgtttattactgtgcccgcgagggaatctattggtggggccaagggaccctggtgacagtcagctccgctagcaccaagggaccctctgtgtttcctctcgccccctccagcaaatctacatccggcgggaccgcggccctgggatgcctggttaaggactacttccctgaacccgtgacggtcagctggaatagcggcgctctcacctccggcgtgcatacatttcctgccgtgctgcagagctccgggctttactctctgagctccgtcgttaccgtgccgtcttcttccctcggaacacagacctatatttgtaacgtgaatcacaagcccagcaacacgaaagtcgataagaaagtggagcctaagtcttgcgacaaaacacatacctgtcccccttgccccgctccggagctgcttggcgggcctagcgttttcctgtttccccctaagcccaaggatacactcatgatctccagaacccccgaagtgacctgtgtcgtggttgacgtgtctcacgaggatcctgaagtcaaattcaattggtacgtggacggagtcgaggtgcataacgccaagacaaaaccgcgggaggaacagtataatagcacgtaccgcgttgtgtccgtcctgaccgtgctgcaccaagattggctcaacggcaaggagtataaatgcaaggttagcaataaagcgctgcccgcccctattgaaaagacaatctctaaggctaaagggcagcccagagagcctcaggtgtacacccttcccccgtcccgggaagagatgacaaagaaccaggtcagcctgacctgtctcgtgaaaggattttatccttctgacatcgccgtggagtgggaatccaatggccaacccgagaacaactacaagacgacacctcccgttctggatagcgacggctccttctttctttactctaaactgaccgtcgataagagccgctggcagcaggggaatgtgttctcctgctctgtgatgcacgaagctctccataaccactatacccaaaagagcctgtccctgagccctggaaaa

SEQ ID NO: 38395 - RNA, 657 nt, synthetic construct
  misc_feature 1..657: note = derived and/or modified sequence opt5 from Dacetuzumab_LightChain1
  source 1..657: mol_type = other RNA
gacatccagatgacccaaagcccctcctctctgagcgcctccgtgggcgatagagtcacaattacgtgccggtctagccagtccctcgttcactctaacgggaataccttcctgcattggtaccagcagaagcctggaaaagctccgaaacttctgatctatacagtgagcaaccgcttttccggcgtgcccagcagattctctgggtccggaagcggcaccgactttacactcaccatttcttccctgcaacctgaggatttcgccacatacttttgtagccagaccacgcacgtcccctggaccttcgggcagggaacaaaagtggaaatcaagcggaccgttgcggctccttctgtgtttatttttcccccttccgacgagcagcttaaaagcggcacagcctccgtcgtgtgcctgctcaataacttctatccgcgcgaagccaaggttcaatggaaggtggataatgctctgcagtctggcaacagccaggagtccgtcaccgaacaggacagcaaagattctacgtactccctgagctctacactcaccctgagcaaggccgactatgagaaacataaggtgtacgcttgtgaggtgacacaccaagggctttcctctcccgtcaccaagagcttcaatagaggagaatgc

SEQ ID NO: 38396 - RNA, 318 nt, synthetic construct
  misc_feature 1..318: note = derived and/or modified sequence opt5 from Dacliximab_LightChain_VJ-Region
  source 1..318: mol_type = other RNA
gacatccagatgacccaaagcccctccacactgtctgccagcgtgggcgatagagtcacgattacctgctccgcttctagctccatctcttacatgcactggtatcagcagaagcctgggaaagccccgaagctcctgatttacacaaccagcaaccttgcgtccggagttcccgctcggttcagcggctctgggtccggaacagagtttaccctgacaatcagctctctccagcctgacgatttcgccacctattactgtcatcaacgctccacgtatcccctgacctttggccaggggacaaaagtggaagtgaag

SEQ ID NO: 38397 - RNA, 348 nt, synthetic construct
  misc_feature 1..348: note = derived and/or modified sequence opt5 from Dacliximab_gamma2-Chain_VDJ-Region
  source 1..348: mol_type = other RNA
caggtgcaactggtccagagcggcgccgaggttaagaaacccgggtcctctgtgaaggtgagctgcaaggcttccggatacaccttcacatcttatagaatgcactgggtccggcaggcccctggccaggggctcgaatggatcggatacattaacccgagcacgggctataccgagtacaatcaaaaatttaaagacaaggcgacaatcaccgctgatgaatccacaaacaccgcctatatggagctgtctagccttcgctccgaagacacagccgtgtactattgtgctagagggggaggcgttttcgattactggggccaggggaccctggtgacggtcagctct

SEQ ID NO: 38398 - RNA, 1326 nt, synthetic construct
  misc_feature 1..1326: note = derived and/or modified sequence opt5 from Daclizumab_HeavyChain
  source 1..1326: mol_type = other RNA
caggtgcaactggtccagagcggcgccgaggttaagaaacccgggtcctctgtgaaggtgagctgcaaggcttccggatacaccttcacatcttatagaatgcactgggtccggcaggcccctggccaggggctcgaatggatcggatacattaacccgagcacgggctataccgagtacaatcaaaaatttaaagacaaggcgacaatcaccgctgatgaatccacaaacaccgcctatatggagctgtctagccttcgctccgaagacacagccgtgtactattgtgctagagggggaggcgttttcgattactggggccaggggaccacgctgaccgtgagctctggaccctccgtctttcctctcgcccccagctctaagtccacaagcggcgggaccgctgccctgggatgccttgtgaaagactacttccctgagcccgttacagtgtcttggaactccggcgcgctgaccagcggggtccatacgtttcctgccgtgctccagtcctctggactgtatagcctgtccagcgtggtcacagttccgtcttccagcctcggcacccagacatacatttgtaatgtgaatcacaagccctctaacaccaaagtggataagaaagctgagcctaagagctgcgacaagacccatacatgtcccccttgccccgccccggaactgcttggcgggccttccgtcttcctgtttccccctaaacccaaggatacgctcatgatctctcggacccccgaggtgacatgtgttgtggtcgacgtgagccacgaagatcctgaggttaaattcaattggtatgtggacggagtcgaggtgcataacgctaagaccaaaccgcgcgaggaacaatacaattccacatatagagtcgtgagcgttctgaccgtgcttcaccaggattggctgaacggcaaggaatacaaatgcaaggtctctaataaggccctccccgcgcctattgagaaaacgatctccaaggccaaagggcagccccgggaacctcaggtgtatacactgcccccgagccgcgacgagctgaccaagaaccaagtttctctcacctgtctggtgaaaggattttacccttccgatatcgctgtcgagtgggaaagcaatggccagcccgagaacaattacaagacaacccctcccgtgcttgactccgacgggtctttctttctgtatagcaagctcacagtggataaatccagatggcagcaaggaaacgttttctcttgcagcgtcatgcacgaagccctgcataaccactacacgcagaagtcccttagcctgtctcctggcaaa

SEQ ID NO: 38399 - RNA, 630 nt, synthetic construct
  misc_feature 1..630: note = derived and/or modified sequence opt5 from Daclizumab_LightChain
  source 1..630: mol_type = other RNA
gacatccagatgacccaaagcccctccacactgtctgccagcgtgggcgatagagtcacgattacctgctccgcttctagctccatctcttacatgcactggtatcagcagaaacctgggaaagccccgaagctcctgatttacacaaccagcaaccttgcgtccggagttcccgctcggttcagcggctctgggtccggaacagagtttaccctgacaatcagctctctccagcctgacgatttcgccacctattactgtcatcaacgctccacgtatcccctgacctttggcagcgggacaaaagtggaagtgaagagaaccgtcgccgctccttctgtgttcatttttcccccttccgacgagcagcttaaaagcggaacagcctccgttgtgtgcctgctcaataacttctacccgcgggaagctaaggtccagtggaaggtggataatgccctgcagtctggcaacagccaagagtccgttaccgaacaggacagcaaagattctacgtattccctgagctctacactcaccctgagcaaggcggactacgagaaacacaaggtgtacgcctgtgaggtcacacatcagggcctttcctctcccgtgaccaagagctttaatcgc

SEQ ID NO: 38400 - RNA, 1341 nt, synthetic construct
  misc_feature 1..1341: note = derived and/or modified sequence opt5 from Dalotuzumab_HeavyChain1
  source 1..1341: mol_type = other RNA
caggtgcaactgcagcagagcggccccgggctcgtcaagccttcccagaccctgtctcttacatgcacggttagcggatggtccatctctggcgggtggctgtggaactggattagacaaccgcccggaaaaggcctccagtggatcgggtggattagctgggacggaaccaataactggaagccttccctgaaagatcgggtgacaatctctgtggacaccagcaagaatcagttctcccttaaactgagctctgtcacagccgctgataccgccgtgtggtggtgtgcgcgctggggcagagtgtttttcgactggtggggccaggggacactcgttaccgtctccagcgcttctacgaagggaccctccgtgtttcctctggcccccagctctaagtccaccagcggcgggacagccgctctgggatgcctcgttaaagattacttccctgagccggtgaccgtctcctggaactctggcgccctgacaagcggggtgcacacctttcccgctgtgcttcaatccagcggactgtattctctctccagcgtcgttacggtgccttctagctccctgggcacacagacctacatttgtaatgtgaaccataagccctctaatacaaaagtcgacaagcgggtggaacctaaaagctgcgataagacccacacctgtcccccgtgccctgcccccgagcttctgggcgggccttccgttttcctctttccgcccaagcctaaagacacactgatgatcagccgcacgccggaagtgacctgtgtcgtggttgatgtgtctcatgaggaccccgaagtcaagttcaactggtatgtggatggagtcgaggtgcacaatgcgaaaacaaagcctagagaggaacagtacaactccacctatcgggttgtgagcgtcctgacagtgctccatcaggactggctgaatggcaaagagtacaagtgcaaagtttctaacaaggcccttcccgctcctatcgaaaagaccatttccaaagccaaggggcaaccccgcgagccccaggtgtatacgctgcctcccagcagagaggaaatgaccaaaaatcaggtctccctcacatgtctggtgaagggattttacccttctgatatcgctgtggagtgggaaagcaacggccaacccgagaataactacaaaaccacacctcccgttcttgactccgacgggtctttctttctgtatagcaagctcaccgtcgataagtcccggtggcagcagggaaacgtgttcagctgctctgtgatgcacgaagccctgcacaatcattacacacagaaatccctgagcctctctccgggcaag

SEQ ID NO: 38401 - RNA, 657 nt, synthetic construct
  misc_feature 1..657: note = derived and/or modified sequence opt5 from Dalotuzumab_LightChain1
  source 1..657: mol_type = other RNA
gacatcgtgatgacccagagccccctgtccctccctgtcacaccgggccaacccgcctctattagctgcagatcctctcagagcatcgttcactccaacgggaatacgtggctgcagtggtggcttcagaaacctggacaatctccccagctgctcatttggaaagtgagcaaccggctgtggggcgtgcctgatcgcttctccgggagcggatctggcaccgactttacacttaagatctccagagtccaggctcaggatgtgggggtttggtggtgtttccaaggaagccatgtgccctggacctttggccagggcacaaaagtccagattaagcggaccgtggccgcgccttctgttttcatctttccgccctccgacgagcagctgaaaagcgggacagcttctgtggtctgcctcctgaataacttctaccctcgcgaagccaaggtgcaatggaaggtggataatgccctgcagtccggaaacagccaggagtccgtcaccgaacaagactctaaagatagcacgtattccctcagctctaccctgacactttccaaggctgactacgagaaacacaaggtttatgcctgtgaagtgacccatcagggcctgagctctcccgtgacaaagagctttaatagaggggagtgc

SEQ ID NO: 38402 - RNA, 687 nt, synthetic construct
  misc_feature 1..687: note = derived and/or modified sequence opt5 from Dapirolizumab_pegol_HeavyChain1
  source 1..687: mol_type = other RNA
gaggtgcagctggtcgaaagcggcgggggactcgttcaacccggcgggtccctgagactttcttgcgccgtgagcggattctcctctaccaactaccacgtgcattgggtccggcaggctcctggcaaggggctggagtggatgggagtgatctggggcgacggcgatacaagctataattccgttctcaaatctcgctttacgattagcagagacacctccaagaacacagtgtacctgcagatgaatagccttcgggccgaagataccgcggtctattactgtgctcgccagctgacacactattacgtgctcgccgcctgggggcaaggaaccctggttacagtgtcttccgctagcaccaaaggcccgtctgtcttccccctggccccttccagcaagtctacgtccgggggaaccgctgccctcggctgcctggtgaaagactattttcccgagcctgtgacagtcagctggaactccggggcgcttacctctggagttcatacattccccgccgtgctgcagagctccggcctctacagcctgtcttccgtggtcaccgtgcctagctctagccttggcacgcagacatacatctgtaatgttaaccacaagccgtccaataccaaggtggataaaaaggtcgaacccaaatcttgcgacaagacacatacctgtgctgcc

SEQ ID NO: 38403 - RNA, 642 nt, synthetic construct
  misc_feature 1..642: note = derived and/or modified sequence opt5 from Dapirolizumab_pegol_LightChain1
  source 1..642: mol_type = other RNA
gacatccagatgacgcaaagcccctcctctctgagcgcctccgtgggcgatcgggtcacaattacgtgccgggcttctgaggacctctactataacctggcctggtaccagcgcaagcctgggaaagcgccgaaacttctgatctatgatacctacagactcgctgacggagttcccagccggttctccggctctgggagcggaacagattataccctgacaatttccagccttcagcctgaagactttgcctcttactattgtcagcaatactacaagttcccctttaccttcggccaggggacaaaggtggagatcaaacgcaccgtggccgctccttccgtctttatttttccccctagcgatgaacagctgaagtctggaacggcctccgtggtttgcctcctgaataacttctatccgagagaggctaaggtgcagtggaaagtcgacaatgccctgcaaagcggcaactctcaggaatccgtgaccgagcaggatagcaaggactccacatactctctcagctccaccctgacacttagcaaagcggattatgagaagcacaaagtttacgcctgtgaagtgacccatcagggcctgtcttcccccgtcaccaagagcttcaatagaggggagtgc

SEQ ID NO: 38404 - RNA, 1356 nt, synthetic construct
  misc_feature 1..1356: note = derived and/or modified sequence opt5 from Daratumumab_HeavyChain1
  source 1..1356: mol_type = other RNA
gaggtgcagctgctcgaaagcggcgggggactggtccaacccggcgggtcccttagactgtcttgcgccgttagcggattcacctttaactccttcgctatgtcttgggtgcggcaggcccctggcaaggggctcgagtgggtgagcgcgatctccggatctggcggcgggacatactatgctgacagcgtcaaaggacgctttacgatttccagagataatagcaagaacaccctgtaccttcagatgaactctctgcgggccgaagacacagccgtgtatttctgtgctaaagataagatcctctggtttggcgagccggttttcgactactgggggcagggaaccctggtgacagtctccagcgcctctaccaaaggcccctccgtgtttcctctggctcccagctctaagtccacaagcgggggaaccgccgcgctcggctgcctggttaaggattatttccctgaacccgtgacggtctcctggaactctggcgcccttaccagcggggtgcacacatttcctgctgtgctgcaatccagcggactctactctctgtccagcgtcgttaccgtgccgtctagctcccttggcacacagacctatatttgtaatgtgaatcataaaccctctaatacgaaggtcgacaaacgcgtggagcctaagagctgcgataaaacacacacctgtcccccttgccccgccccggagctgctcgggggaccttccgttttcctgtttccccctaagcccaaggacacactgatgatcagcagaacccccgaagtgacctgtgtcgtggttgatgtgtctcatgaggaccctgaagtcaaattcaactggtacgtggatggcgtcgaggtgcacaatgctaagacaaaaccgcgggaggaacagtacaactccacgtatcgcgttgtgagcgtcctcaccgtgctgcatcaggactggcttaatgggaaggagtacaaatgcaaggtttctaacaaagccctgcccgcgcctattgaaaagacaatctccaaggccaaaggacaacccagagagcctcaggtgtataccctgcccccgagccgggaagagatgacaaagaatcaggtctccctcacctgtcttgtgaaaggcttttacccttctgatatcgctgtggagtgggaaagcaacggccagcccgagaataactataagacgacacctcccgttctggactccgacgggtctttcttcctctacagcaaactgaccgtcgataagtcccgctggcaacagggaaacgtgtttagctgctctgtgatgcacgaagccctgcacaatcattatacccagaagtccctcagcctgtctcctggcaaa

SEQ ID NO: 38405 - RNA, 642 nt, synthetic construct
  misc_feature 1..642: note = derived and/or modified sequence opt5 from Daratumumab_LightChain1
  source 1..642: mol_type = other RNA
gagatcgtgctgacccagagccccgccacactcagcctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctcccacctttggccaggggacaaaagtggagatcaagagaaccgtggctgccccttctgtcttcatttttccgccctccgatgaacagctcaaaagcggaacggcgtctgtggtttgcctgctgaacaatttctatcctcgggaggccaaggtgcaatggaaagtcgacaacgctctccagtccggcaatagccaggagtccgtgaccgaacaggattctaaggacagcacatactccctgagctctacccttacactgtccaaggccgattatgagaaacacaaggtttacgcttgtgaagtgacccatcaaggcctcagctctcccgtcacgaaatcctttaaccgcggggagtgc

SEQ ID NO: 38406 - RNA, 1350 nt, synthetic construct
  misc_feature 1..1350: note = derived and/or modified sequence opt5 from Dectrekumab_HeavyChain1
  source 1..1350: mol_type = other RNA
gaggtgcagctggtcgaaagcggcgggggagttgtgcagcccggcagatccctccggctgtcttgcgccgctagcgggttcaccttttcctcttacggaatgcactgggtgcgccaggcccctggcaaggggcttgagtgggtcgcgatcatttggtatgacggaagcaacaaatactatgctgattccgtgaagggcagattcacaatctctcgggacaatagcaaaaacacgctgtacctccagatgaatagcctgcgcgccgaagataccgccgtttattactgtgctagactttggtttggcgacctggatgccttcgacatttgggggcagggaacaatggtgaccgtcagctctgcttccacaaagggcccgagcgtgtttcccctcgccccttcttccaaaagcacctctgggggaacagcggccctgggctgcctggttaaggattatttccccgagcctgtgaccgtctcctggaacagcggggctctcacgtccggagtgcatacctttcccgccgtgctgcaatctagcggcctttactccctgagctctgtcgttacagtgccttccagctctctcggcacccagacatacatctgtaatgtgaaccacaagccgagcaataccaaagtcgacaagcgggtggaacccaaatcctgcgataagacgcatacatgtcctccctgccctgctcccgagctgcttgggggaccgtctgttttcctgtttcctcccaaacctaaggacaccctcatgattagccgcacacccgaggtgacctgtgtcgtggttgatgtgtcccacgaagaccccgaggtcaagttcaactggtatgtggatggcgtcgaagtgcataatgccaaaaccaagcctagagaggagcagtacaacagcacatatcgggttgtgtctgtcctgacggtgctgcaccaggactggctcaatgggaaagaatacaagtgcaaagtttccaacaaggcgctgccggcccccatcgagaaaaccatcagcaaggctaagggacaacctcgcgaaccccaggtgtatacacttcctccctctagagaggaaatgaccaaaaatcaggtctccctgacatgtctcgtgaagggcttttacccgagcgacattgccgtggagtgggagtccaacgggcagcctgaaaataactataaaaccacgccccctgttctggattctgacggatccttctttctttactccaagctgacagtcgataaatctcggtggcaacagggcaacgtgttcagctgctccgtgatgcacgaggctctccataatcactacacccaaaagagcctgtctctgtcccccggcaag

SEQ ID NO: 38407 - RNA, 648 nt, synthetic construct
  misc_feature 1..648: note = derived and/or modified sequence opt5 from Dectrekumab_LightChain1
  source 1..648: mol_type = other RNA
gagatcgtgctgacccagagccccgccacactctccctgtctcctggcgaaagagctattcttagctgccgggccgggcaatccgtctctagctacctggtttggtatcagcagaaaccgggacaggcgccccgcctcctgatctacgacgcttccaacagagccacgggcattcctgcccggttctctgggagcggatccggcaccgattttacacttaccatcagctctctggagcccgaagacttcgctgtgtattactgtcaacagcgctccagctggcctcccgtgtatacatttgggcagggaaccaaactcgagattaagagaacagtcgccgctccttctgtgttcatctttccgccctccgatgaacagctgaaaagcggcaccgcctctgttgtgtgcctgctcaataacttctaccctcgggaggcgaaggtccaatggaaagtggacaatgccctgcagtccggcaacagccaggagtccgttacggaacaggattctaaggacagcacctattcccttagctctacactgaccctctccaaggctgattacgagaaacacaaggtgtacgcctgtgaagtcacacatcaagggctgagctctcccgtgaccaagagctttaatcgcggagagtgc

SEQ ID NO: 38408 - RNA, 1332 nt, synthetic construct
  misc_feature 1..1332: note = derived and/or modified sequence opt5 from Demcizumab_HeavyChain1
  source 1..1332: mol_type = other RNA
caggtgcagctggtccagagcggcgccgaggttaagaaacccggggcttccgtgaagatctcttgcaaagccagcggatactccttcaccgcgtattacattcactgggtgaagcaggctcctggccaggggctcgaatggatcggatatatttctagctacaacggcgccacaaattataaccaaaaatttaaggggagagtcacgttcaccacagacacctccacatctaccgcctacatggagctgcggagccttcgctccgatgacacagctgtgtattactgtgccagagattacgactatgatgttggaatggactactggggccagggcaccctggtgacggtcagctctgcttccaccaaggggccgagcgtgtttcccctcgccccttgctctcggtccacaagcgaatctaccgcggccctgggatgtcttgttaaagattatttccccgagcctgtgacagtctcctggaatagcggcgctctgacctccggggtgcatacgtttcccgccgtgctccagtctagcggactgtactccctgagctctgtcgttacagtgccttccagcaacttcggcacccagacatatacctgcaatgtggaccacaagccgtctaacaccaaagtcgataagacagtggaacgcaaatgttgcgttgagtgtcccccttgccccgctcctcccgtggccgggccgagcgtctttctcttccctcccaagcctaaggacacgctgatgatctccagaacccccgaggtgacatgtgttgtggtcgatgtgtctcatgaagaccccgaggtccaatttaattggtacgtggatggagttgaagtgcacaacgcgaaaaccaagcctcgggaggagcagttcaatagcacatttcgcgtcgtgtccgttcttaccgtggtccatcaggactggctgaacggcaaagaatataagtgcaaagtgagcaataagggcctcccggcccccattgagaaaacgatctctaagacaaaggggcagcctagagaaccccaagtgtacaccctgcctccctcccgggaggaaatgaccaaaaaccaggttagccttacatgtctggtcaagggattctacccgtctgacatcgctgtggagtgggagtccaatggccagcctgaaaacaattataaaaccacaccccctatgctcgatagcgacgggtcctttttcctgtactctaagctgacggtggataaaagccgctggcaacagggaaacgtcttctcctgctctgtgatgcacgaggccctccacaaccattatacccaaaagagcctgtcccttagccccggc

SEQ ID NO: 38409 - RNA, 654 nt, synthetic construct
  misc_feature 1..654: note = derived and/or modified sequence opt5 from Demcizumab_LightChain1
  source 1..654: mol_type = other RNA
gacatcgtgatgacccagagccccgattccctggccgtctctctcggcgagagagctacaattagctgccgggcctccgaatctgttgacaactacgggatcagcttcatgaagtggtttcaacagaaacctggacagccgcccaagctgcttatttatgcggcttccaatcagggctctggggtgcctgatcgcttcagcggatccggcagcgggacggactttaccctgacaatctcttccctccaagccgaggatgtggccgtctactattgtcagcagagcaaagaagtgccctggaccttcggaggcggcacaaaggttgagattaaaagaaccgtggctgccccttctgtctttatctttcccccttccgacgaacagcttaagagcgggacagcttctgtggtttgcctgctgaacaatttctacccgcgggaggccaaggtgcaatggaaagtcgataacgcgctccagtccggaaatagccaggagtccgtgaccgaacaggactctaaggatagcacgtattccctgagctctaccctgacactctccaaagccgactacgagaagcacaaagtgtatgcttgtgaagtcacccatcaaggcctgagctctcccgttacaaagagcttcaaccgcggggagtgc

SEQ ID NO: 38410 - RNA, 1350 nt, synthetic construct
  misc_feature 1..1350: note = derived and/or modified sequence opt5 from Denintuzumab_mafodotin_HeavyChain1
  source 1..1350: mol_type = other RNA
caggtgcagctgcaggagagcggccccgggctcgtcaagccttcccagaccctgtctcttacatgcacggttagcggaggctccatctctaccagcgggatgggagtgggctggattagacagcacccggggaaaggactggaatggatcggccatatttggtgggacgatgacaagcggtacaaccccgccctcaaatcccgcgtgacaatctctgtcgataccagcaagaatcaattctccctgaaacttagctctgtgacagctgccgacaccgcggtttattactgtgctagaatggagctgtggtcctattactttgattattggggccaggggacactcgtgaccgtcagctctgcctccacgaagggacctagcgtgttccccctggccccttcttccaagagcacctccggcgggacagctgccctgggatgcctcgttaaagactactttcccgaacctgtgaccgtctcttggaacagcggcgctctgacatccggggtgcacaccttcccggccgtgcttcagagctctggactgtattccctcagctctgtcgttacggtgcccagctcctctctgggcacacagacctacatttgtaatgtgaaccataagcctagcaatacaaaagtcgataagaaagtggagcccaagtcctgcgacaagacccacacctgtcctccctgcccggcgcctgaacttctgggcgggcccagcgtttttctcttccctcccaaacccaaggatacactgatgatctctcggacgcctgaggtgacctgtgtcgtggttgacgtgtcccatgaggatccggaagtcaaatttaactggtacgtggacggagtcgaggtgcacaatgccaagacaaaaccccgcgaagaacaatataacagcacctacagagttgtgtctgtcctgacagtgctccaccaggattggctgaatggcaaggagtataaatgcaaggtttccaacaaggcccttcctgctcccatcgagaaaaccattagcaaggctaaagggcagcctcgggagccccaggtgtacacgctgccgccttcccgcgacgaactcacaaagaatcaagtctctctgacctgtcttgtgaaaggattctatcccagcgacatcgccgtggagtgggaatccaacggccagcctgagaataactacaagaccacaccccctgttctggattctgacgggagctttttcctctattccaagctgaccgtcgataaaagcagatggcagcaaggaaatgtgttttcttgctccgtgatgcatgaggcgctgcacaaccattacacacaaaagagcctctctctgtcccccggcaaa

SEQ ID NO: 38411 - RNA, 639 nt, synthetic construct
  misc_feature 1..639: note = derived and/or modified sequence opt5 from Denintuzumab_mafodotin_LightChain1
  source 1..639: mol_type = other RNA
gagatcgtgctgacccagagccccgccacactctccctgtctcctggcgaaagagctacgcttagctgctccgcctctagctccgtctcttacatgcactggtatcaacagaagccggggcaggcgccccggctgctcatttacgacaccagcaaactggcttccggaatccctgcccgcttcagcggctctgggtccggaacagattttacccttacaattagctctctggagcccgaagacgttgccgtgtattactgtttccagggctccgtgtatccttttaccttcgggcaaggaacaaagctcgagatcaaaagaaccgtcgctgcccccagcgtgtttattttccctccgtctgatgaacagctgaagtccggcacggctagcgttgtgtgcctgctcaacaatttttacccccgggaggccaaagtccagtggaaggtggacaacgcgctgcagtccggcaattctcaagagagcgttaccgaacaggattccaaggacagcacatattctctttccagcaccctgacactctctaaagccgattacgagaagcataaagtgtacgcttgtgaagtcacccaccaggggctgagctcccctgtgacgaagtctttcaaccgcggagagtgc

SEQ ID NO: 38412 - RNA, 1356 nt, synthetic construct
  misc_feature 1..1356: note = derived and/or modified sequence opt5 from Denosumab_HeavyChain
  source 1..1356: mol_type = other RNA
gaggtgcagctgctcgaaagcggcgggggactggtccaacccggcgggtcccttagactgtcttgcgccgctagcggattcaccttttcctcttacgccatgagctgggttcggcaggcgcctggcaaggggctcgagtgggtgtccggaatcacaggctctggcgggagcacgtattacgctgactccgtgaaaggacgcttcaccattagcagagataactctaagaatacactgtatcttcagatgaactccctgcgggccgaagacaccgccgtctactattgtgctaaagatccgggcacaaccgtgatcatgagctggtttgacccctgggggcagggaacactcgttaccgtgtcttccgccagcacgaagggcccttctgtcttccccctggctccttccagcaaatccacctctgggggaacagccgcgctgggctgcctcgtgaaggattactttcccgagcctgttaccgtgagctggaactccggcgccctgacaagcggggtccacaccttcccggctgtgcttcaatcttccggactgtatagcctctctagcgtggtcacggttccctcctctagcctgggcacacagacctacatttgtaatgtgaatcataagccttccaacacaaaagtggacaagaaagtcgaacccaagagctgcgataaaacccacacctgtcctccctgcccggcccctgagcttctcgggggaccctctgtgtttctgttccctcccaagcccaaggacacactgatgatctcccgcacgcctgaggttacctgtgtggtcgtggatgttagccatgaagacccggaggtgaaatttaattggtacgtcgatggcgtggaagtccacaacgctaagacaaaacccagagaggagcagtataattctacctaccgggtggtttccgtgctgacagtcctccatcaggactggctgaacgggaaggaatataaatgcaaggtgagcaataaagcccttcctgcgcccattgagaagaccatctccaaggccaaaggacaacctcgcgaaccccaggtttacacgctgccgccttctagagatgagctcacaaagaaccaggtgagcctgacctgtcttgtcaaaggcttctatccctccgacatcgctgtggaatgggagtctaatggccagcctgagaacaattacaagaccacaccccctgtgctggacagcgatgggtcctttttcctctatagcaaactgaccgttgacaagtctcggtggcaacagggaaacgtcttttcctgcagcgtgatgcacgaagccctgcacaaccattacacacagaagtctctctccctgagccccggcaaa

SEQ ID NO: 38413 - RNA, 645 nt, synthetic construct
  misc_feature 1..645: note = derived and/or modified sequence opt5 from Denosumab_LightChain
  source 1..645: mol_type = other RNA
gagatcgtgctgacccagagccccggcacactctccctgtctcctggggaaagagccacgcttagctgccgggcttcccaatctgtccgcggaagatacctggcctggtatcagcagaagccgggccaggcgccccggctcctgatttacggggctagctcccgcgccaccggaatccctgacagattctctggcagcgggtccggaacagattttacccttacaattagccggctggagcccgaagacttcgccgtgttttattgtcaacagtacgggtcttcccctcgcaccttcggccagggcacaaaagttgagatcaagagaaccgtggctgcccccagcgtctttattttccctccgtctgatgaacagctcaaatccggaacggctagcgtggtttgcctgctgaacaatttttatccccgggaggccaaggtgcaatggaaagtcgacaacgcgctccagtctggcaattcccaggagagcgtgaccgaacaggattccaaggactctacatacagcctgtccagcacccttacactgtctaaggccgattatgagaaacacaaggtttacgcttgtgaagtgacccatcaagggctctccagccctgtcacgaaatctttcaaccgcggagagtgc

SEQ ID NO: 38414 - RNA, 1338 nt, synthetic construct
  misc_feature 1..1338: note = derived and/or modified sequence opt5 from Depatuxizumab_HeavyChain1
  source 1..1338: mol_type = other RNA
caggtgcaactgcaggagagcggccccgggctcgtcaagccttcccagaccctgtctcttacatgcacggttagcggatactccatctctagcgacttcgcctggaactggattagacagccgcccggcaaagggctggaatggatgggatatatctcctactctggcaatacccggtatcaacctagcctcaagtcccgcattacaatcagcagagatacctctaaaaaccagtttttcctgaaacttaattccgtgacagctgccgacaccgcgacatactattgtgtgaccgctgggcggggatttccctactggggccagggcacgctggtcaccgtgagctctgcctccacaaaggggcctagcgttttccccctcgccccttcttccaagagcacctccggaggcacagctgccctggggtgcctggtgaaggattattttccggagcccgtcaccgtgtcttggaacagcggagctctcacgtccggcgttcacacattccctgccgtgctgcagagctctgggctttactccctgagctctgtcgtgaccgtgcccagctcctctctcggaacacaaacctacatttgtaatgtcaaccataaacctagcaataccaaggttgacaaaaaggtggaacccaaatcctgcgataagacacacacgtgtccgccttgccccgcgcctgagctgcttggcggccccagcgtgtttctgtttccccctaagccgaaagacaccctcatgatctctcgcacacccgaagtcacctgtgtggttgtggatgtctcccatgaggaccctgaggtgaagttcaactggtatgttgatggggtggaagtccacaatgccaaaacaaagcccagagaggaacagtacaacagcacctatcgggtggtctctgtgctgacggttctgcatcaggactggctcaatggaaaagagtacaagtgcaaagtgtccaacaaggctctgcctgcccccatcgagaagacaattagcaaagctaagggccagccgcgcgaacctcaagtctatacccttcccccttccagagatgagctgaccaaaaatcaggtgtctctcacatgtctggttaaggggttctaccccagcgacatcgccgtggaatgggagtccaacggacagcctgaaaataactataaaaccacacccccggtccttgattctgacggcagctttttcctgtactccaagctcacggtggacaagagccggtggcaacaggggaacgtgttttcttgctccgttatgcacgaggcgctgcacaatcattacacccagaaaagcctgtctctctcccctggaaag

SEQ ID NO: 38415 - RNA, 642 nt, synthetic construct
  misc_feature 1..642: note = derived and/or modified sequence opt5 from Depatuxizumab_LightChain1
  source 1..642: mol_type = other RNA
gacatccagatgacccaaagcccctcctctatgagcgtgtccgtcggcgatagagttacaattacgtgccactctagccaggacatcaactccaatattgggtggctgcagcagaaacctggaaaatctttcaagggcctcatctaccatgggaccaacctggatgacggagtgccgagccggttttccggcagcgggtctggaacagattatacccttacaatttccagcctgcaacccgaggacttcgccacctactattgtgtgcagtacgctcagtttccttggacattcggcggcgggaccaaactcgaaatcaagcgcacggtcgccgcgccctctgtgtttatcttccctccctccgatgagcagctgaaaagcggaaccgcttctgttgtgtgccttctgaataacttttatcctagagaagccaaggtccaatggaaggtggacaatgccctccagtccggcaacagccaggagtccgttacagaacaggattctaaagacagcacctactccctgagctctacactgaccctctccaaggctgattatgagaaacacaaggtgtacgcctgtgaggtcacgcatcaagggctgagctctccggtgacaaagagcttcaatcggggagaatgc

SEQ ID NO: 38416 - RNA, 1338 nt, synthetic construct; identical to SEQ ID NO: 38414
  misc_feature 1..1338: note = derived and/or modified sequence opt5 from Depatuxizumab_mafodotin_HeavyChain1
  source 1..1338: mol_type = other RNA

SEQ ID NO: 38417 - RNA, 642 nt, synthetic construct; identical to SEQ ID NO: 38415
  misc_feature 1..642: note = derived and/or modified sequence opt5 from Depatuxizumab_mafodotin_LightChain1
  source 1..642: mol_type = other RNA

SEQ ID NO: 38418 - RNA, 1329 nt, synthetic construct
  misc_feature 1..1329: note = derived and/or modified sequence opt5 from Dinutuximab_beta_HeavyChain1
  source 1..1329: mol_type = other RNA
gaggtgcagctgctccaaagcggccccgaactggagaagcctggggcctccgtcatgatctcttgcaaagctagcggatcctctttcaccggctacaacatgaattgggttagacagaacattggaaagagccttgaatggatcggggccattgacccgtattacggcgggacatcctataatcagaaatttaagggacgggcgacgctgaccgtggataaatctagctccacagcttacatgcacctcaagagcctgacctctgaggactccgccgtgtattactgtgtcagcggcatggaatattggggccaggggacatctgtgaccgtttccagcgcctctacaaagggaccctccgtgttccctcttgctcccagctccaaatctaccagcggcgggacggccgctctgggatgcctcgtcaaggattactttcctgagcccgtgaccgtttcctggaacagcggcgccctgacatctggggtgcataccttccctgcggtcctgcaatccagcggactctactctctgagctccgtggtgacagtcccgtctagctcccttggcacccagacgtatatctgtaatgttaaccacaaacccagcaatacaaaggtggacaaacgcgtggagcctaagtcttgcgataagacccatacatgtcccccttgccccgccccggaactgctcggcgggccttccgtctttctgtttccccctaaacccaaggacacccttatgattagcagaacccccgaggtgacatgtgttgtggtcgatgtgtctcacgaagaccctgaggttaaattcaactggtacgtggatggagtcgaggtgcataatgctaagacgaaaccgcgggaggaacagtataactccacctaccgcgtcgtgagcgttctgacagtgctccaccaggactggctgaatggcaaggaatataaatgcaaggtctccaacaaggccctgcccgctcctatcgagaaaaccatctctaaggccaaagggcaacccagagaacctcaggtgtacacactgcccccgagccgggaggagatgaccaagaatcaggtttccctcacgtgtcttgtgaaaggattctatccttctgatattgcggtcgaatgggagagcaacggccagcccgaaaataactacaagacaacccctcccgtgctggactccgatgggagctttttcctctactctaagctgaccgtggacaaatcccgctggcaacagggaaacgtttttagctgctctgtcatgcacgaggcccttcataatcactatacacagaagtccctgagcctctctcctggcaaa

SEQ ID NO: 38419 - RNA, 660 nt, synthetic construct
  misc_feature 1..660: note = derived and/or modified sequence opt5 from Dinutuximab_beta_LightChain1
  source 1..660: mol_type = other RNA
gagatcgtgatgacccagagccccgccacactgtccgtctctcctggcgaaagagctacgctcagctgccggtcctctcaaagcctggttcaccgcaacgggaatacctaccttcattggtatctgcagaagccgggacagtcccccaaactcctgattcacaaggtgtctaacagattcagcggcgtgcctgaccggttttccgggagcggatctggcacagatttcacccttaaaatctcccgcgtcgaggccgaagacctgggggtgtacttttgtagccagtctacacatgttccccctctcaccttcggagcgggcacaaagctggagctgaaaagaaccgtggctgccccctccgtctttattttccctccgagcgatgaacaactcaagtctggcacggcctccgtggtttgcctgcttaataacttttatccccgggaggctaaggtgcagtggaaagtcgacaatgccctgcagagcgggaactcccaggagtctgtgaccgaacaagatagcaaggactccacatacagcctctcttccaccctgacacttagcaaagctgattatgagaagcacaaagtgtacgcctgtgaagtcacccatcagggactgtctagccctgttacgaagtccttcaatcgcggcgagtgc

SEQ ID NO: 38420 - RNA, 1329 nt, synthetic construct; identical to SEQ ID NO: 38418
  misc_feature 1..1329: note = derived and/or modified sequence opt5 from Dinutuximab_HeavyChain1
  source 1..1329: mol_type = other RNA

SEQ ID NO: 38421 - RNA, 660 nt, synthetic construct; identical to SEQ ID NO: 38419
  misc_feature 1..660: note = derived and/or modified sequence opt5 from Dinutuximab_LightChain1
  source 1..660: mol_type = other RNA

SEQ ID NO: 38422 - RNA, 660 nt, synthetic construct; identical to SEQ ID NO: 38419
  misc_feature 1..660: note = derived and/or modified sequence opt5 from Dinutuximab_LightChain
  source 1..660: mol_type = other RNA

SEQ ID NO: 38423 - RNA, 1350 nt, synthetic construct
  misc_feature 1..1350: note = derived and/or modified sequence opt5 from Diridavumab_HeavyChain1
  source 1..1350: mol_type = other RNA
gaggtgcagctggtcgaaagcggcgctgaggttaagaaacccgggtcctctgtgaaggtgagctgcaaggcttccggaggccctttcagatcttacgccatcagctgggtccggcaagcgccggggcagggacccgaatggatgggcgggattatccctatttttggaaccacaaaatatgctcccaaattccagggccgcgtgacgatcaccgccgacgattttgccggcacagtttacatggagctctcctctctgagaagcgaagacaccgctatgtattactgtgccaagcacatggggtatcaggtgcgggagacaatggatgtctggggaaagggcaccacagtgaccgtttccagcgcttctacgaaagggccttccgtgttcccccttgcccctagctctaagtccaccagcggaggcacagcggccctggggtgcctcgtcaaagactactttccggagcccgtgaccgtgtcttggaactccggagctctgacaagcggcgtccataccttccctgccgttcttcaatcctctggcctgtatagcctctccagcgtggtgacggtcccctcttccagcctggggacacagacctacatttgtaatgtgaaccacaagccttctaatacaaaagttgataagcgcgtggaacccaagagctgcgacaaaacccatacctgtccgccttgccccgctcctgagctgctcggaggcccctccgtctttctgtttccccctaagccgaaagatacacttatgatctctagaacgcccgaagtgacctgtgttgtggtcgacgtgagccacgaggatcctgaggtcaagtttaactggtacgtggacggggttgaagtgcataatgccaaaacaaagccccgggaggaacagtataactccacctaccgcgtcgtgagcgttctgacagtgctccaccaggattggctgaatggaaaagagtataagtgcaaggtctctaacaaagcgcttcctgcccccatcgaaaagaccatttccaaagctaagggccaaccgagagagcctcaggtgtacacgctgccccctagccgggaggaaatgaccaaaaatcaggtgtctctcacatgtctggttaaggggttctatccctccgacatcgccgtcgagtgggaaagcaacggacagcctgagaataactacaagaccacacccccggtgctggattccgacggctctttcttcctctatagcaaactgaccgtggacaagtcccgctggcaacagggcaatgtcttttcttgcagcgtgatgcacgaagcccttcataaccactacacacagaaatccctgagcctctctcctggg

SEQ ID NO: 38424 - RNA, 651 nt, synthetic construct
  misc_feature 1..651: note = derived and/or modified sequence opt5 from Diridavumab_LightChain1
  source 1..651: mol_type = other RNA
cagagcgtgctgacccaacccccttccgtctctgccgctccgggccagaaggttacaatcagctgctccgggtctagctccaacattggaaatgactacgtgtcttggtatcagcagctccccggcacggcccctaaactgcttatctacgataacaataagagacccagcgggattcctgaccggttctccggaagcaaatctggcacctccgcgacactggggatcaccggactccaaacaggcgatgaggctaactattactgtgccacctgggaccgcagacccacagcctatgtggtctttggcgggggaaccaagctgacggtgcttggccagcctaaagctgccccgagcgttaccctgtttcccccttcttccgaggaactccaggctaataaggccacactggtgtgcctgattagcgatttctaccccggggcggtcaccgtggcctggaaggctgactcttcccctgttaaagccggagtggaaacaaccacgcccagcaagcagtccaacaataaatatgctgcctctagctacctctccctgacaccggagcaatggaaaagccaccggtcttactcctgtcaggtcacccatgaaggcagcacagtggagaagaccgtggcgcctaccgagtgctct

SEQ ID NO: 38425 - RNA, 1338 nt, synthetic construct
  misc_feature 1..1338: note = derived and/or modified sequence opt5 from Domagrozumab_HeavyChain1
  source 1..1338: mol_type = other RNA
gaggtgcagctgctcgaaagcggcgggggactggtccaacccggcgggtcccttagactgtcttgcgccgctagcggattcaccttttcctcttacgccatgagctgggttcggcaggcgcctggcaaggggctcgagtgggtgtccacaatctctagcggaggctcctatacgagctacccggactctgtgaaaggccgcttcaccatttccagagataacagcaagaatacactgtatcttcagatgaactctctgcgggctgaagacaccgccgtctactattgtgccaaacaggattacgctatgaattattgggggcaaggaacactcgtgaccgtttccagcgcctctacaaagggcccctccgtgtttcctctggctcccagctccaaatctaccagcgggggaacggccgcgctgggctgcctcgtcaaggactacttccctgagcccgtgaccgtttcctggaacagcggggccctgacatctggagtgcacacctttcctgctgtccttcagtccagcggcctgtactctctcagctccgtggtgacagtcccgtctagctccctgggcacccagacgtatatctgtaatgttaaccataagcccagcaatacaaaagtggataagaaagtggaacctaagtcttgcgacaaaacccacacatgtcccccttgccccgccccggaggctgccggggcgccttccgtcttcctttttccccctaagcccaaggataccctgatgattagccgcacccccgaggtgacatgtgttgtggtcgacgtgtctcatgaagatcctgaggttaaattcaactggtacgtggacggagtcgaagtgcacaatgccaagacgaaaccgagagaggagcagtataactccacctaccgggtcgtgagcgttctcacagtgctgcatcaagattggctgaatggcaaggaatataaatgcaaggtctccaacaaagctctccccgcccctatcgagaagaccatttctaaggctaaagggcagccccgcgaacctcaggtgtacacactgcccccgagcagagaggaaatgaccaagaatcaggtttcccttacgtgtctggtgaaaggattttatccttctgacatcgccgtcgagtgggagagcaacggccaacccgaaaataactacaagacaacccctcccgtgctcgattccgacgggagcttctttctgtactctaaacttaccgtggacaagtcccggtggcagcagggaaacgttttcagctgctctgtcatgcacgaggccctgcacaatcattatacacaaaagtccctcagcctgtctcctggcaaa

SEQ ID NO: 38426 - RNA, 1335 nt, synthetic construct
  misc_feature 1..1335: note = derived and/or modified sequence opt5 from Domagrozumab_HeavyChain
  source 1..1335: mol_type = other RNA
gaggtgcagctgctcgaaagcggcgggggactggtccaacccggcgggtcccttagactgtcttgcgccgctagcggattcaccttttcctcttacgccatgagctgggttcggcaggcgcctggcaaggggctcgagtgggtgtccacaatctctagcggaggctcctatacgagctacccggactctgtgaaaggccgcttcaccatttccagagataacagcaagaatacactgtatcttcagatgaactctctgcgggctgaagacaccgccgtctactattgtgccaaacaggattacgctatgaattattgggggcaaggaacactcgtgaccgtttccagcgcctctacaaagggcccctccgtgtttcctctggctcccagctccaaatctaccagcgggggaacggccgcgctgggctgcctcgtcaaggactacttccctgagcccgtgaccgtttcctggaacagcggggccctgacatctggagtgcacacctttcctgctgtccttcagtccagcggcctgtactctctcagctccgtggtgacagtcccgtctagctccctgggcacccagacgtatatctgtaatgttaaccataagcccagcaatacaaaagtggataagaaagtggaacctaagtcttgcgacaaaacccacacatgtcccccttgccccgccccggaggctgccggggcgccttccgtcttcctttttccccctaagcccaaggataccctgatgattagccgcacccccgaggtgacatgtgttgtggtcgacgtgtctcatgaagatcctgaggttaaattcaactggtacgtggacggagtcgaagtgcacaatgccaagacgaaaccgagagaggagcagtataactccacctaccgggtcgtgagcgttctcacagtgctgcatcaagattggctgaatggcaaggaatataaatgcaaggtctccaacaaagctctccccgcccctatcgagaagaccatttctaaggctaaagggcagccccgcgaacctcaggtgtacacactgcccccgagcagagaggaaatgaccaagaatcaggtttcccttacgtgtctggtgaaaggattttatccttctgacatcgccgtcgagtgggagagcaacggccaacccgaaaataactacaagacaacccctcccgtgctcgattccgacgggagcttctttctgtactctaaacttaccgtggacaagtcccggtggcagcagggaaacgttttcagctgctctgtcatgcacgaggccctgcacaatcattatacacaaaagtccctcagcctgtctcctggc

SEQ ID NO: 38427 - RNA, 642 nt, synthetic construct
  misc_feature 1..642: note = derived and/or modified sequence opt5 from Domagrozumab_LightChain1
  source 1..642: mol_type = other RNA
gacatccagatgacccaaagcccctcctctctgagcgcctccgtgggcgatagagtcacaattacgtgcaaggcttctcaggacgttagcaccgccgtggcgtggtaccagcagaaacctgggaaggctccgaaactcctgatctattccgcctcttaccggtatacaggagtgcccagccgcttctccggcagcgggtctggaaccgattttacacttaccatttccagcctgcaacctgaggacttcgccacatactattgtcagcagcactactctaccccctggacgtttggcgggggaaccaaggtcgaaatcaaaagaacagtggctgccccttccgttttcatttttccccctagcgatgagcagctcaagtctggcaccgcttccgtggtctgcctgcttaacaatttctatccgcgggaagccaaggtgcaatggaaagttgacaacgcgctgcagagcggcaattcccaggagtctgtgacagaacaggatagcaaggactccacctacagcctctcttccacgctgacactgagcaaagccgattacgagaagcataaagtctatgcttgtgaggtgacccaccaagggctctctagccccgtgacaaagtcctttaaccgcggagaatgc

SEQ ID NO: 38428 - RNA, 1335 nt, synthetic construct
  misc_feature 1..1335: note = derived and/or modified sequence opt5 from Drozituab_HeavyChain1
  source 1..1335: mol_type = other RNA
gaggtgcagctggtccaaagcggcgggggagttgaaagacccggcgggtccctccggctgtcttgcgccgctagcggattcacctttgacgattacgcctcctgggtgcgccaggcgcctggcaaggggcttgagtgggtgtctggaatcaactggcagggcggcagcacagggtatgctgactccgtcaaaggaagagtgacgatttctcgggataatgccaagaacagcctgtacctccaaaattccctgcgcgccgaagacaccgctgtttattactgtgccaaaatccttggcgctgggagaggatggtatttcgattactggggcaaggggacaaccgtgacagtcagctctgcctccaccaaaggaccgagcgtgtttcccctggcgccttcttccaagagcacatctggcggcaccgccgctctcgggtgcctggttaaggactatttccccgagcctgtgacggtctcctggaacagcggagccctgacctccggcgtgcacacatttcccgctgtgctccagtctagcgggctgtactcccttagctctgtcgttaccgtgccttccagctctctgggaacacagacctacatttgtaatgtgaaccataaaccgagcaatacgaaggtcgataaaaaggtggaacccaaatcctgcgacaagacacacacctgtcctccctgccctgcccccgagctcctgggcgggccgtctgttttcctttttcctcccaagcctaaagatacactgatcagccggacccccgaggtgacctgtgtcgtggttgacgtgtcccatgaagatcccgaggtcaagttcaactggtatgtggacggagtcgaagtgcacaatgcgaaaacaaagcctcgcgaggagcagtacaacagcacgtatagagttgtgtctgtcctcaccgtgctgcatcaggattggctgaatggcaaagaatacaagtgcaaagtttccaacaaggccctcccggctcccattgagaagacaatcagcaaagccaagggccaacctcgggaaccccaggtgtataccctgcctccctctcgcgaggaaacaaagaatcaggtctcccttacctgtctggtgaaggggttttacccgagcgacatcgctgtggagtgggagtccaacggacagcctgaaaataactataaaacgacaccccctgttctcgactctgatggcagcttctttctgtactccaaacttaccgtcgacaagtctagatggcaacaggggaacgtgttcagctgctccgtgcacgaggccctgcacaatcattacacccagaaaagcctctctctgtcccccgga

SEQ ID NO: 38429 - RNA, 639 nt, synthetic construct
  misc_feature 1..639: note = derived and/or modified sequence opt5 from Drozituab_LightChain1
  source 1..639: mol_type = other RNA
agcgagctgacccaggaccccgccgtgtccgtcgctctcggccaaacagttagaatcacgtgctctggggatagcctgcggtcctactatgcctcttggtaccagcagaagcctggacaggcgccggtgcttgtgatttatggcgctaacaatcgccccagcgggatccctgacagattctccggatctagctccggcaacaccgccagcctgacaattaccggggcccaagctgaagatgaggccgactactattgtaattctgctgattccagcggaaaccacgtcgtgtttggcggcgggacaaaactcaccgttctgggacagcccaaggccgcgccttctgtgacactttttcccccttccagcgaagaactgcaggccaataaagctaccctcgtctgcctgatctctgacttctacccgggcgccgtgacggttgcttggaaggccgattccagccccgtgaaagcgggggtcgaaaccacaaccccttccaagcagtctaacaataagtatgccgctagctcctacctgagcctcacacccgagcaatggaaatctcataagtcctacagctgtcaggtgacccacgagggatctacggtggagaaaacagtcgcccctaccgagtgcagc

SEQ ID NO: 38430 - RNA, 1353 nt, synthetic construct
  misc_feature 1..1353: note = derived and/or modified sequence opt5 from Drozitumab_HeavyChain1
  source 1..1353: mol_type = other RNA
gaggtgcagctggtccaaagcggcgggggagttgaaagacccggcgggtccctccggctgtcttgcgccgctagcggattcacctttgacgattacgccatgtcctgggtgcgccaggcgcctggcaaggggcttgagtgggtgtctggaatcaactggcagggcggcagcacagggtatgctgactccgtcaaaggaagagtgacgatttctcgggataatgccaagaacagcctgtacctccagatgaactccctgcgcgccgaagacaccgctgtttattactgtgccaaaatccttggcgctgggagaggatggtatttcgattactggggcaaggggacaaccgtgacagtcagctctgcctccaccaaaggaccgagcgtgtttcccctggcgccttcttccaagagcacatctggcggcaccgccgctctcgggtgcctggttaaggactatttccccgagcctgtgacggtctcctggaatagcggagccctgacctccggcgtgcacacatttcccgctgtgctccaatctagcgggctgtactcccttagctctgtcgttaccgtgccttccagctctctgggaacacagacctacatttgtaatgtgaaccataaaccgagcaatacgaaggtcgataaaaaggtggaacccaaatcctgcgacaagacacacacctgtcctccctgccctgcccccgagctcctgggcgggccgtctgttttcctttttcctcccaagcctaaagatacactgatgatcagccggacccccgaggtgacctgtgtcgtggttgacgtgtcccatgaagatcccgaggtcaagttcaactggtatgtggacggagtcgaagtgcacaatgcgaaaacaaagcctcgcgaggagcagtacaacagcacgtatagagttgtgtctgtcctcaccgtgctgcatcaggattggctgaatggcaaagaatacaagtgcaaagtttccaacaaggccctcccggctcccattgagaagacaatcagcaaagccaagggccaacctcgggaaccccaggtgtataccctgcctccctctcgcgaggaaatgacaaagaatcaggtctcccttacctgtctggtgaaggggttttacccgagcgacatcgctgtggagtgggagtccaacggacagcctgaaaataactataaaacgacaccccctgttctcgactctgatggcagcttctttctgtactccaaacttaccgtcgacaagtctagatggcaacaggggaacgtgttcagctgctccgtgatgcacgaggccctgcacaatcattacacccagaaaagcctctctctgtcccccggaaag

SEQ ID NO: 38431 - RNA, 639 nt, synthetic construct; identical to SEQ ID NO: 38429
  misc_feature 1..639: note = derived and/or modified sequence opt5 from Drozitumab_LightChain1
  source 1..639: mol_type = other RNA

SEQ ID NO: 38432 - RNA, 1353 nt, synthetic construct
  misc_feature 1..1353: note = derived and/or modified sequence opt5 from Duligotumab_HeavyChain1
  source 1..1353: mol_type = other RNA
gaggtgcagctggtcgaaagcggcgggggactcgttcaacccggcgggtccctgagactttcttgcgccgctagcggattcaccctgtccggcgactggatccactgggtgcggcaggcccctgggaagggactcgagtgggtgggcgaaatttctgcggctggcgggtacacagattatgccgacagcgtcaaaggacgctttacgatctccgccgatacctctaagaacacagcttacctgcagatgaatagccttagagccgaggacaccgctgtgtattactgtgcccgggaatcccgcgttagcttcgaggcggccatggattattggggccaggggacactggtgaccgtctcttccgctagcacaaaaggaccgtctgtgtttcccctcgccccttccagcaagtctacctccggcgggacggctgccctgggatgcctggttaaagactacttccccgagcctgtgaccgtcagctggaactccggcgcgctcacatctggcgtgcatacctttcccgccgtgctgcaaagctccgggctttatagcctgtcttccgtcgttacagtgcctagctctagcctcggaacccagacgtacatttgtaatgtgaaccacaagccgtccaatacaaaggtcgataaaaaggtggaacccaaatcttgcgacaagacccatacatgtcctccctgccctgctcccgagctgcttggcgggccgagcgttttcctgtttcctcccaaacctaaggataccctcatgatctccagaacccccgaagtgacatgtgtcgtggttgacgtgagccacgaggatcccgaggtcaagttcaactggtacgtggacggagtcgaagtgcataatgccaaaacgaagcctcgggaggaacagtataactctacctaccgcgttgtgtccgtcctgacagtgctgcaccaggattggctcaatggcaaagagtataagtgcaaagttagcaacaaggctctgccggcccccattgagaaaaccatctctaaggccaaggggcaacctagagaaccccaggtgtacacacttcctccctcccgggaggaaatgaccaaaaatcaggtcagcctgacgtgtctcgtgaagggattttatccgtccgacatcgctgtggagtgggaatctaacggccagcctgagaataactacaaaacaacaccccctgttctggacagcgatggctccttctttctttattctaagctgaccgtcgacaaaagccgctggcaacaggggaatgtgttctcctgcagcgtgatgcacgaagcgctccataaccactacacccagaagtctctgtccctgagccccggaaag

SEQ ID NO: 38433 - RNA, 642 nt, synthetic construct
  misc_feature 1..642: note = derived and/or modified sequence opt5 from Duligotumab_LightChain1
  source 1..642: mol_type = other RNA
gacatccagatgacccaaagcccctcctctctgagcgcctccgtgggcgatagagtcacaattacgtgccgggcttctcagaacatcgccaccgacgttgcgtggtaccagcagaagcctgggaaagctccgaagctcctgatttatagcgcctccttcctttactctggagtgcccagccgcttttccggcagcgggtctggaacagatttcaccctgacaatctccagcctccaacctgaggactttgccacctattactgtcagcagtctgaacccgagccttatacattcggccaggggaccaaagtggaaattaagagaacggtcgctgccccctccgtgtttatcttccctccgagcgatgagcaactgaaatctggaaccgcttccgttgtgtgccttctgaataacttttacccccgggaagccaaggtccagtggaaggtggacaatgcgctccagagcggcaactcccaggagtctgttacagagcaagatagcaaagactccacctatagcctgtcttccacactgaccctcagcaaggccgattacgaaaaacacaaggtgtacgcttgtgaggtcacgcatcagggcctgtctagccctgtgacaaaatccttcaatcgcggggaatgc

SEQ ID NO: 38434 - RNA, 1353 nt, synthetic construct; identical to SEQ ID NO: 38432
  misc_feature 1..1353: note = derived and/or modified sequence opt5 from Duligotuzumab_HeavyChain1
  source 1..1353: mol_type = other RNA

SEQ ID NO: 38435 - RNA, 642 nt, synthetic construct; identical to SEQ ID NO: 38433
  misc_feature 1..642: note = derived and/or modified sequence opt5 from Duligotuzumab_LightChain1
  source 1..642: mol_type = other RNA

SEQ ID NO: 38436 - RNA, 1353 nt, synthetic construct
  misc_feature 1..1353: note = derived and/or modified sequence opt5 from Dupilumab_HeavyChain1
  source 1..1353: mol_type = other RNA
gaggtgcagctggtcgaaagcggcgggggactcgagcaacccggcgggtccctgagactttcttgcgccggaagcggcttcacctttcgggactacgctatgacatgggttcgccaggcccctgggaagggactggaatgggtgtcctctatcagcggctccggcgggaacacgtattacgcggattctgtgaaaggaagattcaccattagccgggacaattccaagaacacactctatctgcagatgaatagccttcgcgctgaggataccgccgtctactattgtgccaaagacagactgtctatcacaattcggccgcgctactatggcctcgatgtgtgggggcagggaaccacagttaccgtgtccagcgcttctacgaagggcccctccgtctttcctctggccccctgcagcagatctacctccgaaagcacagctgccctggggtgtctcgtgaaagactacttccctgagcccgttaccgtgtcctggaactctggagcgctgacaagcggcgtccacacctttcctgccgtgcttcaatccagcggcctgtactctctctccagcgtggtcacggttccgtctagctccctggggacaaagacctatacatgcaatgtggatcataagccctctaacaccaaagtggacaagcgggtcgagagcaaatacggacctccctgtcctccctgcccggctcctgagttccttggcgggccctccgtgtttctgttccctcccaagcccaaagataccctcatgatcagccgcacacctgaggttacgtgtgtggtcgtggacgtttctcaggaagatccggaggtgcagtttaattggtatgtcgacggagtggaggtccacaacgccaagaccaagcccagagaagaacagttcaattccacataccgggtggttagcgtgctgaccgtcctgcatcaagattggctcaacggcaaagaatataagtgcaaagtgtctaataaggggctgccttccagcattgagaaaacaatctccaaggctaaaggacagccccgcgaacctcaggtttacacccttcccccgtctcaggaggagatgacgaagaaccaagtgagcctgacatgtctcgtcaagggcttttatccttccgacatcgccgtggaatgggagtctaatggccagcccgaaaacaattacaaaaccacccctcccgtgctggacagcgatgggtccttctttctttacagcagactgacagttgacaagtctcggtggcaggagggaaacgtcttctcctgcagcgtgatgcacgaagcgctccataaccactatacccaaaaatctctgtccctgagcctcggc

SEQ ID NO: 38437 - RNA, 657 nt, synthetic construct
  misc_feature 1..657: note = derived and/or modified sequence opt5 from Dupilumab_LightChain1
  source 1..657: mol_type = other RNA
gacatcgtgatgacccagagccccctgtccctccctgtcacaccgggcgagcccgcctctattagctgcagatcctctcaaagcctgctttactccatcgggtataactacctggattggtatctccagaagtctggacagagccctcagctgcttatttacctgggctccaatcgggctagcggggttcccgaccgcttctctggatccggcagcgggacggattttaccctcaaaatctctagagtggaagccgaggacgtgggattctattactgtatgcaagcgctgcagacaccttatacctttggccagggcacaaagctggaaattaaacggaccgtcgctgccccctccgtgttcatctttcctccgagcgatgagcagctcaagtctgggacagcctccgttgtgtgcctgcttaacaatttctacccccgcgaagctaaagtccaatggaaggtggacaacgccctgcagagcggaaattcccaggagtctgttaccgagcaggatagcaaggactccacgtacagcctctcttccaccctgacacttagcaaagctgattatgaaaagcacaaagtgtacgcctgtgaggtcacccatcaaggcctgtctagccctgtgacaaagtcctttaacagaggggaatgc

SEQ ID NO: 38438 - RNA, 1353 nt, synthetic construct
  misc_feature 1..1353: note = derived and/or modified sequence opt5 from Durvalumab_HeavyChain1
  source 1..1353: mol_type = other RNA
gaggtgcagctggtcgaaagcggcgggggactcgttcaacccggcgggtccctgagactttcttgcgccgctagcggattcaccttttcccggtactggatgtcttgggtgcgccaggcccctggcaaggggctggagtgggtggcgaacatcaaacaggacggaagcgaaaagtattacgtcgattccgtgaaaggcagattcacaatttctcgggacaatgctaagaacagcctctatctgcagatgaactcccttcgcgccgaggatacggccgtttactattgtgctagagaaggcgggtggtttggagagctggccttcgactactggggccaagggaccctcgtgacagtcagctctgcttccaccaaaggaccgagcgtgtttcccctggccccttcttccaagagcacatctggcgggaccgcggccctgggatgcctcgttaaggattatttccccgagcctgtgacagtctcctggaatagcggcgctctgacctccggcgtgcacacgtttcccgccgtgcttcagtctagcgggctgtactccctcagctctgtcgttaccgtgccttccagctctctgggaacacagacctacatctgtaatgtgaaccataaaccgagcaatacaaaggtcgacaaacgggtggaacccaagtcctgcgataaaacccacacgtgtcctccctgccctgctcccgagttcgaaggcgggccgtctgtttttcttttccctcccaagcctaaggacacactgatgattagccgcacccccgaggtgacatgtgtcgtggttgatgtgtcccatgaggaccccgaagtcaaatttaactggtatgtggatggagtcgaggtgcacaatgccaagaccaaacctagagaggaacagtacaacagcacctatcgggttgtgtctgtcctcacagtgctgcatcaagactggctgaatggcaaggaatacaaatgcaaggtttccaacaaagcgctcccggccagcatcgagaagacgatttctaaggctaaagggcagccccgcgagcctcaggtgtataccctgcccccttccagagaagagatgacaaagaatcaggtcagccttacctgtctggtgaaaggattctacccctccgatatcgccgtggaatgggagtctaacggccaaccggaaaataactataagacaacccctcccgttctcgacagcgacggctcctttttcctgtactctaaacttacggtcgataagagccggtggcagcaggggaacgtgttctcctgcagcgtgatgcacgaggctctgcacaatcattacacacaaaagtctctctccctgagccctggaaaa

SEQ ID NO: 38439 - RNA, 645 nt, synthetic construct
  misc_feature 1..645: note = derived and/or modified sequence opt5 from Durvalumab_LightChain1
  source 1..645: mol_type = other RNA
gagatcgtgctgacccagagccccggcacactcagcctgtctcctggggaaagagccacgcttagctgccgggcttcccaacgcgtctctagctcctacctggcctggtatcagcagaagccgggacaggcgcccagactcctgatttacgacgcttctagccgggccaccggcatccctgatcgcttctccgggagcggatctggcacagactttacccttacaatttccagactggagcccgaagatttcgccgtttattactgtcaacagtatgggagcctcccttggacctttggacagggcacaaaagtggagatcaagcggaccgtggctgccccctctgtcttcatttttcctccgtccgacgaacagctgaaaagcggcacggcttctgtggtttgcctgctcaacaatttctacccccgcgaggccaaggtgcaatggaaagtcgataacgcgctgcagtccgggaatagccaggagtccgtgaccgaacaggactctaaggatagcacatattcccttagctctaccctgacactctccaaggccgactacgagaaacacaaggtttacgcttgtgaagtgacccatcaaggactgagctctcctgtcacgaaatcctttaacagaggcgagtgc

SEQ ID NO: 38440 - RNA, 1338 nt, synthetic construct
  misc_feature 1..1338: note = derived and/or modified sequence opt5 from Dusigitumab_HeavyChain1
  source 1..1338: mol_type = other RNA
caggtgcaactggtccagagcggcgccgaggttaagaaacccggggcttccgtgaaggtgtcttgcaaagccagcggatacaccttcacatcctatgacatcaactgggtcagacaggcgacgggccaggggctcgaatggatgggatggatgaatcctaactctggcaataccgggtacgctcaaaagtttcagggacgggtgacaatgacccgcaacacaagcatttccaccgcctatatggagctgtctagccttagatccgaagatacagccgtttactattgtgctcgggacccgtactattactactatggcatggatgtgtggggccaggggaccacggtcaccgtgagctctgcctccacaaaaggacccagcgttttccctctggctccctgctctcgctccaccagcgagtctacagccgcgctcggctgtctggtgaaggactactttcctgaacccgtcaccgtgtcctggaatagcggggcccttacgtccggagtgcacacattccctgctgtcctgcagtctagcggcctctattccctgagctctgttgtgaccgtgccgtccagcaactttgggacacaaacctatacctgcaatgtcgatcataagccctctaacacaaaagtggacaagacggttgagagaaaatgttgcgtggagtgtcctccctgccctgctcccccggtcgccggacctagcgtgttcctgtttccccctaagcccaaagataccctcatgatctcccggacacccgaagttacctgtgtggtcgtggacgtctctcacgaggatcctgaagtgcagttcaattggtacgttgacggcgtggaggtccataacgccaagacaaagccgcgcgaggaacagtttaatagcaccttcagagtggtttccgtgctgacggtcgtgcaccaggattggcttaacggcaaagagtacaagtgcaaagtgagcaataaggggctgcccgcgcctattgaaaagacaatctctaagaccaaaggacaaccccgggagcctcaggtttataccctgcccccgtcccgcgaagagatgacaaagaaccaggtcagcctcacctgtcttgtgaagggcttttacccttctgacattgccgtggagtgggaatccaatgggcaacccgagaacaactacaaaacaacgcctcccatgctggatagcgacggatccttctttctctattctaagctgaccgtcgacaaaagcagatggcagcagggcaatgtgttctcctgctctgttatgcatgaagctctgcacaaccactacacacagaaaagcctctccctgagccctgggaaa

SEQ ID NO: 38441 - RNA, 651 nt, synthetic construct
  misc_feature 1..651: note = derived and/or modified sequence opt5 from Dusigitumab_LightChain1
  source 1..651: mol_type = other RNA
cagagcgtgctgacccaacccccttccgtctctgccgctccgggccagaaggttacaatcagctgctccgggtctagctccaacattgagaataaccacgtgtcttggtaccagcagctccccggaacggcccctaaactgcttatctatgacaataacaagagacccagcggcattcctgatcggttctccgggagcaaatctggaacctccgcgacactgggcatcaccgggctccaaacaggagacgaagctgattactattgtgagacctgggacacaagcctgtctgccggccgcgtgtttggcgggggaaccaaacttacggtcctgggccagcccaaagccgctccttccgtgaccctcttcccgcccagctctgaggaactgcaggccaataaggctacactggtttgcctcatttccgatttttaccctggggccgtgaccgtcgcgtggaaggccgacagctcccccgtgaaagctggagttgaaacaaccacgccttctaagcagagcaacaataaatatgccgcttccagctacctgtctcttacacccgagcaatggaagtcccatagaagctattcttgtcaggtgacccacgagggcagcacagtcgaaaagaccgtggccccgaccgagtgctcc

SEQ ID NO: 38442 - RNA, 1347 nt, synthetic construct
  misc_feature 1..1347: note = derived and/or modified sequence opt5 from Ecromeximab_HeavyChain1
  source 1..1347: mol_type = other RNA
gaggtgaccctggtcgaaagcggcggggacttcgttaagcccggaggctccctcaaagtgtcttgcgccgctagcgggtttgccttctcccactacgcgatgtcttgggtgagacagacgcctgctaagcggctggagtgggtcgcctatatcagctccggaggctctgggacatactatagcgattccgtgaaaggacgctttaccattagcagagacaacgccaagaatacactttacctgcaaatgcggtctctccgctccgaagatagcgctatgtatttctgtaccagagttaaactgggcacatactattttgactcttggggccaggggaccacacttaccgtgtccagcgcctctacgaagggaccgtccgtcttccccctggctcctagctccaagtctaccagcggcgggacagccgcgctcggatgcctggtgaaagattactttcccgagcctgttaccgtgtcctggaacagcggcgccctgacatctggggtccataccttccccgctgtgctccagtccagcggactgtactctcttagctccgtggtcacggttccttctagctccctgggcacacagacctatatctgtaatgtgaaccacaagccgagcaatacaaaagtggacaagaaagtcgaacccaagtcttgcgataagacccatacctgtcctccctgccctgcccccgagctcctgggcgggccgtccgtgtttcttttccctcccaaacctaaggacacactgatgattagccggacgcccgaggttacctgtgtggtcgtggatgtttctcacgaagaccccgaggtgaaatttaactggtacgtcgatggagtggaagtccataatgctaagacaaaacctcgcgaggagcaatataactccacctacagagtggttagcgtgctcacagtcctgcaccaggactggctgaatggcaaggaatataaatgcaaggtgtccaacaaggccctcccggcgcccatcgagaaaaccatttctaaggccaaagggcagcctcgggaaccccaggtttacacgctgcctcccagccgcgatgagcttacaaagaatcaagtgtccctgacctgtctcgtcaaaggattctatccgtctgacatcgctgtggaatgggagagcaacggccagcctgagaataactacaagaccacaccccctgtgctggactccgatgggagctttttcctttactctaagctgaccgttgacaaatccagatggcagcagggaaatgtcttcagctgctctgtgatgcacgaagccctccataaccactatacacaaaagtccctgagcctgtctcccggcaaa

SEQ ID NO: 38443 - RNA, 642 nt, synthetic construct
  misc_feature 1..642: note = derived and/or modified sequence opt5 from Ecromeximab_LightChain1
  source 1..642: mol_type = other RNA
gacatccagatgacccaaacagccagctccctgcccgcttctctcggcgatagagtgacgattagctgctccgcctctcaggacatcagcaactacctgaattggtatcagcagaagcctgatgggaccgtcaaacttctgattttctactcctctaacctccacagcggagttccgtcccggtttagcggcgggggatctggcacagactattccctgaccatcagcaatcttgagcccgaagatattgcgacatacttctgtcatcaatattctaagctgccttggacctttgggggaggcacaaaactcgagatcaagcgcaccgtggctgccccctccgtgttcatctttcctcccagcgacgaacagctgaaatctggcacggcctccgtcgtgtgcctgctcaacaatttctaccctagagaggctaaggttcagtggaaggtggataacgccctgcagagcggaaattcccaagaatctgtcaccgagcaggacagcaaagattccacatatagcctttcttccaccctgacactcagcaaggctgactacgagaaacacaaggtgtacgcctgtgaagttacccatcaggggctgtctagcccggtgacgaaatcctttaaccggggcgagtgc

SEQ ID NO: 38444 - RNA, 1341 nt, synthetic construct
  misc_feature 1..1341: note = derived and/or modified sequence opt5 from Eculizumab_HeavyChain1
  source 1..1341: mol_type = other RNA
gtgcagctggtccaaagcggcgccgaggttaagaaacccggggcttccgtgaaggtgtcttgcaaagccagcggatacatcttctccaactattggattcagtgggtcagacaggcgcctggccaggggctcgaatggatgggagagatcctgccgggctctgggagcaccgaatacacagagaattttaaggaccgggtgacgatgacccgcgatacatccacctctacagtttatatggaacttagctccctgagaagcgaggacaccgctgtgtactattgtgcccggtacttctttggatcttcccccaactggtatttcgatgtctggggccaaggcacactcgtgaccgttagctctgcctccacgaaagggcctagcgtgtttcccctggctccttgctctcgctccaccagcgagtccacagccgctcttggatgtctggtcaaggactacttccccgaacctgtgaccgtgtcttggaatagcggcgccctcacatccggggtccacacctttccggcggttctgcagagctctggactgtactccctcagctctgtggtgacggtccccagctccaacttcggcacacagacctatacatgcaatgtggatcataagccttctaacaccaaagttgacaagaccgtggagagaaaatgttgcgtcgaatgtcccccttgccccgccccgcctgtggctgggcccagcgtttttctgttccctcccaagcccaaagatacacttatgatttcccggacgcctgaggtgacctgtgtcgtggtcgacgtgagccaggaggatccggaagttcaatttaattggtacgtggacggagtcgaggtgcacaacgccaagacaaagccccgcgaggaacagttcaattctacctatagagttgtgtccgtcctgacagtgctccatcaggattggctgaacggcaaagaatacaagtgcaaagtgagcaataagggccttccttcttccatcgagaaaaccattagcaaggctaaagggcagccccgggagcctcaagtttatacgctgcccccgtcccaggaagagatgacaaagaaccaggtctctctcacctgtctggtgaagggattttaccctagcgacatcgccgtggaatgggagtccaatggccaacccgaaaacaattataaaaccacacctcccgtcctggattctgacgggagcttcttcctctactcccgcctgaccgtggacaagagcagatggcaggagggaaacgtgttttcttgctccgttatgcacgaggcgcttcataaccactacacacagaaaagcctgtctctctccctgggcaag

SEQ ID NO: 38445 - RNA, 642 nt, synthetic construct
  misc_feature 1..642: note = derived and/or modified sequence opt5 from Eculizumab_LightChain1
  source 1..642: mol_type = other RNA
gacatccagatgacccaaagcccctcctctctgagcgcctccgtgggcgatcgggtcacaattacgtgcggggcttctgagaacatctacggagccctcaattggtatcagcagaagcctggcaaagcgccgaagctgcttatttacggggctaccaacctggccgacggagttcccagccggttctccggctctgggagcggaacagattttaccctcacaatctccagcctgcagcctgaagacttcgccacctattactgtcaaaatgtgcttaacacacccctgacctttggccagggcacgaaagtggagattaagcgcaccgtcgctgccccttctgtgttcatctttcccccttccgatgaacagctcaaaagcgggacagcttctgttgtgtgcctgctgaataacttctatccgagagaggccaaggtccagtggaaggtggacaatgcgctccaatccggaaacagccaggaatctgttaccgagcaggattccaaagacagcacatactccctgtctagcacccttacgctgtccaaggccgattatgagaaacacaaggtgtacgcttgtgaagtcacacatcagggcctcagctctcccgtgaccaaatcctttaatagaggggagtgc

SEQ ID NO: 38446 - RNA, 375 nt, synthetic construct
  misc_feature 1..375: note = derived and/or modified sequence opt5 from Efalizumab_HeavyChain
  source 1..375: mol_type = other RNA
gaggtgcagctggtcgaaagcggcgggggactcgttcaacccggcgggtccctgagactttcttgcgccgctagcggatactccttcaccggccactggatgaactgggtgcggcaggcccctgggaagggactggagtgggtgggcatcatgattcatccgtctgacagcgaaacacgctataatcagaaatttaaggatatcagattcacgatttccgtcgacaaatctaagaacaccctctacctgcagatgaatagccttcgggcggaggatacagctgtgtattactgtgcccgcatcggcatttatttttacgggaccacatatttcgactacatctggggacaaggcaccctggttacagtgtccagc

SEQ ID NO: 38447 - RNA, 324 nt, synthetic construct
  misc_feature 1..324: note = derived and/or modified sequence opt5 from Efalizumab_LightChain
  source 1..324: mol_type = other RNA
gacatccagatgacccaaagcccctcctctctgagcgcctccgtgggcgatagagtcacaattacgtgccgggcttctaagaccatcagcaaatacctcgcctggtatcagcagaagcctgggaaagcgccgaagctgcttatttactccggatctacactgcagagcggcgttccctcccgcttcagcgggtctggatccggcaccgactttacactcaccatcagctctctgcaacctgaggatttcgctacatattactgtcagcagcacaacgaatatccccttacctttgggcagggaacgaaagtggagattaagaga

SEQ ID NO: 38448 - RNA, 768 nt, synthetic construct
  misc_feature 1..768: note = derived and/or modified sequence opt5 from Efungumab_SingleChain_variable_fragment
  source 1..768: mol_type = other RNA
atggccgaggtgcagctggtcgaaagcggcgctgaggttaagaaacccggggaatccctcagaatctcttgcaagggaagcggctgtattatctcctcttactggattagctgggtgcggcaaatgcctgggaaaggactggagtggatgggcaagatcgacccgggggattcctatattaactactctcccagcttccagggacacgtgaccatctccgccgacaaaagcatcaatacagcgtatcttcagtggaactctctgaaggcttccgatacggccatgtactattgcgcccgcggcggcagagactttggggatagcttcgactactggggacagggcaccctcgtcacagtgtcttccgggggaggcgggagcggaggcggcgggtctggaggcgggggatccgatgttgtgatgacccaaagcccttcctttctgtctgctttcgtcggcgaccggattacaatcacctgtcgcgccagctccgggattagcagatatcttgcttggtaccagcaggcccccggaaaggcgcctaaactgctcatctacgccgcttctacactgcagaccggcgtgccctcccggtttagcggctctgggagcggaacggagttcaccctgacaattaattccctccaacctgaagattttgccacctattactgccagcatctgaactcttatccgcttacattcggcgggggaaccaaggttgacatcaaacgcgctgccgcgctggagcaccatcaccatcaccac

SEQ ID NO: 38449 - RNA, 1362 nt, synthetic construct
  misc_feature 1..1362: note = derived and/or modified sequence opt5 from Eldelumab_HeavyChain1
  source 1..1362: mol_type = other RNA
cagatgcaactggtggagagcggcgggggagtcgttcagcccggcagatccctccggctgtcttgcaccgccagcgggttcacattttccaacaatggaatgcactgggtgcgccaggctcctggcaaggggcttgaatgggtggccgtcatctggttcgacggaatgaacaaattttacgtggattctgttaagggcagattcacgattagccgggacaattccaaaaacaccctgtatctcgagatgaatagcctgcgcgcggaagatacagctatctactattgtgccagagagggcgacgggtctggaatttactattactatggcatggatgtgtgggggcagggaaccacagtcaccgtgtccagcgcctctacaaagggcccgtccgtttttccccttgctcctagctctaaatccaccagcgggggaacggccgctctgggctgcctcgtgaaggactacttccccgaacctgtcaccgtgtcttggaactccggcgccctgacaagcggggtgcatacctttcccgcggtcctgcaatcctctggactctacagcctgtccagcgttgtgacagtgccttcttccagccttggcacccagacgtatatctgtaatgtcaaccacaagccgtctaatacaaaagtggataagcgggttgagcccaaaagctgcgacaagacccatacatgtcctccctgccctgcccccgagctgctcgggggaccgtccgtgttcctgtttcctcccaaacctaaggatacccttatgatttctcgcacccccgaagtcacatgtgtggttgtggacgtcagccacgaggatcccgaagtgaagttcaactggtacgtcgacggcgtggaggttcataatgctaaaacgaagcctagagaggaacagtataactccacctaccgggtggtcagcgtgctgacagttctccaccaggattggctgaatgggaaagagtataagtgcaaagtgtctaacaaggccctgccggctcccatcgagaaaaccatctccaaggccaagggacaacctcgcgaaccccaggtctacacactccctcccagcagagaagagatgaccaaaaatcaggtgtctctgacgtgtcttgtgaagggcttttatccgtccgacattgcggttgagtgggaaagcaacggccagcctgagaacaattacaaaacaacaccccctgtcctggactccgatgggtctttctttctctacagcaagctgaccgtggacaaatcccggtggcaacagggaaacgtgttctcttgcagcgtcatgcacgaagcccttcataatcactatacccagaagtccctgagcctctctcccggcaag

SEQ ID NO: 38450 - RNA, 648 nt, synthetic construct
  misc_feature 1..648: note = derived and/or modified sequence opt5 from Eldelumab_LightChain1
  source 1..648: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttcccctatctttaccttcggccccggcacaaaagtggatattaagagaaccgtggctgcccctagcgtctttatcttcccgccctctgacgagcagctcaaatccgggacggctagcgtggtttgcctgctgaacaatttttaccctcgggaagccaaggtgcagtggaaagtcgataacgcgctccaatccggaaattctcaggagagcgtgaccgagcaggactccaaggatagcacatattctctgtccagcacccttacactgtctaaggccgactacgaaaaacacaaggtttacgcttgtgaggtgacccatcagggcctcagctcccccgtcacgaaatctttcaaccgcggggaatgc

SEQ ID NO: 38451 - RNA, 1341 nt, synthetic construct
  misc_feature 1..1341: note = derived and/or modified sequence opt5 from Elgemtumab_HeavyChain1
  source 1..1341: mol_type = other RNA
gaggtgcagctgctcgaaagcggcgggggactggtccaacccggcgggtcccttagactgtcttgcgccgctagcggattcaccttttcctcttacgccatgagctgggttcggcaggcgcctggcaaggggctcgagtgggtgtccgctatcaactctcagggaaaaagcacatattacgccgactccgtgaagggccgcttcacgattagcagagataattctaaaaacaccctgtatcttcagatgaactccctgcgggccgaagacacagctgtctactattgtgcccgctggggcgatgaggggtttgacatctggggacaaggcaccctcgtgacagttagctctgcttccaccaaggggccgagcgtgttccccctggccccttcttccaaaagcacatccggaggcaccgcggccctggggtgcctcgtcaaggattactttcccgaacctgtgacggtttcttggaatagcggagctctgacctccggcgtgcacacattccccgccgtccttcagagctctggcctgtattccctcagctctgtggtgaccgtccctagctcctctctggggacacagacctacatttgtaatgttaaccataagccgagcaatacgaaagtggacaagagagtggagcccaaatcctgcgataagacacacacctgtcctccctgccctgctcccgagcttctgggaggcccgagcgtctttctcttccctcccaaacctaaggacacactgatgatctctcggacccccgaagtgacctgtgttgtggtcgatgtgtcccatgaggaccccgaagttaagtttaactggtacgtggatggggtcgaggtgcacaatgccaaaacaaagcctcgcgaggaacagtataacagcacgtacagagtcgtgtctgttctgaccgtgctccatcaagactggctgaatggaaaagagtataagtgcaaagtctccaacaaggcgcttccggcccccattgagaaaacaatcagcaaggctaagggccagcctcgggaaccccaggtgtacaccctgcctccctcccgcgaagagatgaccaaaaatcaggtttctctcacatgtctggtgaaggggttctatccgagcgatatcgccgtcgagtgggaatccaacggacaacctgagaataactacaaaacgacaccccctgtgcttgactctgacggcagctttttcctgtattccaagctcaccgtggataaaagcagatggcagcagggcaacgtcttttcttgctccgttatgcacgaagctctgcacaatcattacacccaaaagagcctgtctctctcccccgggaag

SEQ ID NO: 38452 - RNA, 642 nt, synthetic construct
  misc_feature 1..642: note = derived and/or modified sequence opt5 from Elgemtumab_LightChain1
  source 1..642: mol_type = other RNA
gacatccagatgacccaaagcccctcctctctgagcgcctccgtgggcgatagagtcacaattacgtgccgggcttctcaggggatcagcaactggctcgcctggtaccagcagaaacctggaaaagcgccgaagctgcttatttatggcgcttcctctctgcaaagcggggttccctcccgcttcagcggatctggctccgggaccgactttacactcaccatcagctctctgcagcctgaggatttcgccacatactattgtcagcagtactccagctttcccaccacattcggacaaggcaccaaagtggaaattaagagaacggtggccgctccttctgtctttatctttcccccttccgacgagcagcttaaaagcggcaccgcctccgtggtttgcctgctcaataacttctatccgcgggaagctaaggtgcagtggaaggtcgataatgccctgcagtctgggaacagccaagagtccgtgacagaacaggacagcaaagattctacctactccctgagctctacactcaccctgagcaaggcggactatgagaaacacaaggtttacgcctgtgaggtgacgcatcagggactttcctctcccgtcacaaagagcttcaatcgcggcgaatgc

SEQ ID NO: 38453 - RNA, 1347 nt, synthetic construct
  misc_feature 1..1347: note = derived and/or modified sequence opt5 from Elotuzumab_HeavyChain1
  source 1..1347: mol_type = other RNA
gaggtgcagctggtcgaaagcggcgggggactcgttcaacccggcgggtccctgagactttcttgcgccgctagcggattcgacttttcccggtactggatgtcttgggtgcgccaggcccctggcaaggggctggagtggatcggagaaattaacccggatagctccaccatcaattatgcgccctctctcaaagacaagttcattatcagcagagataacgctaaaaattccctgtaccttcagatgaacagcctgcgggccgaggacacagccgtgtattactgtgctcgccctgatggcaattattggtactttgacgtctggggccaggggacgctcgtgaccgtttcttccgccagcacaaagggaccctctgtgttccctctggctccctccagcaaatctacctccggcgggacagccgcgctgggatgcctcgtcaaggattattttcctgaaccggtgaccgttagctggaactccggcgccctgacatctggggtgcacaccttccccgctgtccttcaaagctccggactgtacagcctctcttccgtggtgacggtccctagctctagcctgggcacccagacatacatttgtaatgttaaccataagccctccaataccaaagtggacaagaaagtggagcctaagtcttgcgataaaacacacacctgtcccccgtgccctgcccccgagcttctgggcgggcctagcgtctttctcttcccgcccaagcctaaggacacgctgatgatctccagaacaccggaagtgacctgtgttgtggtcgatgtgagccatgaggaccccgaagttaaatttaactggtatgtggatggagtcgaggtgcacaatgctaagacaaaacctcgggaggaacagtacaactctacctatcgcgtcgtgtccgttctgaccgtgctccatcaggactggctgaatggcaaggagtacaaatgcaaggtcagcaacaaagcccttcccgcgcctatcgaaaagacaatttctaaggccaaagggcaacccagagagccccaggtgtatacgctgcctccctcccgggacgaactcaccaagaatcaggttagcctgacatgtcttgtgaaaggattctacccttccgatatcgctgtcgagtgggagtctaacggccagcccgaaaacaattataagaccacacctcccgtgctggacagcgatgggtcctttttcctctactctaaactgaccgtggacaagagccgctggcaacagggaaacgtcttttcctgcagcgttatgcacgaggccctgcacaatcattacacgcagaagtctctctccctgagcccgggcaaa

SEQ ID NO: 38454 - RNA, 642 nt, synthetic construct
  misc_feature 1..642: note = derived and/or modified sequence opt5 from Elotuzumab_LightChain1
  source 1..642: mol_type = other RNA
gacatccagatgacccaaagcccctcctctctgagcgcctccgtgggcgatagagtcacaattacgtgcaaggcttctcaggacgttgggatcgccgtggcgtggtaccagcagaaacctggaaaggtgccgaaactcctgatttattgggctagcacccggcacacaggcgtccccgatcgcttctccgggtctggaagcggcaccgactttacacttaccatctccagcctgcaacctgaggatgtggccacatactattgtcagcagtactcttcctatccctacaccttcgggcagggaacgaaggttgaaattaaaagaaccgtggccgctcctagcgtctttatctttcccccttctgacgagcaactcaagtccggcacagccagcgtggtttgcctgcttaacaatttctatccgcgggaagctaaggtgcagtggaaagtcgataacgccctgcagtctggcaattcccaggagagcgtgaccgaacaagactccaaggattctacatacagcctctccagcaccctgacgctgtctaaagcggactacgagaagcataaagtgtatgcctgtgaggtcacacaccaggggctctccagccccgttaccaagtctttcaaccgcggagaatgc

SEQ ID NO: 38455 - RNA, 1338 nt, synthetic construct
  misc_feature 1..1338: note = derived and/or modified sequence opt5 from Emactuzumab_HeavyChain1
  source 1..1338: mol_type = other RNA
caggtgcaactggtccagagcggcgccgaggttaagaaacccggggcttccgtgaaggtgtcttgcaaagccagcggatacaccttcacatcctatgacatctcttgggtcagacaggcgcctggccaggggctcgaatggatgggagtgatttggacggatggcgggaccaactacgctcaaaagctgcagggacgggttacaatgaccacagacaccagcacatccaccgcctatatggagcttcgctctctgagaagcgatgacacggccgtgtactattgtgctcgggatcagcgcctctactttgacgtctggggccagggcaccacagtgaccgtttccagcgcctctacaaaagggccgtccgtgttccccctggctcctagctctaagtccaccagcggaggcacggccgcgcttgggtgcctggtcaaggattattttcccgaacctgtgacagtgtcttggaactccggagccctcaccagcggcgtccacacattccccgctgttctgcaatcctctgggctgtacagcctctccagcgtggtgaccgtcccttcttccagcctgggaacccagacatacatctgtaatgtgaatcataaaccgtctaacacgaaggttgacaaaaaggtggagcccaaaagctgcgataagacccacacatgtcctccctgccctgcccccgaacttctgggcggcccgtccgtctttctcttccctcccaagcctaaagacaccctgatgatttctagaacacccgaggtgacctgtgttgtggtcgatgtgagccatgaggaccccgaagtcaagtttaattggtatgtggatggggttgaggtgcacaacgctaaaacgaagcctcgggaggaacagtacaattccacatatcgcgtcgtgagcgttcttaccgtgctgcatcaggactggctcaacggaaaagagtacaagtgcaaagtctctaataaggccctgccggcgcccatcgaaaagaccatttccaaagccaagggccaacctagagagccccaggtgtatacactgcctcccagccgggacgaactcaccaaaaaccaggtgtctctgacatgtcttgttaaggggttctacccgtccgatatcgctgtcgagtgggaaagcaatggacaacctgagaacaattataaaacgacaccccctgtgctggactccgatggcagctttttcctctactctaagctgaccgtggacaagtcccgctggcagcaggggaacgtcttttcttgcagcgtgatgcacgaggcccttcacaatcattacacccagaaatccctgagcctctctcccggaaag

SEQ ID NO: 38456 - RNA, 639 nt, synthetic construct
  misc_feature 1..639: note = derived and/or modified sequence opt5 from Emactuzumab_LightChain1
  source 1..639: mol_type = other RNA
gacatccagatgacccaaagcccctcctctctgagcgcctccgtgggcgatagagtcacaattacgtgccgggcttctgaggacgttaacacctacgtgagctggtatcagcagaagcctgggaaagccccgaagctcctgatctacgcggcttccaatcgctatacaggagtgccctctagattcagcggctccgggagcggaaccgattttacacttaccatttcttccctgcagcctgaagacttcgccacatactattgtcaacagagcttttcttaccccaccttcggccaggggacgaaactcgagatcaagcggaccgtcgccgctccttccgtgtttatttttccccctagcgatgaacagctgaaatctggaacagcctccgttgtgtgccttctgaacaatttctatccgcgcgaggctaaggtccaatggaaggtggacaacgccctccagagcggcaattcccaggaatctgttaccgagcaggatagcaaagactccacatacagcctgtcttccaccctgacgctcagcaaggcggattacgagaaacacaaggtgtatgcctgtgaagtcacacatcaaggcctgtctagccccgtgaccaaatccttcaacagaggggagtgc

SEQ ID NO: 38457 - RNA, 1323 nt, synthetic construct
  misc_feature 1..1323: note = derived and/or modified sequence opt5 from Emibetuzumab_HeavyChain1
  source 1..1323: mol_type = other RNA
caggtgcaactggtccagagcggcgccgaggttaagaaacccggggcttccgtgaaggtgtcttgcaaagccagcggatacaccttcacagactattacatgcactgggtcagacaggcgcctggccaggggctcgaatggatgggacgggtgaacccgaatcgcagaggcacgacctataaccaaaagtttgaggggcgggttacaatgaccacagatacctccacatctaccgcttacatggaactgcgcagccttagatccgacgatacggccgtgtattactgtgcccgggctaattggctggactattggggacagggcaccacagtcaccgtgtctagcgcctccacaaaaggccccagcgttttccctctcgctccctgctctcgctccaccagcgagtctacggccgcgctggggtgtcttgtgaaggattactttcctgaacccgtcacagtgtcctggaacagcggagccctgacctctggcgtgcatacattccctgctgtcctccagtccagcgggctgtactccctgtctagcgttgtgaccgtgccgtccagctctctcggaaccaagacatatacgtgcaatgtcgaccacaaaccctccaacaccaaggtggataaaagagttgagagcaagtacggccctccctgtcctccctgcccggcccctgaggctgccgggggaccctctgtgtttctgttccctcccaaacccaaggacacacttatgatcagccggacccctgaagtcacatgtgtggttgtggatgtctcccaggaggacccggaagtgcaatttaattggtatgtcgatggcgtggaggttcataacgcgaagaccaaaccccgcgaggaacagttcaattctacgtacagagtggtcagcgtgctgacagttctccaccaggactggctgaacggcaaggagtataaatgcaaggtgtccaataaagggcttcctagctctattgaaaagaccatctccaaagccaagggacagccccgggagcctcaagtctacaccctgcccccgagccaggaagagatgacaaagaaccaggtgtctctcacctgtctggtgaaaggcttttatccttccgatattgctgttgagtgggaaagcaatgggcaacccgagaacaattacaagacaacgcctcccgtcctggactccgacggatctttctttctctacagccgcctgaccgtggataaatccagatggcaggaaggcaacgtgttctcttgcagcgtcatgcatgaggcccttcacaaccactatacacagaagtccctgagcctctctctgggg

SEQ ID NO: 38458 - RNA, 645 nt, synthetic construct
  misc_feature 1..645: note = derived and/or modified sequence opt5 from Emibetuzumab_LightChain1
  source 1..645: mol_type = other RNA
gacatccagatgacccaaagcccctcctctctgagcgcctccgtgggcgatagagtcacaattacgtgctctgttagctcctctgtgagctccatctacctccactggtatcagcagaagcctgggaaagctccgaagctgcttatttacagcacctctaacctggcctccggagtgcccagccggttctctggctccgggagcggaacagactttaccctcacaatctcttccctgcagcctgaggatttcgcgacctattactgtcaagtctatagcggctacccccttacatttgggggaggcaccaaagtggaaattaagcgcacggttgctgccccttccgtgttcatctttcccccttctgacgagcagctgaaaagcggcaccgcctccgtcgtgtgcctcctgaataacttctatccgagagaagctaaggttcagtggaaggtggataatgccctgcagagcgggaactctcaagagtccgtcacagaacaggacagcaaagattctacctacagcctctcctctacactgacccttagcaaggctgactacgagaaacataaggtgtatgcctgtgaggtgacgcaccagggactgtccagccccgtcacaaaatcttttaatcggggcgaatgc

SEQ ID NO: 38459 - RNA, 1344 nt, synthetic construct
  misc_feature 1..1344: note = derived and/or modified sequence opt5 from Emicizumab_HeavyChain1
  source 1..1344: mol_type = other RNA
caggtgcaactggtcgagagcggcgggggactcgttcagcccggcgggtccctgagactttcttgcgccgctagcggattcaccttttcctactatgacatccagtgggtgcggcaggcccctggcaaggggctggaatgggtgtctagcatttccccgtctggacaaagcacatactatcgcagagaggtcaaaggccggttcacgatctcccgcgataacagcaagaataccctctacctgcagatgaactctcttagagcggaagacacagctgtgtattactgtgcccggcgcaccggcagagagtatgggggaggctggtactttgattactgggggcagggaacactggttaccgtgtccagcgcctctacaaaaggcccctccgtcttccctctcgctccctgcagccggtctacctccgaaagcacggccgctctggggtgtctggtgaaggactattttcctgagcccgttaccgtgtcctggaactctggagccctcacaagcggcgtccacaccttccctgcggtgctgcagtccagcggcctttactctctgtccagcgtggtcacagttccgtctagctccctcgggacccaaacgtatacatgcaatgtggatcataaaccctctaataccaaggtggacaagcgcgtcgagagcaaatacggacctccctgtcctccctgcccggcccctgaatttctgggcgggccctccgtgttcctttttcctcccaagcccaaagatacactgatgattagcagaacccctgaggttacctgtgtggtcgtggacgtttctcaggaagatccggaggtgcagttcaactggtatgtcgacggagtggaggtccacaatgctaagacaaaaccccgggaggaacagtacaactccacgtatcgcgtggttagcgtgctcaccgtcctgcatcaagattggctgaatggcaaggaatacaagtgcaaagtgtctaacaaggggctcccttccagcatcgagaaaacaatttccaaggccaaaggacagcccagagaacctcaggtttacaccctgcccccgtctcaaaaggagatgaccaaaaatcaggtgagccttacatgtctggtcaagggcttttatccttccgacatcgctgtggagtgggaatctaacggccagcccgagaataactacaagacgacacctcccgtgctcgatagcgacgggtccttctttctgtatagcaaacttaccgttgacaagtctcggtggcaggaaggaaatgtcttctcctgcagcgtgatgcacgaggccctgcataaccgctacacccaaaaatctctctccctgagccct

SEQ ID NO: 38460 - RNA, 1332 nt, synthetic construct
  misc_feature 1..1332: note = derived and/or modified sequence opt5 from Emicizumab_HeavyChain2
  source 1..1332: mol_type = other RNA
caggtgcaactggtccagagcggctccgagctcaagaaacccggggcctctgttaaggtgagctgcaaggcttccggatacaccttcacagacaacaatatggattgggtgagacaggcccctggccaggggctggaatggatgggagacatcaacacgcggtctggcgggagcatttataatgaggaatttcaagatcgcgtcatcatgaccgtggacaaatccacagataccgcgtacatggagctttctagcctgagatccgaagacacagctacctatcactgtgcccggcgcaaaagctacggatattacctcgatgagtggggcgagggcacactggttaccgtgtcttccgccagcacgaaggggccgtctgtcttcccccttgctccttgctccagaagcacctctgaatccacagccgctctgggatgtctcgtgaaggactattttcccgagcctgttaccgtgagctggaactccggcgccctgacatctggggtccataccttccccgcggtgctgcagagctccggactctacagcctgtcttccgtggtcacggttcctagctctagccttggcacacagacctacacatgcaatgtggatcacaaaccgtccaacaccaaggtggacaaacgggtcgaatctaagtatgggcccccttgtcccccttgccccgccccggagtttctgggaggccctagcgtgttcctctttccccctaaacccaaggataccctgatgatttcccgcacacccgaggttacgtgtgtggtcgtggacgttagccaggaagatcctgaggtgcaattcaattggtacgtcgacggcgtggaagtccataacgctaagaccaaaccgagagaggaacagtataattctacataccgggtggtttccgtgcttaccgtcctgcaccaggactggctcaacgggaaggagtataaatgcaaggtgagcaataaaggactgccctcttccatcgagaagacaattagcaaagccaagggccagcctcgcgaaccccaagtttacaccctgcctccctcccaggaggaaatgacgaagaaccaggtgtctctcacatgtctggtcaaagggttttatccgagcgatatcgctgtggagtgggaatccaatggacaacctgagaacaattacaagaccacaccccctgtgcttgactctgatggcagcttctttctgtactccaaactcaccgttgacaagagcagatggcaggaggggaacgtcttctcttgctccgtgatgcatgaagccctgcacaaccactatacccaggagagcctttctctgtccccc

SEQ ID NO: 38461 - RNA, 642 nt, synthetic construct
  misc_feature 1..642: note = derived and/or modified sequence opt5 from Emicizumab_LightChain1
  source 1..642: mol_type = other RNA
gacatccagatgacccaaagccccagctctctgagcgcctccgtgggcgatagagtcacaattacgtgcaaggcttctcggaacatcgagcgccagctcgcctggtaccagcagaaacctgggcaagcgccggaactgcttatttatcaggctagcagaaaggagtccggagttcccgaccggttctctggcagccgctacgggaccgattttacactgaccatctccagcctccagcctgaagacattgccacatattactgtcagcaatattctgatccccctctgaccttcggaggcgggacaaaagtggagatcaagagaaccgtggccgctccctccgtctttatcttccctccgagcgacgaacagcttaaatctggaacggcctccgtggtttgcctgctcaataacttttacccccgggaggctaaggtgcagtggaaggtcgataatgccctgcagagcggcaactctcaagagtccgtgaccgaacaggacagcaaagattccacatattctctgagctccaccctcacactgagcaaggcggactacgagaaacacaaggtttacgcctgtgaagtgacccatcagggcctttcttcccctgtcacgaaatccttcaatcgcggggagtgc

SEQ ID NO: 38462 - RNA, 1347 nt, synthetic construct
  misc_feature 1..1347: note = derived and/or modified sequence opt5 from Enavatuzumab_HeavyChain1
  source 1..1347: mol_type = other RNA
gaggtgcagctggtcgaaagcggcgggggactcgttcaacccggcgggtccctgagactttcttgcgccgctagcggattcaccttttcctcttactggatgagctgggtgcggcaggcccctggcaaggggctggagtgggtggcggaaatccgcctcaaatccgacaactatgctacacactacgccgagtctgtcaagggaagattcacgattagccgggatgactccaaaaatagcctgtatcttcagatgaactctctgcgcgccgaagataccgctgtgtactattgtacaggctactatgccgacgctatggattactggggccaggggaccctcgttacagtgtccagcgcctctaccaagggaccgtccgtctttcccctggcgcctagctctaaatccacaagcggcgggaccgccgctctgggatgcctcgtgaaggactacttccccgagcctgttacggtgtcctggaactctggcgccctgaccagcggggtccatacatttcccgctgtgcttcaatccagcggactgtattctctctccagcgtggtcaccgttccttctagctccctgggcacacagacctacatctgtaatgtgaatcacaagccgtctaacacgaaagtggataagaaagtcgagcccaagagctgcgacaaaacacatacctgtcctccctgccctgcccccgaacttctgggcgggccgtccgtgttcctctttcctcccaagcctaaggatacactgatgattagcagaacccccgaggttacctgtgtggtcgtggacgtttctcacgaagatcccgaggtgaaattcaattggtatgtcgacggagtggaggtccataacgcgaagacaaaacctcgggaggaacagtacaattccacgtatcgcgtggttagcgtgctgaccgtcctccaccaggattggctgaacggcaaggaatacaaatgcaaggtgtctaataaagcccttccggctcccatcgagaagacaatttccaaggccaaagggcaacctagagaaccccaggtttataccctgcctcccagccgggaggagatgacaaagaaccaggtgtccctcacctgtctggtcaaaggattttacccgtctgacatcgctgtggaatgggagagcaatggccagcctgaaaacaattacaagacgacaccccctgtgcttgactccgatgggtctttctttctgtatagcaaactcaccgttgacaagtcccgctggcaacagggaaacgtcttcagctgctctgtgatgcacgaggccctgcataaccactacacccagaagtccctgagcctctctcccggcaaa

SEQ ID NO: 38463 - RNA, 654 nt, synthetic construct
  misc_feature 1..654: note = derived and/or modified sequence opt5 from Enavatuzumab_LightChain1
  source 1..654: mol_type = other RNA
gacatccagatgacccaaagcccctcctctctgagcgcctccgtgggcgatagagtcacaattacgtgccgggcttctcagagcgtttccacctctagctactcctatatgcactggtaccagcagaagcctgggaaagccccgaagctcctgatcaaatatgcgagcaaccttgagtctggagtgccctcccgcttcagcggctctgggtccggaacagactttaccctgacaattagctctctccaacctgaagatttcgctacctactattgtcagcattcctgggagatcccctacacatttggcgggggaaccaaggtggaaattaaaagaacggtcgccgcccctagcgtgttcatctttcccccttccgacgagcagctgaagtctggcaccgctagcgttgtgtgccttctgaataacttctatccgcgggaagccaaggtccagtggaaagtggataatgctctccaatccggcaacagccaggagtctgttacagagcaggactccaaggatagcacctactctctgagctccacactgaccctctctaaagccgactacgaaaagcacaaagtgtatgcgtgtgaggtcacgcatcaggggctgagctcccccgtgacaaagagctttaatcgcggagaatgc

SEQ ID NO: 38464 - RNA, 1341 nt, synthetic construct
  misc_feature 1..1341: note = derived and/or modified sequence opt5 from Enfortumab_HeavyChain
  source 1..1341: mol_type = other RNA
gaggtgcagctggtcgaaagcggcgggggactcgttcaacccggcgggtccctgagactttcttgcgccgctagcggattcaccttttcctcttacaacatgaattgggtgcggcaggcccctggcaaggggctggagtgggtgagctatatctcctctagctccagcacaatttactatgcggactctgtcaaaggacgcttcacgatctccagagataacgctaagaatagcctctctctgcagatgaactcccttcgggacgaagataccgccgtgtactattgtgcccgcgcttactattacggcatggacgtttggggccaggggacaaccgtgacagtcagctctgcctccaccaaaggaccgagcgtgtttcccctggctccttcctctaagagcacatccggcgggaccgccgcgctcggatgcctggttaaagattacttccccgagcctgtgacggtcagctggaactctggcgccctgacctccggggtgcacacatttcccgctgtgctccaaagctctggactgtatagcctttcctctgtcgttaccgtgcctagctccagcctgggcacacagacctacatttgtaatgtgaatcataagccgtctaacacgaaggtcgacaaaagagtggaacccaagtcctgcgataaaacacacacctgtcctccctgccctgcccccgagctcctgggcgggccgagcgttttcctttttcctcccaagcctaaagacacactgatgatctctcggacccccgaggtgacctgtgtcgtggttgatgtgtcccatgaagaccccgaggtcaagttcaattggtatgtggatggagtcgaagtgcacaacgctaagacaaaacctcgcgaggagcagtacaatagcacgtatagagttgtgtccgtcctcaccgtgctgcatcaggactggctgaacggcaaggaatacaaatgcaaggtttctaataaagccctcccggcgcccattgagaagacaatcagcaaagccaaggggcaacctcgggaaccccaggtgtataccctgcctccctcccgcgaggaaatgacaaagaaccaggtctctcttacctgtctggtgaaaggattttacccgagcgatatcgctgtggagtgggagtccaatggccagcctgaaaacaactacaagacgacaccccctgttctcgacagcgacgggtctttctttctgtattccaaacttaccgtcgataagagcagatggcaacagggaaatgtgttctcttgctccgtgatgcacgaggccctgcacaaccattacacccagaaaagcctctctctgagccccggcaag

SEQ ID NO: 38465 - RNA, 642 nt, synthetic construct
  misc_feature 1..642: note = derived and/or modified sequence opt5 from Enfortumab_LightChain
  source 1..642: mol_type = other RNA
gacatccagatgacccaaagcccctcctctgtgagcgcctccgtcggcgatagagttacaattacgtgccgggcttctcaggggatcagcggatggctggcctggtaccagcagaagcctggcaaagcgccgaagttcctcatttatgctgcctccaccctgcaatctggggtgcccagccgcttttccggaagcggctctgggacagacttcacccttacaatctccagcctgcagcctgaggattttgccacctactattgtcagcaggctaactcttttccccctacattcggaggcggcaccaaagtggaaattaagagaacggtcgccgctccctccgtgttcatctttcctccgagcgacgagcaactcaaatctgggaccgcctccgttgtgtgcctgcttaataacttctacccccgggaagcgaaggtccagtggaaggtggataatgccctgcagagcggaaactcccaggagtctgttacagaacaagacagcaaagattccacctatagcctctcttccacactgaccctgagcaaggctgactacgagaaacacaaggtgtatgcctgtgaggtcacgcatcagggcctctctagccctgtgacaaaatcctttaatcgcggggaatgc

SEQ ID NO: 38466 - RNA, 1341 nt, synthetic construct; identical to SEQ ID NO: 38464
  misc_feature 1..1341: note = derived and/or modified sequence opt5 from Enfortumab_vedotin_HeavyChain1
  source 1..1341: mol_type = other RNA

SEQ ID NO: 38467 - RNA, 642 nt, synthetic construct; identical to SEQ ID NO: 38465
  misc_feature 1..642: note = derived and/or modified sequence opt5 from Enfortumab_vedotin_LightChain1
  source 1..642: mol_type = other RNA

SEQ ID NO: 38468 - RNA, 1356 nt, synthetic construct
  misc_feature 1..1356: note = derived and/or modified sequence opt5 from Enoblituzumab_HeavyChain
  source 1..1356: mol_type = other RNA
gaggtgcagctggtcgaaagcggcgggggactcgttcaacccggcgggtccctgagactttcttgcgccgctagcggattcaccttttcctctttcggcatgcactgggtgcggcaggcccctgggaagggactggagtgggtggcgtacatcagctccgactctagcgctatttattacgccgatacagtcaaaggccgctttacgatctccagagacaacgccaagaatagcctctatctgcagatgaactctcttcgggatgaagacaccgctgtgtactattgtggccgcgggagagagaatatttactatggatcccggctggattactggggccaggggacaaccgttacagtgagctctgcctccaccaaaggaccgagcgtcttccccctcgctccttcttccaagagcacatccggcgggaccgccgcgctgggatgcctggtgaaagactactttcccgaacctgttacggtgtcttggaacagcggcgccctcacctccggcgtccatacattccccgctgtgctgcaaagctctgggctttattccctgagctctgtggtcaccgttcctagctcctctctcggaacacagacctacatctgtaatgtgaaccacaagccgagcaatacgaaggtggataaacgcgtcgagcccaagtcctgcgacaaaacacatacctgtcctccctgccctgcccccgagctggtgggcgggccgagcgtttttcttctgcctcccaagcctaaagatacactcatgatttctagaacccccgaagtgacctgtgtcgtggttgacgtgtcccacgaggatcccgaagtcaagttcaactggtatgtggacggagtcgaggtgcataatgctaagacaaaacctccggaggaacagtacaacagcacgctgcgggttgtgtctgtcctgaccgtgctccaccaggattggctgaatggcaaggagtataaatgcaaggtttccaacaaagcccttcccgcgcctatcgaaaagacaatcagcaaagccaaggggcaaccccgcgagcctcaggtgtacaccctgcccccgtccagagaagagatgacaaagaatcaggtctctctcacctgtctggtgaaaggattttatcctagcgacattgctgtggagtgggaatccaacggccagcccgagaataactacaagacgacacctcttgttctggactctgatggcagcttctttctctactccaaactgaccgtcgacaagagccggtggcaacaggggaacgtgttctcttgctccgtgatgcacgaagccctgcataatcactatacccagaaaagcctctctctgtcccccggaaag

SEQ ID NO: 38469 - RNA, 642 nt, synthetic construct
  misc_feature 1..642: note = derived and/or modified sequence opt5 from Enoblituzumab_LightChain
  source 1..642: mol_type = other RNA
gacatccagctgacccaaagcccctccttcctctctgccagcgtgggcgatagagtcacaattacgtgcaaggcttcccagaacgttgacaccaatgtggcctggtaccagcagaaacctgggaaggcgccgaaagctctgatctattctgccagctaccggtattccggagtgccctctcgctttagcggctccgggagcggaacagatttcacccttacaatttcttccctgcaacctgaggactttgccacctactattgtcagcagtacaacaattatcccttcacatttggccaggggaccaagctcgaaatcaaaagaacggtcgctgcccctagcgtgttcatttttcccccttctgatgagcaactgaagtccggaaccgctagcgttgtgtgccttctgaacaatttctacccgcgggaagccaaggtccagtggaaagtggacaacgcgctccagtctggcaattcccaggagagcgttacagaacaagattccaaggactctacctacagcctgtccagcacactgaccctctctaaagccgattatgagaagcacaaagtgtacgcttgtgaggtcacgcatcagggcctgtccagccccgtgacaaagtcttttaaccgcggggaatgc

SEQ ID NO: 38470 - RNA, 1356 nt, synthetic construct
  misc_feature 1..1356: note = derived and/or modified sequence opt5 from Enokizumab_HeavyChain1
  source 1..1356: mol_type = other RNA
caggtgcaactggtccagagcggcgccgaggttaagaaacccgggtcctctgtgaaggtgagctgcaaggcttccggaggcaccttctcttactattggatcgaatgggtcagacaggcccctgggcagggactcgagtggatgggcgaaattctgccggggagcggaacaacgaaccccaatgagaaatttaaaggccgggtgaccatcacagcggacgaatccacctctacagcttacatggagcttagctccctgcgcagcgaggataccgccgtttattactgtgccagagctgactattacggctctgattatgtgaagttcgactactgggggcaaggaacactcgtcaccgtgtccagcgcctctacgaagggcccttccgtttttcccctggctcctagctctaaatccaccagcgggggaacagccgcgcttggctgcctggtgaaggattacttccccgaacctgtcaccgtgtcctggaactctggggccctcacaagcggagtgcacacctttccggctgtcctgcagtccagcggcctgtattctctctccagcgttgtgacggtgccctctagctccctgggcacacagacctacatttgtaatgtcaaccataaaccttctaatacaaaggtggacaaacgggttgagcccaagagctgcgataagacccacacctgtcctccctgcccggcccctgaacttctcgggggaccctccgtgttcctgtttcctcccaaacccaaggacacactgatgatcagccgcacgcctgaggtcacctgtgtggttgtggatgtctctcatgaggacccggaagtgaaattcaactggtatgtcgatggcgtggaggttcacaatgctaagacaaaacccagagaggaacagtacaactccacctatcgggtggtcagcgtgcttacagttctgcatcaagactggctcaatgggaaggaatacaaatgcaaggtgtctaacaaggccctgcctgcgcccattgagaaaaccatctccaaggccaaaggacagcctcgcgagccccaggtctatacgctgccgcctagcagagaagagatgacaaagaatcaggtgtccctcacctgtctggtgaaaggcttttacccctctgatatcgctgttgaatgggagagcaacgggcaacctgaaaataactacaagaccacaccccctgtccttgactccgacggatctttctttctgtatagcaagctcaccgtggataaatcccggtggcagcagggcaatgtgttcagctgctctgtcatgcacgaggccctgcacaaccattacacacaaaagtcccttagcctgtctcccggcaaa

SEQ ID NO: 38471 - RNA, 642 nt, synthetic construct
  misc_feature 1..642: note = derived and/or modified sequence opt5 from Enokizumab_LightChain1
  source 1..642: mol_type = other RNA
gacatccagatgacccaaagcccctcctctctgagcgcctccgtgggcgatagagtcacaattacgtgcaaggcttctcagcacgttatcacccatgtgacatggtaccagcagaaacctgggaaggccccgaaactcctgatttatggaaccagctactcctattctggcgtgcccagccggttctccgggagcggatctggcacagactttacccttacaatctccagcctgcaacctgaggatttcgcgacctactattgtcagcagttttacgaatatcccctcacgttcgggggaggcaccaaggtcgagattaaacgcacagtggctgccccttctgtttttatctttcccccttccgacgaacagcttaagagcggcaccgcctctgtggtctgcctgctgaacaatttctacccgagagaggctaaggtgcaatggaaagttgataacgccctccagtccgggaatagccaggaatccgtgacagagcaggactctaaggatagcacctactccctgagctctacgctgacactctccaaagctgactatgagaagcacaaagtctacgcctgtgaagtgacccatcaaggactgagctctcccgtgacaaagagcttcaaccggggcgagtgc

SEQ ID NO: 38472 - RNA, 612 nt, synthetic construct
  misc_feature 1..612: note = derived and/or modified sequence opt5 from Enokizumab_LightChain
  source 1..612: mol_type = other RNA
gacatccagatgacccaaagcccctcctctctgagcgcctccgtgggcgatagagtcacaattacgtgcaaggcttctcagcacgttatcacccatgtgacatggtaccagcagaaacctgggaaggccccgaaactcctgatttatggaaccagctactcctattctggcgtgcccagccggttctccgggagcggatctggcacagactttacccttacaatctccagcctgcaacctgaggatttcgcgacctactattgtcagcagttttacgaatatcccctcacgttcgggggaggcaccaaggtcgagattaaacgcacagtggctgccccttctgtttttatctttcccccttccgacgaacagcttaagagcggcaccgcctctgtggtctgcctgctgaacaatttctacccgagagaggctaaggtgcaatggaaagttgaatccgtgacagagcaggatagcaaggactccacctactctctcagctccacgctgacactgagcaaagccgattatgagaagcacaaagtctacgcttgtgaagtgacccatcaggggctctcttcccccgtgacaaagagcttcaaccggggagagtgc

SEQ ID NO: 38473 - RNA, 1356 nt, synthetic construct
  misc_feature 1..1356: note = derived and/or modified sequence opt5 from Enoticumab_HeavyChain1
  source 1..1356: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcagcttcctgtggtatgacggaacaaacaaaaattacgtggagtccgttaagggcagatttacgatctctcgggataacagcaaaaatatgctctatctggaaatgaactcccttcgcgcggaggacaccgctgtgtactattgtgccagagatcatgacttccggagcggctacgaagggtggtttgatccgtggggacagggcacactggtcaccgtgtcttccgccagcacaaaggggccctctgttttccctctcgctccctccagcaaatctacctccggaggcacagccgctctggggtgcctggtgaaggactattttcctgagcccgtcaccgtgagctggaactccggagccctcacgtctggcgtgcacaccttccctgcggtcctgcaaagctccggcctttacagcctgtcttccgttgtgacagtgccgagctctagcctcgggacccagacatacatttgtaatgtcaatcataagccctccaacaccaaagtggataagaaagttgagcctaagtcttgcgacaaaacgcacacatgtcccccttgccccgccccggaactgcttggaggccctagcgtgtttctgtttccccctaagcccaaggataccctcatgatctcccgcacacccgaggtcacctgtgtggttgtggacgtcagccatgaagatcctgaggtgaaattcaattggtatgtcgacggggtggaggttcacaacgctaagaccaaaccgagagaggaacagtacaattctacatatcgggtggtctccgtgctgacggttctgcaccaggattggctcaacggaaaggaatacaaatgcaaggtgagcaataaagccctgcccgctcctattgagaagaccatctctaaggccaaaggccaaccccgcgaacctcaggtctatacacttcccccgtccagagacgagctgaccaagaaccaggtgagcctcacatgtctggtgaaagggttctacccttccgacattgcggttgagtgggaatctaatggacagcccgagaacaactataagaccacgcctcccgtccttgatagcgacggctcctttttcctgtactctaaactcacagtggataagagccggtggcaacagggcaatgtgttctcctgcagcgtcatgcatgaagccctgcacaaccattacacccagaagtctctgtccctcagccctggg

SEQ ID NO: 38474 - RNA, 642 nt, synthetic construct
  misc_feature 1..642: note = derived and/or modified sequence opt5 from Enoticumab_LightChain1
  source 1..642: mol_type = other RNA
gagatcgtgctgacccagagccccgccacactcagcctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacaccgcagcaattggcctcccacctttggcgggggaacaaaagtggagatcaagagaaccgtggctgccccttctgtcttcatttttccgccctccgatgaacagctcaaaagcggcacggcgtctgtggtttgcctgctgaacaatttctatcctcgggaggccaaggtgcagtggaaagtcgacaacgctctccagtccggcaatagccaagagtccgtgaccgaacaggattctaaggacagcacatactccctgagctctacccttacactgtccaaggccgattatgagaaacataaggtttacgcttgtgaagtgacccaccaggggctcagctctcccgtcacgaaatcctttaaccgcggagagtgc

SEQ ID NO: 38475 - RNA, 1329 nt, synthetic construct
  misc_feature 1..1329: note = derived and/or modified sequence opt5 from Ensituximab_HeavyChain1
  source 1..1329: mol_type = other RNA
caagtgcaactgaaggagagcggccccgacctcgtcgccccttcccagtctctgagcatcacatgcacagtttccgggttctctcttagcaaatttggagtgaactgggtgagacagccgcccggcaaggggctggaatggctcggagtcatttggggcgatgggtccacgtcttacaatagcggactgatctcccggcttagcatttctaaagagaactccaagagccaggtgttcctgaaactcaattctctgcaagctgacgataccgccacatattactgtgttaagcctggcggcgactattgggggcacggaacctccgtgacagtcagctctgcgtccaccaagggccccagcgtgtttcctctggctccctcctctaaaagcacatccgggggaaccgccgccctcggctgcctggttaaggattacttccctgaaccggtgacggtcagctggaactctggggctcttacctccggagtgcatacatttcccgccgtgctgcagagctctggcccttatagcctctcctctgtcgttaccgtgcccagctccagcctgggcacacagacctacatctgtaatgtgaaccacaaaccttctaatacgaaggtcgacaaaaaggtggagcccaagtcctgcgataaaacacatacctgtccgccttgccccgctcctgaacttctcgggggacccagcgttttcctgtttccccctaagccgaaagacacactgatgatttctcgcacccccgaggtgacctgtgtcgtggttgatgtgtcccacgaggaccctgaagtcaagttcaactggtatgtggatggcgtcgaggtgcataatgccaaaacaaagcccagagaggaacagtacaacagcacgtaccgggttgtgtccgtcctgaccgtgctccaccaagactggctgaatgggaaagagtataagtgcaaggtttctaacaaagcgcttcctgcccccatcgaaaagacaatcagcaaagctaagggacagccgcgcgagcctcaggtgtacaccctgcccccttccagagatgaactcaccaaaaatcaggtctctctgacctgtcttgtgaagggcttttatcccagcgacattgccgtggagtgggaatccaacgggcaacctgagaataactacaagacgatgcccccggttctggacagcgatggatctttctttctctattccaaactgacagtcgacaagagccggtggcagcagggcaacgtgttctcttgctccgtgatgcacgaggctctgcataatcactacacccagaaaagcctctctctgagccctggcaag

SEQ ID NO: 38476 - RNA, 639 nt, synthetic construct
  misc_feature 1..639: note = derived and/or modified sequence opt5 from Ensituximab_LightChain1
  source 1..639: mol_type = other RNA
caggtggtcctgacccaaagccccgttatcatgtccgcctctcctggcgagaaagtgacaatgacgtgcagcgcttcctctagcatttcctacatgtattggtaccagcagaaaccggggacctctcccaagagatggatctatgacacaagcaaactcgcctccggagtgcctgcgcggttcagcggctctgggtccggaaccagctactctctgacaatttccaacatggaagctggcgatgccgccacctattactgtcaccagcgcgacagctatccctggacatttgggggaggcaccaatcttgagatcaagagaacggtcgctgccccttctgtgttcatttttcccccttccgatgaacaactgaaaagcggcaccgcttccgttgtgtgcctcctgaacaatttctacccgcgggaggccaaggtccagtggaaggtggacaacgcgcttcagtctgggaatagccaggaatccgttacagagcaagatagcaaagactctacctactccctgagctctacactcaccctgagcaaggccgattatgagaaacataaggtgtacgcttgtgaagtcacgcaccagggactgtcctctcccgtgacaaagagctttaaccgcggcgagtgc

SEQ ID NO: 38477 - RNA, 768 nt, synthetic construct; identical to SEQ ID NO: 38448
  misc_feature 1..768: note = derived and/or modified sequence opt5 from Ensituximab_SingleChain_variable_fragment
  source 1..768: mol_type = other RNA

SEQ ID NO: 38478 - RNA, 987 nt, synthetic construct
  misc_feature 1..987: note = derived and/or modified sequence opt5 from Entolimod_chain1
  source 1..987: mol_type = other RNA
atgagaggcagccaccatcaccatcaccatgggatggcctccatgaccggaggccagcaaatggggcgggacctgtacgatgacgatgacaaggatcccatggctcaggtgatcaacacaaattctctcagcctgcttacgcagaacaatctgaacaaatcccagtctagcctctcctctgccattgagcgcctgagctccggacttagaatcaatagcgcgaaggacgatgctgccggccaagccattgctaaccggttcacctctaatatcaaagggctgacacaggcctcccgcaacgctaatgacggaattagcatcgcccagaccacagaaggcgcgctcaacgagatcaataacaatctgcagagagtccgggaactgtctgttcaagccaccaacggcacaaattccgatagcgacctcaagtctattcaggatgagatccagcagcgcctggaagagattgacagagtgtccaaccaaacccagtttaacggggtgaaagtccttagccaggataatcaaatgaagatccaggtgggagctaacgacggcgagacgattaccatcgacctgcagaagattgatgttaaatccctcgggctggacggattcaatgtgaactctcctggcatcagcgggggaggcggcgggatccttgattccatgggaacactgattaatgaagacgccgctgccgcgaagaaaagcaccgccaacccgctcgcttctatcgattccgccctgagcaaggtcgacgctgtgcggtctagcctgggcgccattcagaatcgctttgattccgccatcacaaacctcgggaataccgttacgaaccttaattctgctagaagccggattgaggacgcggattatgccacagaagtgtccaacatgagcaaagctcaaatcctgcagcaggccggaacctctgtcctggcccaggctaatcaagtgccccagaacgtgctctccctgcttcgc

SEQ ID NO: 38479 - RNA, 1338 nt, synthetic construct
  misc_feature 1..1338: note = derived and/or modified sequence opt5 from Epratuzumab_HeavyChain
  source 1..1338: mol_type = other RNA
caggtgcaactggtccagagcggcgccgaggttaagaaacccgggtcctctgtgaaggtgagctgcaaggcttccggatacaccttcacatcttattggctccactgggtcagacaggcccctggccaggggctggaatggatcggatacattaacccgcggaatgactatacggagtacaaccaaaattttaaagataaagcgaccatcacagctgacgaaagcaccaacacagcctatatggagctttcctctctgcgcagcgaagataccgccttctacttttgtgctagacgggacattacaaccttctattggggccaggggacgctcgtgaccgtttccagcgcctctacaaagggaccctccgtgtttcctctggctcccagctctaagtccaccagcggcggcacagccgcgcttgggtgcctggtcaaagattacttccctgagcccgtgaccgtttcttggaactccggagccctcacgagcggcgtgcatacatttcctgctgtcctgcagtcctctgggctgtacagcctctccagcgtggtgaccgtcccgtcttccagcctgggaacacagacctatatctgtaatgttaatcacaagccctctaacaccaaagtggacaagaaagtggagcctaagagctgcgataagacacatacgtgtcccccttgccccgccccggaacttctgggcgggccttccgtcttcctctttccccctaaacccaaggacaccctgatgatttctcgcacacccgaggtgacctgtgttgtggtcgatgtgagccacgaagaccctgaggttaaattcaattggtacgtggatggagtcgaggtgcataacgctaagacaaaaccgagagaggaacaatataattccacctaccgggtcgtgagcgttcttacggtgctgcaccaggactggctcaacggcaaggaatataaatgcaaggtctctaataaggccctgcccgcgcctatcgagaaaacaatctccaaggccaaaggccagccccgcgaacctcaggtgtacaccctgcccccgagcagagatgagctcaccaagaaccaagtttctctgacatgtcttgtgaaagggttttatccttccgacattgctgtcgagtgggaaagcaatggacagcccgagaacaactacaagaccacacctcccgtgctggactccgatggctctttctttctctacagcaagctgacggtggacaaatcccggtggcagcaagggaatgttttctcttgcagcgtcatgcacgaagcccttcataaccactatacccagaagtccctgagcctctctcctggaaaa

SEQ ID NO: 38480 - RNA, 657 nt, synthetic construct
  misc_feature 1..657: note = derived and/or modified sequence opt5 from Epratuzumab_LightChain
  source 1..657: mol_type = other RNA
gacatccagctgacgcaaagcccctcctctctcagcgcctccgtgggcgatagagtcacaatgtcttgcaagagctcccagtctgttctgtacagcgctaaccacaaaaattatcttgcctggtaccagcagaagcctgggaaagcgccgaagctgctcatttattgggcttccacgcgggagagcggagtgccctctcgcttctccggcagcgggtctggaaccgactttacattcaccatctccagcctgcaacctgaagatattgccacatactattgtcatcagtacctttcttcctggacctttggccaggggacaaaagtggagatcaagagaaccgtcgccgctcccagcgtgttcatttttcctccctccgacgaacagctgaagtctggaacggccagcgttgtgtgcctcctgaacaatttctatcctcgggaggctaaagtccaatggaaggtggataacgccctgcagtccggcaatagccaggaatctgttaccgagcaggactccaaagatagcacatactctctcagctccaccctgacactttctaaggcggactacgagaaacacaaggtgtatgcctgtgaagtcacccatcaaggcctgagctccccggtgaccaagagctttaaccgcggggagtgc

SEQ ID NO: 38481 - RNA, 762 nt, synthetic construct
  misc_feature 1..762: note = derived and/or modified sequence opt5 from Eptacog_beta_HeavyChain1
  source 1..762: mol_type = other RNA
atcgtgggcgggaaggtctgccccaagggagagtgtccttggcaggttctgctcctggtgaacggcgcccaactttgcgggggaaccctgattaatacaatctgggtggtcagcgctgcccactgtttcgacaagattaaaaactggagaaatctcatcgcggtgctgggcgaacatgatctttccgagcacgacggggatgaacagtctcggcgcgttgctcaggtgattatcccgagcacgtacgtccccggaaccacaaaccatgacatcgccctgctcagactgcaccagcctgtggttctgaccgatcatgtggtccccctctgcctgcctgagcggacattttccgaacgcacccttgccttcgtgagattttctctggtgagcggctggggccaactcctggaccgcggggctacagcccttgagctgatggtcctcaatgttccccggctgatgacccaggattgtctgcagcagtccagaaaggtgggagactctcctaacattacggagtatatgttctgcgctggctacagcgatgggtccaaagacagctgtaagggagattctggcgggccgcacgccacccactatcggggaacatggtacctcaccggcatcgtgtcctggggccaagggtgcgcgacagtcggacattttggcgtgtatacccgcgttagccagtacattgaatggctgcagaaacttatgagatctgagccccggcctggggtgctgctccgcgcccccttccct

SEQ ID NO: 38482 - RNA, 456 nt, synthetic construct
  misc_feature 1..456: note = derived and/or modified sequence opt5 from Eptacog_beta_LightChain1
  source 1..456: mol_type = other RNA
gccaacgctttcctggaggaactcagacccggcagcctggagcgggaatgcaaggaggaacagtgttcctttgaggaggcccgcgaaatcttcaaagacgcggagagaaccaagctgttttggatttcttacagcgatggggaccaatgcgcttcctctccttgtcagaatggaggcagctgcaaagatcagcttcagtcctatatctgtttctgcctcccggcctttgaagggcggaactgtgagacacacaaggacgatcaactgatttgcgtgaatgagaacggaggctgtgaacagtactgctctgaccatacggggaccaaacgcagctgtagatgccacgagggatattcccttctggccgatggcgtcagctgcacacccaccgttgaatacccttgtggcaagatccccattctcgagaagcggaatgcttctaaacctcaggggcgc

SEQ ID NO: 38483 - RNA, 708 nt, synthetic construct
  misc_feature 1..708: note = derived and/or modified sequence opt5 from Erlizuab_HeavyChain1
  source 1..708: mol_type = other RNA
gaggtgcagctggtcgaaagcggcgggggactcgttcaacccggcgggtccctgagactttcttgcgccaccagcggatacacattcacggagtatacccactggcggcaggctcctggcaaggggctggaatgggtggccggaatcaacccgaaaaatggcggcacatcccataaccagcgctttgacagattcaccatttctgtggataagagcacatccaccgcgtaccagaatagcctccgggctgaggacacagccgtctattactgtgcccgctggagagggctgaactatggatttgatgtgcggtacttcgacgtttggggccaagggacccttgtgacggtcagctccgctagcaccaaaggaccctctgtgtttcctctggccccctccagcaagtctacatccggcgggaccgctgccctcggatgcctggttaaagattatttccctgaacccgtgacagtcagctggaactctggcgcgctgacctccggcgtgcacacgtttcctgccgtgctccagagctccgggctgtactctcttagctccgtcgttacagtgccgtcttcttccctgggaacccagacatacatctgtaatgtgaatcataagcccagcaacaccaaggtcgacaaaaaggtggagcctaaatcttgcgataagacccacacatgtcccccttgccccgctccggagctc

SEQ ID NO: 38484 - RNA, 639 nt, synthetic construct
  misc_feature 1..639: note = derived and/or modified sequence opt5 from Erlizuab_LightChain1
  source 1..639: mol_type = other RNA
gacatccagacccaaagcccctcctctctgagcgcctccgtgggcgatagagtcacaattacgtgccgggcttctcaggacatcaacaattacctcaactggtatcagcagaagcctgggaaagccccgaagctgcttatttactataccagcacactgcactccggagttccctctcgcttcagcggctccgggagcggaaccgattacacactcaccatctcttccctgcaacctgaggactttgcgacatattactgtcagcagggcaatacccttccccctacgttcgggcagggaaccaaagtggaaattaagagaacagtggctgcccccagcgtctttatcttccctccgtctgatgagcaactgaaatccggcaccgccagcgtggtttgcctcctgaacaatttttatccccgggaagctaaggtgcagtggaaggtcgacaacgccctgcagtctggcaattcccaggagagcgtgacagaacaagattccaaagactctacctacagcctctccagcacgctgacactttctaaggctgattacgagaaacataaggtttatgcctgtgaggtgacccaccaggggctgtccagccctgtcacaaaatctttcaaccgcggagaatgc

SEQ ID NO: 38485 - RNA, 1341 nt, synthetic construct
  misc_feature 1..1341: note = derived and/or modified sequence opt5 from Etaracizumab_HeavyChain1
  source 1..1341: mol_type = other RNA
caggtgcaactggtcgagagcggcgggggagttgtgcagcccggcagatccctccggctgtcttgcgccgctagcgggttcaccttttcctcttacgacatgagctgggtgcgccaggcccctggaaagggccttgaatgggtcgcgaaagtgtcctctgggggaggcagcacatattacctggatacggttcagggcagattcaccatctcccgggacaacagcaagaatacactctatctgcaaatgaactctcttcgcgctgaggataccgccgtgtactattgtgccagacatctgcacgggtcctttgctagctggggacagggcacaaccgtcacagtgtcttccgccagcaccaaagggccgtctgttttccccctcgctccttccagcaagtccacgtctggaggcaccgccgcgctggggtgcctggtgaaagactactttcccgaacctgtcacagtgagctggaactccggagccctcaccagcggcgtgcacacattccccgctgtcctgcagtcttccggcctttatagcctgtctagcgttgtgaccgtgccttcctctagcctcgggacgcagacatacatttgtaatgtcaatcataagccgtccaacaccaaggtggataaacgggttgagcccaagagctgcgacaaaacacacacctgtcctccctgccctgcccccgaactgcttggaggcccgtctgtgtttctgttccctcccaagcctaaagataccctcatgatctcccgcacacccgaggtcacgtgtgtggttgtggacgtcagccatgaggatcccgaagtgaagtttaattggtacgtcgacggggtggaggttcacaacgctaagaccaaacctagagaggaacaatataattctacataccgggtggtctccgtgctgaccgttctgcaccaggattggctcaacggaaaggagtataaatgcaaggtgagcaataaagccctgccggcgcccattgaaaagacaatctccaaagccaagggccagcctcgcgagccccaggtctacacccttcctccctctagagaagagatgacgaagaaccaagtgagcctgacatgtctcgtgaaagggttctatccgtccgacattgctgttgaatgggagtctaatggacagcctgagaacaattacaagaccacaccccctgtcctggatagcgacggctcctttttcctttatagcaaactgaccgtggacaagtctcggtggcagcaaggcaacgtgttttcctgcagcgtcatgcatgaagccctccacaaccattacacccagaaatctctgtccctgagccccgggaag

SEQ ID NO: 38486 - RNA, 642 nt, synthetic construct
  misc_feature 1..642: note = derived and/or modified sequence opt5 from Etaracizumab_LightChain1
  source 1..642: mol_type = other RNA
gagatcgtgctgacccagagccccgccacactctccctgtctcctggcgaaagagctacgcttagctgccaagcctcccagtctattagcaacttcctgcactggtaccagcagcggccggggcaagcgccccgcctcctgatcagatatcggtcccagtctattagcggaatccctgctcgcttttccggcagcgggtctggaaccgacttcacacttaccatttccagcctggagcccgaagattttgccgtctactattgtcagcagtctggctcctggcctctcacattcgggggaggcaccaaggttgagatcaaaagaacagtggccgctcccagcgtgtttatcttccctccgtctgacgaacaactgaagtccggcaccgccagcgtcgtgtgcctgctcaataacttttacccccgggaggctaaagttcagtggaaggtggataatgccctgcagtccgggaactctcaggagagcgtcacggaacaagactccaaagatagcacctattctctttccagcacactgaccctctctaaggcggactacgagaagcataaagtgtatgcctgtgaagttacacaccagggactgagctcccctgtgaccaagtctttcaatcgcggcgagtgc

SEQ ID NO: 38487 - RNA, 1326 nt, synthetic construct
  misc_feature 1..1326: note = derived and/or modified sequence opt5 from Etrolizuab_HeavyChain1
  source 1..1326: mol_type = other RNA
gaggtgcagctggtcgaaagcggcgggggactcgttcaacccggcgggtccctgagactttcttgcgccgctagcggattctttatcaccaacaattactggggctgggtgcggcaggcccctgggaagggactggagtgggtgggctatatttcctactctggcagcacatcctataacccgtctctcaaaagccgcttcacgatctccagagacaccagcaagaatacattttacctgcagaactctcttcgggcggaagataccgctgtctattactgtgcccgcacagggtccagcggatatttcgacttttggggccaggggaccctggtgacagtttcttccgccagcaccaaaggaccctctgtgttccctctcgctccctccagcaagtccacgtctggcgggaccgccgctctgggatgcctggtcaaagattactttcctgagcccgtgacagttagctggaactccggcgccctcaccagcggcgtgcacacattccctgcggtcctgcaatcttccgggctttacagcctgtctagcgtggtgaccgtcccgtcctctagcctcggaacgcagacatatatttgtaatgttaatcataagccctccaacaccaaggtggacaaaaaggtggaacctaaaagctgcgataagacacacacctgtcccccttgccccgccccggagctgcttggcgggccttctgtctttctgtttccccctaaacccaaggacaccctcatctccagaacacccgaggtgacgtgtgttgtggtcgatgtgagccatgaagaccctgaggttaagttcaattggtacgtggatggagtcgaagtgcacaacgctaaaaccaagccgcgggaggagcagtataattctacataccgcgtcgtgtccgttctgaccgtgctgcatcaggactggctcaacggcaaagaatataagtgcaaagtcagcaataaggccctgcccgctcctattgagaaaacaatctccaaggccaaggggcaacccagagaacctcaggtgtacacccttcccccgtctcgggaggaaacgaaaaaccaggttagcctgacatgtctcgtgaagggattctatccttccgatatcgcggtcgagtgggagtctaatggccagcccgaaaacaactacaaaaccacccctcccgtgctggacagcgatggctcctttttcctttacagcaagctgacagtggacaaatctcgctggcaacaggggaatgttttctcctgcagcgtccacgaggccctccacaaccattatacccagaagtctctgtccctgagccctgga

SEQ ID NO: 38488 - RNA, 1326 nt, synthetic construct
  misc_feature 1..1326: note = derived and/or modified sequence opt5 from Etrolizuab_HeavyChain2
  source 1..1326: mol_type = other RNA
gaggtgcagctggtcgaaagcggcgggggactcgttcaacccggcgggtccctgagactttcttgcgccgctagcggattctttatcaccaacaattactggggctgggtgcggcaggcccctgggaagggactggagtgggtgggctatatttcctactctggcagcacatcctataacccgtctaaactcagccgcttcacgatctccagagacaccagcaagaatacattttacctgcagaactctcttcgggcggaagataccgctgtctattactgtgcccgcacagggtccagcggatatttcgacttttggggccaggggaccctggtgacagtttcttccgccagcaccaaaggaccctctgtgttccctctcgctccctccagcaagtccacgtctggcgggaccgccgctctgggatgcctggtcaaagattactttcctgagcccgtgacagttagctggaactccggcgccctcaccagcggcgtgcacacattccctgcggtcctgcaatcttccgggctttacagcctgtctagcgtggtgaccgtcccgtcctctagcctcggaacgcagacatatatttgtaatgttaatcataagccctccaacaccaaggtggacaaaaaggtggaacctaaaagctgcgataagacacacacctgtcccccttgccccgccccggagctgcttggcgggccttctgtctttctgtttccccctaaacccaaggacaccctcatctccagaacacccgaggtgacgtgtgttgtggtcgatgtgagccatgaagaccctgaggttaagttcaattggtacgtggatggagtcgaagtgcacaacgctaaaaccaagccgcgggaggagcagtataattctacataccgcgtcgtgtccgttctgaccgtgctgcatcaggactggctcaacggcaaagaatataagtgcaaagtcagcaataaggccctgcccgctcctattgagaaaacaatctccaaggccaaggggcaacccagagaacctcaggtgtacacccttcccccgtctcgggaggaaacgaaaaaccaggttagcctgacatgtctcgtgaagggattctatccttccgatatcgcggtcgagtgggagtctaatggccagcccgaaaacaactacaaaaccacccctcccgtgctggacagcgatggctcctttttcctttacagcaagctgacagtggacaaatctcgctggcaacaggggaatgttttctcctgcagcgtccacgaggccctccacaaccattatacccagaagtctctgtccctgagccctgga

SEQ ID NO: 38489 - RNA, 639 nt, synthetic construct
  misc_feature 1..639: note = derived and/or modified sequence opt5 from Etrolizuab_LightChain1
  source 1..639: mol_type = other RNA
gacatccagacccaaagcccctcctctctgagcgcctccgtgggcgatagagtcacaattacgtgccgggcttctgagagcgttgacgatctcctgcactggtaccagcagaagcctgggaaagccccgaaacttctgatcaagtatgcgtcccagtctattagcggagtgccctcccgcttcagcggctctgggtccggaaccgactttacactcaccatcagctctctgcaacctgaagatttcgctacatactattgtcagcagggcaactcccttcccaatacctttgggcagggaacaaaggtggagattaaaagaaccgtcgccgcccctagcgtgttcatctttcccccttctgacgaacaactgaagtccggcacggctagcgttgtgtgcctcctgaacaatttctacccgcgggaggccaaggtccagtggaaagtggataacgctctgcagtccggcaattctcaggaaagcgttaccgagcaagactccaaggatagcacatattctctctccagcaccctgacactttctaaagccgactacgagaagcataaagtgtatgcgtgtgaagtcacccaccaggggctgagctcccccgtgacgaagtcttttaaccgcggagagtgc

SEQ ID NO: 38490 - RNA, 1338 nt, synthetic construct
  misc_feature 1..1338: note = derived and/or modified sequence opt5 from Etrolizumab_HeavyChain1
  source 1..1338: mol_type = other RNA
gaggtgcagctggtcgaaagcggcgggggactcgttcaacccggcgggtccctgagactttcttgcgccgctagcggattctttatcaccaacaattactggggctgggtgcggcaggcccctgggaagggactggagtgggtgggctatatttcctactctggcagcacatcctataacccgtctctcaaaagccgcttcacgatctccagagacaccagcaagaatacattttacctgcagatgaactctcttcgggcggaagataccgctgtctattactgtgcccgcacagggtccagcggatatttcgacttttggggccaggggaccctggtgacagtttcttccgccagcaccaaaggaccctctgtgttccctctcgctccctccagcaagtccacgtctggcgggaccgccgctctgggatgcctggtcaaagattactttcctgagcccgtgacagttagctggaactccggcgccctcaccagcggcgtgcacacattccctgcggtcctgcaatcttccgggctttacagcctgtctagcgtggtgaccgtcccgtcctctagcctcggaacgcagacatatatttgtaatgttaatcataagccctccaacaccaaggtggacaaaaaggtggaacctaaaagctgcgataagacacacacctgtcccccttgccccgccccggagctgcttggcgggccttctgtctttctgtttccccctaaacccaaggacaccctcatgatctccagaacacccgaggtgacgtgtgttgtggtcgatgtgagccatgaagaccctgaggttaagttcaattggtacgtggatggagtcgaagtgcacaacgctaaaaccaagccgcgggaggagcagtataattctacataccgcgtcgtgtccgttctgaccgtgctgcatcaggactggctcaacggcaaagaatataagtgcaaagtcagcaataaggccctgcccgctcctattgagaaaacaatctccaaggccaaggggcaacccagagaacctcaggtgtacacccttcccccgtctcgggaggaaatgacgaaaaaccaggttagcctgacatgtctcgtgaagggattctatccttccgatatcgcggtcgagtgggagtctaatggccagcccgaaaacaactacaaaaccacccctcccgtgctggacagcgatggctcctttttcctttacagcaagctgacagtggacaaatctcgctggcaacaggggaatgttttctcctgcagcgtcatgcacgaggccctccacaaccattatacccagaagtctctgtccctgagccctgga

SEQ ID NO: 38491 - RNA, 642 nt, synthetic construct
  misc_feature 1..642: note = derived and/or modified sequence opt5 from Etrolizumab_LightChain1
  source 1..642: mol_type = other RNA
gacatccagatgacccaaagcccctcctctctgagcgcctccgtgggcgatagagtcacaattacgtgccgggcttctgagagcgttgacgatctcctgcactggtaccagcagaagcctgggaaagccccgaaacttctgatcaagtatgcgtcccagtctattagcggagtgccctcccgcttcagcggctctgggtccggaaccgactttacactcaccatcagctctctgcaacctgaagatttcgctacatactattgtcagcagggcaactcccttcccaatacctttgggcagggaacaaaggtggagattaaaagaaccgtcgccgcccctagcgtgttcatctttcccccttctgacgaacaactgaagtccggcacggctagcgttgtgtgcctcctgaacaatttctacccgcgggaggccaaggtccagtggaaagtggataacgctctgcagtccggcaattctcaggaaagcgttaccgagcaagactccaaggatagcacatattctctctccagcaccctgacactttctaaagccgactacgagaagcataaagtgtatgcgtgtgaagtcacccaccaggggctgagctcccccgtgacgaagtcttttaaccgcggagagtgc

SEQ ID NO: 38492 - RNA, 1359 nt, synthetic construct
  misc_feature 1..1359: note = derived and/or modified sequence opt5 from Evinacumab_HeavyChain1
  source 1..1359: mol_type = other RNA
gaggtgcagctggtcgaaagcggcgggggagttatccaacccggcgggtccctcagactgtcttgcgccgctagcggattcacctttgacgattacgccatgaactgggtgcggcagggccctgggaagggacttgagtgggtgtccgcgatttctggcgacggcgggagcacatattacgctgattccgtcaaaggacgcttcacgatctctagagacaatagcaagaactccctgtatctccagatgaatagcctgcgggccgaagataccgcctttttctactgtgctaaagaccttcgcaacacaatttttggcgtggttatcccggatgccttcgacatttgggggcagggaaccatggtgacagtctcttccgctagcaccaagggcccctctgtgtttcctctggccccctgctccagaagcacatctgagtccaccgcggccctcgggtgtctggttaaagattatttccctgaacccgtgacggtcagctggaatagcggagctctgacctctggcgtgcacacatttcctgccgtgctccaaagctccggcctgtacagcctttcttccgtcgttaccgtgccgagctctagcctggggacaaagacctatacgtgcaacgtggaccataagccctccaatacaaaagtcgataagcgggtggagtctaaatacggacctccctgtcctccctgcccggctcctgagttcctcggcgggcccagcgtttttctgttccctcccaagcccaaagacacccttatgatctcccgcacacctgaagtgacctgtgtcgtggttgatgtgagccaggaggacccggaagtccagtttaactggtacgtggacggagtcgaggtgcacaatgccaagaccaagcccagagaggaacagttcaactctacatatcgggttgtgtccgtcctgacggtgctccatcaagattggctgaatggcaaagagtacaagtgcaaagttagcaacaaggggctgccttcttccatcgagaaaaccattagcaaggcgaaaggacagccccgcgaacctcaggtgtatacacttcccccgtcccaggaagagatgaccaagaatcaagtctctctgacatgtcttgtgaagggcttctaccctagcgacatcgccgtggagtgggaatccaacggccagcccgagaataactataaaaccacgcctcccgttctggattctgacgggagctttttcctctactccagactgacagtcgataagagccggtggcaggaaggaaacgtgttttcttgctccgtgatgcacgaggctctccataatcactatacccaaaaatccctgtctctctccctgggcaag

SEQ ID NO: 38493 - RNA, 642 nt, synthetic construct
  misc_feature 1..642: note = derived and/or modified sequence opt5 from Evinacumab_LightChain1
  source 1..642: mol_type = other RNA
gacatccagatgacccaaagcccctccacactgtctgccagcgtgggcgatagagtcacgattacctgccgggcttcccagtctatccgcagctggctcgcctggtaccagcagaagcctgggaaagcgccgaagctgcttatttataaggcttcctctctggagagcggagttccctccagattcagcggctctgggtccggaacagaatttaccctcacaatcagctctctgcaacctgacgatttcgccacctactattgtcagcagtacaactcctatagctacacatttggccaggggaccaaacttgagattaaacggacggtggccgctccctctgtgttcatctttcctccctccgacgaacaactcaagagcggaaccgcctccgtcgtgtgcctgctgaataacttctatcctcgcgaggctaaggttcagtggaaagtggataatgccctgcagtctggcaacagccaggaatccgtcacagagcaagacagcaaggattctacctactccctcagctctacactgacccttagcaaagcggactacgagaagcacaaagtgtatgcctgtgaagttacgcatcagggcctgtcctctccggtgacaaagagctttaatagaggggagtgc

SEQ ID NO: 38494 - RNA, 1323 nt, synthetic construct
  misc_feature 1..1323: note = derived and/or modified sequence opt5 from Evolocumab_HeavyChain1
  source 1..1323: mol_type = other RNA
gaggtgcagctggtccagagcggcgccgaagttaagaaacccggggcttccgtgaaggtgtcttgcaaagccagcggatacaccctcacatcctatggcatctcttgggtcagacaggcgcctgggcagggactggagtggatgggctgggtgagcttctacaacgggaatacgaactatgctcagaaacttcaaggacggggcaccatgacaaccgacccgtccacatctaccgcctacatggaactgcgcagcctcagatccgatgacacagccgtttattactgtgctcggggctatgggatggatgtgtggggacagggcaccacggtcaccgtgagctctgcctccacaaaagggcccagcgtttttcctctggctccctgctctcgctccaccagcgagtctacagccgcgcttggatgtctggtgaaggactacttccctgaacccgtcaccgtgtcctggaatagcggcgccctcacgtccggggtgcacacatttcctgctgtcctgcagtctagcggactgtactccctcagctctgttgtgaccgtgccgtccagcaacttcggcacacagacctatacctgcaatgtcgatcataagccctctaacacaaaagtggacaagacggttgagagaaaatgttgcgtggagtgtcctccctgccctgctcccccggtcgccggccctagcgtgtttctgtttccccctaagcccaaagatacccttatgatttcccggacacccgaagttacctgtgtggtcgtggacgtctctcacgaggatcctgaagtgcaattcaattggtacgttgacggggtggaggtccataacgccaagacaaagccgcgcgaggaacagttcaatagcacctttagagtggtttccgtgctgacggtcgtgcaccaggattggctcaacggaaaagagtataagtgcaaagtgagcaataagggcctgcccgcgcctatcgaaaagacaatttctaagaccaaagggcagccccgggagcctcaagtttacacccttcccccgtcccgcgaagagatgacaaagaaccaggtcagcctgacctgtctcgtgaagggattctatccttctgacatcgccgtggagtgggaatccaatggccagcccgagaacaattacaaaacaacgcctcccatgctggatagcgacgggtcctttttcctgtattctaagctcaccgtcgacaaaagcagatggcaacagggaaacgtgttttcctgctctgttatgcatgaagctctgcacaaccactacacacaaaagagcctttccctgagccctggcaaa

SEQ ID NO: 38495 - RNA, 645 nt, synthetic construct
  misc_feature 1..645: note = derived and/or modified sequence opt5 from Evolocumab_LightChain1
  source 1..645: mol_type = other RNA
gagagcgccctgacccagcccgcttccgtgtctggcagccctgggcaatccatcacaatttcttgcacgggaaccagctccgacgtcggcgggtacaactctgttagctggtatcagcagcacccgggaaaggcccccaaactcatgatctacgaagtgtccaatagacctagcggcgtgtctaaccggttctccgggagcaagtctggaaatacagcgtccctgaccattagcggccttcaggctgaggatgaagccgactattactgtaactcttatacatccaccagcatggtctttggcgggggaacaaaactgaccgtgctcggccaacccaaggccgctccttccgttacgctgtttcccccttctagcgaggaacttcaggccaataaagctaccctggtgtgcctcatctccgatttctacccgggggccgtcacagtggcgtggaaggccgacagctctcccgttaaggctggagtggagaccacaaccccttccaaacagagcaacaataagtatgccgcttctagctacctgtccctgacgcccgagcagtggaaatctcatcgcagctactcctgtcaagtcacacacgaaggcagcaccgtggagaagacagtggcccctaccgaatgctct

SEQ ID NO: 38496 - RNA, 1353 nt, synthetic construct
  misc_feature 1..1353: note = derived and/or modified sequence opt5 from Exbivirumab_HeavyChain1
  source 1..1353: mol_type = other RNA
caggtgcaactggtcgagagcggcgggggagttgtgcagcccggcgggtccctcagactgtcttgcgcccctagcggattcgtgtttcggtcctacggcatgcactgggtccgccagaccccggggaagggacttgaatgggtgtctctgatctggcatgacggcagcaacagattctatgctgattccgttaaaggccggtttacaatttctcgcgacaatagcaagaacacgctctacctgcagatgaatagccttagagccgaggataccgcgatgtatttctgtgctcgggaacgcctgatcgccgcccccgctgcctttgacctctgggggcaaggaacactggtgaccgtcagctctgcttccacaaaaggccctagcgtgttccccctggccccttcttccaagagcacctctgggggaacagcggccctcggctgcctggttaaagattactttcccgagcctgtgaccgtctcctggaacagcggggctcttacgtccggagtgcacaccttcccggccgtgctgcagtctagcggcctctattccctgagctctgtcgttacagtgccctccagctctcttggcacccagacatacatttgtaatgtgaaccataagcctagcaataccaaggtcgacaaaagagtggaacccaagtcctgcgataaaacgcacacatgtcctccctgcccggctcctgagctgctcgggggaccctctgtttttctgttccctcccaagcccaaagacaccctgatgatcagccggacacctgaggtgacctgtgtcgtggttgatgtgtcccatgaagacccggaggtcaagtttaactggtatgtggatggcgtcgaagtgcacaatgccaagaccaaaccccgcgaggagcagtacaacagcacatacagagttgtgtctgtcctcacggtgctgcaccaagactggcttaatgggaaggaatataaatgcaaggtttccaacaaagcgctgcctgcccccattgagaagaccatcagcaaagctaagggacagcctcgggaaccccaggtgtacacactcccgccttctcgcgaggaaatgaccaagaatcaggtctccctgacatgtcttgtgaaaggcttctatcccagcgatatcgccgtggagtgggagtccaacgggcaacctgaaaataactacaagaccacgccccctgttctggactctgacggcagctttttcctctattccaaactgacagtcgataagtctagatggcagcagggaaacgtgttcagctgctccgtgatgcatgaggctctgcacaatcattacacccaaaaatccctctctctgtcccccggcaag

SEQ ID NO: 38497 - RNA, 642 nt, synthetic construct
  misc_feature 1..642: note = derived and/or modified sequence opt5 from Exbivirumab_LightChain1
  source 1..642: mol_type = other RNA
agctacgtgctgacccagcccccttccgtctctgttgccccgggcaagacagctagaatcagctgcgggggaaacaatattggcacgaaaaacgtgcactggtatcaacagaagcccgggcaggcccctgtgctcgtcgtgtacgcggactccgatcggccctctggaatccctgagcgcttcagcggctccaattctgggaacaccgctacactgaccattagcagagttgaagccggagacgaggccgattattactgtcaggtgtgggactccgtcagctatcatgtggtttttggcggcgggacaacccttacagtgctgggacaacccaaagctgccccttctgtcaccctcttcccgccctccagcgaggaactgcaggctaataaggccacgcttgtgtgcctgatctctgatttttaccctggcgcggtgaccgtcgcctggaaagctgactccagccccgttaaggccggggtggaaacaaccacaccttctaagcagtccaacaataaatatgctgccagctcctacctctctctgacccccgagcagtggaaaagccaccggtcctacagctgtcaagtgacgcatgagggatctacagtcgaaaagaccgtggcgccgacagagtgctcc

SEQ ID NO: 38498 - RNA, 1347 nt, synthetic construct
  misc_feature 1..1347: note = derived and/or modified sequence opt5 from Farletuzumab_HeavyChain1
  source 1..1347: mol_type = other RNA
gaggtgcagctggtcgaaagcggcgggggagttgtgcaacccggcagatccctccggctgtcttgcagcgcctccgggttcaccttttctggatacggccttagctgggtgcgccaggctcctgggaagggactggagtgggtcgccatgatctcctctggcggcagctatacatactatgcggactccgtgaaagggagattcgctattagccgggataacgccaagaatacgctctttctgcagatggactctcttcgcccggaagataccggagtttacttctgtgccagacacggcgacgatcccgcttggtttgcctattgggggcagggaacacctgtgaccgtctccagcgcttctacaaaaggcccctccgtgttccctctggcccccagctctaagtccaccagcgggggaacagcggccctcggctgcctggttaaagactactttcctgagccggtgaccgtctcctggaactctggcgctctgacgagcggggtgcataccttccccgccgtgctccaatccagcggactgtattctctttccagcgtcgttacagtgccttctagctccctgggcacccagacatacatctgtaatgtgaaccacaagccctctaataccaaggtcgataaaaaggtggaacctaaaagctgcgacaagacgcatacatgtcccccgtgccctgctcccgagctccttgggggaccttccgtttttctgttcccgcccaaacctaaggataccctgatgattagccggacaccggaggtgacctgtgtcgtggttgacgtgtctcacgaagatcccgaggtcaagtttaactggtacgtggacggcgtcgaagtgcataatgccaaaaccaagcctcgcgaggagcagtataactccacatacagagttgtgagcgtcctcacggtgctgcaccaggattggctgaatgggaaagaatataagtgcaaagtttctaacaaggcgctccccgcccctatcgagaaaaccatttccaaggctaagggacaaccccgggaaccccaggtgtacacactgcctcccagccgcgacgagcttaccaaaaatcaggtctccctgacatgtctcgtgaagggcttctatccttctgacatcgccgtggaatgggagagcaacggccagcccgagaataactacaaaaccacgcctcccgttctggattccgacgggagctttttcctttattctaagctgacagtcgataaatccagatggcaacagggaaatgtgttcagctgctctgtgatgcacgaagctctccataaccactacacccagaagtccctgagcctgtctccgggcaag

SEQ ID NO: 38499 - RNA, 651 nt, synthetic construct
  misc_feature 1..651: note = derived and/or modified sequence opt5 from Farletuzumab_LightChain1
  source 1..651: mol_type = other RNA
gacatccagctgacccaaagcccctcctctctcagcgcctccgtgggcgatagagtcacaattacgtgctctgttagctcctctatcagctccaacaatctgcactggtaccagcagaagcctgggaaagctccgaagccctggatttatggaaccagcaaccttgcctctggcgtgccttcccggttcagcgggtctggatccggcacagactacacctttacaatcagctctctgcagcccgaggatattgcgacctattactgtcaacagtggtccagctatccttacatgtatacattcgggcagggaaccaaagtggaaatcaagcgcacggtcgctgccccctccgtgtttatcttccctccgtctgacgagcagctcaaaagcggcaccgcctccgttgtgtgcctgcttaataacttttaccccagagaagctaaggtccaatggaaggtggataatgccctgcagagcggcaactctcaggagtccgttacagaacaggacagcaaagattctacctacagcctctcctctacactgaccctgagcaaggctgactatgagaaacataaggtgtacgcctgtgaggtcacgcaccaagggctctccagccctgtgacaaaatctttcaatcggggagaatgc

SEQ ID NO: 38500 - RNA, 1338 nt, synthetic construct
  misc_feature 1..1338: note = derived and/or modified sequence opt5 from Fasinumab_HeavyChain1
  source 1..1338: mol_type = other RNA
caggtgcaactggtccagagcggcgccgaggttaagaaacccggggcttccgtgaaggtgtcttgcaaagtcagcggattcaccctcacagaactgtccatccactgggtgagacaggcccctggcaaggggcttgagtggatgggaggctttgacccggaagatggggagacgatttacgcgcagaaattccaaggacgggttaccatgacagaagacacctctacagataccgcttatatggagctgacaagcctccgctccgaggacaccgccgtgtactattgttctacgatctttggcgtcgtgaccaacttcgataattggggccaggggacactggttaccgtgagctccgccagcacaaagggaccctctgtctttcctcttgctccctgctccagaagcacctctgaatccacggccgctctgggctgtctcgtgaaggactacttccctgagcccgtgacagtcagctggaactctggggccctgacctccggagttcatacatttcctgcggtgctgcagagctccggcctctattctctgagctccgtggtcaccgtgccgtctagctcccttgggaccaaaacatacacgtgcaatgttgatcacaagcccagcaacaccaaagtggacaagcgggtcgaatctaaatatggacctccctgtcctccctgcccggcccctgagttcctgggcggccccagcgtgtttctcttccctcccaagcccaaggatacactgatgatttcccgcacccctgaggttacatgtgtggtcgtggacgtctctcaggaagatccggaggtgcaatttaattggtacgttgacggggtggaagtccataacgctaaaaccaagcccagagaggaacagttcaatagcacgtaccgggtggtttccgtgcttacagtcctgcaccaggattggctcaacggaaaagagtataagtgcaaagtgagcaataagggcctgccttcttccatcgagaaaaccattagcaaggccaaggggcagccccgcgaacctcaagtgtacaccctgcccccgtctcaggaggaaatgaccaaaaaccaggtttccctcacatgtctggtcaagggattttatcctagcgacatcgctgtggagtgggaatccaatggccaacccgagaacaattacaaaacaacgcctcccgtgcttgactctgatgggagcttcttcctgtattccagactcaccgtcgacaagtctcggtggcaggagggaaacgtgtttagctgctccgttatgcatgaagccctgcacaatcactacacacagaaaagcctttctctgtccctcggcaag

SEQ ID NO: 38501 - RNA, 642 nt, synthetic construct
  misc_feature 1..642: note = derived and/or modified sequence opt5 from Fasinumab_LightChain1
  source 1..642: mol_type = other RNA
gacatccagatgacccaaagcccctcctctctgagcgcctccgctggcgatagagtgacaattacgtgccgggcctctcaggcgatccgcaacgacctcgggtggtaccagcagaagcctggaaaagctccgaagagactgatttatgccgccttcaatcttcaaagcggcgtcccctcccggttttctgggagcggatccggcaccgagttcacactgaccatcagctctctccagcctgaagatctggcttcctactattgtcagcagtacaaccgctatccctggacatttgggcaaggaaccaaagttgagattaagagaacagtggccgctcctagcgtgttcatctttcccccttctgacgaacagcttaaatccggcaccgccagcgtcgtgtgcctgctcaataacttctacccgcgggaggcgaaggttcagtggaaggtggataatgccctgcagtctggcaactcccaagaaagcgtcacggagcaggactccaaagattctacctatagcctgtccagcacactcaccctgtctaaggctgactacgagaaacacaaggtgtacgcctgtgaagttacacatcaggggctttccagccccgtgaccaaatcttttaatcgcggagagtgc

SEQ ID NO: 38502 - RNA, 1350 nt, synthetic construct
  misc_feature 1..1350: note = derived and/or modified sequence opt5 from Fezakinumab_HeavyChain1
  source 1..1350: mol_type = other RNA
caggtgcaactggtccagagcggcgccgaggttaagaaacccggggcttccgtgaaggtgtcttgcaaagccagcggatacaccttcacaaactattacatgcactgggtcagacaggcgcctggccaggggctcgaatgggtgggatggatcaatccgtatacgggctccgctttttacgcccaaaagttccgggggcgcgttaccatgacaagagacacctctattagcacagcctatatggagctgtcccggcttcgctctgatgacaccgctgtgtactattgtgccagagaacccgagaaatttgatagcgacgattccgacgtctggggacggggcacactggtgaccgttagctctgcttccacgaagggccctagcgtgttccccctcgccccttcttccaagagcacctctgggggaacagcggccctgggctgccttgtcaaagattactttcccgaacctgtgaccgtgtcctggaacagcggggctctgacatccggagtccataccttcccggccgttctccagtctagcggcctgtactccctgagctctgtggtgacggtcccctccagctctctcgggacacagacctatatctgtaatgtgaaccacaagcctagcaatacaaaagttgacaagaaagtggagcccaagtcctgcgataagacccatacctgtcctccctgcccggctcctgagctgcttggaggcccctctgtctttctgttccctcccaaacccaaggacacactcatgattagccgcacgcctgaagtgacctgtgttgtggtcgatgtgtcccacgaggacccggaagtcaaatttaactggtacgtggatggcgttgaggtgcataatgccaagacaaaacccagagaggaacagtataacagcacctaccgggtcgtgtctgttctgacagtgcttcaccaagactggctgaatgggaaggagtataaatgcaaggtctccaacaaggcgctccctgcccccatcgagaaaaccattagcaaggctaaaggacagcctcgcgaaccccaggtgtacacgctgccgccttctagagaagagatgacaaagaatcaggtgtccctgacctgtctcgttaaaggcttctatcccagcgacatcgccgtcgagtgggaatccaacgggcaacctgagaataactacaagaccacaccccctgtgctggattctgacggcagctttttcctttactccaagctgaccgtggataaatctcggtggcagcagggaaatgtctttagctgctccgtgatgcacgaagctctccataaccactatacacaaaagagcctgtctctttcccccggg

SEQ ID NO: 38503 - RNA, 651 nt, synthetic construct
  misc_feature 1..651: note = derived and/or modified sequence opt5 from Fezakinumab_LightChain1
  source 1..651: mol_type = other RNA
caggccgtgctgacccaaccccctagcgtctccggcgctccggggcagagagttacaatctcttgcacgggaagctcctctaacattggcgccgggtacggagtgcactggtatcagcagctccccggcaccgcgcctaagctgcttatctacggggacagcaatcggccctccggagtgcctgatcgcttctctggcagcaaatccggcacaagcgcttctctggccattaccgggctccaagccgaggacgaagctgattattactgtcagtcctatgacaacagcctgtctggatacgtctttggcgggggaacacagcttaccgtgctgggccagcccaaggccgctccttccgttacactcttcccgcccagctctgaggaactgcaagccaataaagcgaccctggtgtgcctcatctccgatttttatcctggggccgtcacggtggcttggaaggccgacagctcccccgttaaagctggagtggagaccacaaccccttctaagcagagcaacaataagtacgccgcgtccagctacctgtctcttacacccgaacagtggaaatcccatagaagctattcttgtcaggtcacccacgagggcagcacggtggagaagacagtggccccgaccgaatgctcc

SEQ ID NO: 38504 - RNA, 1347 nt, synthetic construct
  misc_feature 1..1347: note = derived and/or modified sequence opt5 from FG-3019_HeavyChain1
  source 1..1347: mol_type = other RNA
gagggccagctggtgcaaagcgggggaggcctcgtccaccccgggggatccctgagactttcttgcgccggcagcgggttcaccttttcctcttacggaatgcattgggttcggcaggctcctggcaagggcctggaatgggtgagcgggatcggaacaggcgggggaacgtattccaccgactctgtgaaaggccgcttcacaattagcagagataacgccaaaaattccctctacctgcagatgaacagccttcgggcggaggacatggctgtctattactgtgcccgcggggattattacggatctggctcctttttcgactgctggggccaggggaccctggtgacagttagctctgcctccaccaagggaccgagcgtgtttcccctcgctccttcttccaagagcacatccggcgggaccgccgctctgggatgtctggtcaaagattatttccccgaacctgtgacggtttcttggaatagcggcgccctcacctccggggtgcacacatttcccgcggtcctgcaaagctctggactttactccctgagctctgtggtgaccgtccctagctcctctctcggcacacagacctacatctgcaacgttaatcataagccgagcaacacgaaggtggacaaaagagtggagcccaagtcctgtgataaaacacatacctgccctccctgtcctgcccccgaactgcttggcgggccgagcgtcttcctgtttcctcccaagcctaaagacacactcatgatttctcggacccccgaggtgacctgcgttgtggtcgatgtgtcccacgaggaccccgaagttaagttcaattggtatgtggatggagtcgaggtgcacaacgctaagacaaaacctcgcgaggaacagtacaatagcacgtatagagtcgtgtctgttctgaccgtgctgcaccaggactggctcaacggcaaggagtacaaatgtaaggtctccaataaagccctgccggctcccatcgaaaagacaattagcaaagccaaggggcaacctcgggagccccaggtgtatacccttcctccctcccgcgaagagatgacaaagaaccaggtttctctgacctgcctcgtgaaaggattttacccgagcgatatcgcggtcgaatgggagtccaatggccagcctgagaacaattataagacgacaccccctgtgctggactctgacgggagcttctttctttactccaaactgaccgtggataagagcagatggcaacagggcaacgttttctcttgttccgtcatgcatgaagccctccacaaccattacacccagaaaagcctgtctctgtcccccgga

SEQ ID NO: 38505 - RNA, 642 nt, synthetic construct
  misc_feature 1..642: note = derived and/or modified sequence opt5 from FG-3019_LightChain1
  source 1..642: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttatccccctacctttggccaagggacaaaactggagattaagagaaccgtggctgccccctccgtgttcatctttcctccgagcgacgaacagcttaaatccggaacggcttctgtcgtgtgcctgctcaataacttctacccccgggaggccaaggttcagtggaaggtggataatgcgctgcagagcggcaactcccaagaaagcgtcaccgagcaggactctaaagattccacatatagcctgtctagcaccctcacactgtccaaggccgactacgagaaacacaaggtgtacgcttgtgaagttacccatcagggcctttctagccctgtgacgaaatcctttaatcgcggggagtgc

SEQ ID NO: 38506 - RNA, 1344 nt, synthetic construct
  misc_feature 1..1344: note = derived and/or modified sequence opt5 from Fibatuzumab_HeavyChain1
  source 1..1344: mol_type = other RNA
caggtgcaactggtccagagcggcgccgaggttaagaaacccggggcttccgtgaaggtgtcttgcaaagccagcggatacaccttcacaggctattggatgaactgggtcagacaggcgcctgggcagggactcgaatggatgggcgacatctacccggggtccggaaatacgaactatgatgagaagtttcaaggccgggtgaccatgacacgcgacacctctattagcacagcttacatggaactgtccagacttcggtctgatgacaccgccgtttattactgtgcccgcggcgggtattacgaggatttcgacagctggggacagggcacaaccgtgacggtctccagcgcttctaccaaagggccctccgtgtttcctctggcccccagctctaagtccacaagcggaggcaccgctgccctcgggtgcctggttaaggattacttccctgaacccgtgacagtctcttggaactccggagcgcttaccagcggcgtgcacacgtttcctgccgtgctgcagtcctctggcctctatagcctgtccagcgtcgttacagtgccgtcttccagcctggggacccagacatacatctgtaatgtgaatcataaaccctctaacaccaaggtcgacaaaagagtggagcctaagagctgcgataaaacccacacatgtcccccttgccccgctccggagctcctgggaggcccttccgttttcctttttccccctaagcccaaggacacgctgatgatttctcggacccccgaagtgacatgtgtcgtggttgatgtgagccatgaggaccctgaagtcaaattcaattggtatgtggatggggtcgaggtgcacaacgccaagaccaaaccgcgcgaggaacaatacaattccacatatagagttgtgagcgtcctcaccgtgctgcatcaggactggcttaacggaaaggagtacaaatgcaaggtttctaataaagctctgcccgcccctatcgaaaagacgatttccaaggcgaaaggccagccccgggagcctcaggtgtatacactgcccccgagccgcgaagagatgaccaagaaccaagtctctctcacctgtctggtgaaagggttttacccttccgacatcgccgtggagtgggaaagcaatggacagcccgagaacaattacaagacaacccctcccgttctcgattccgacggctctttctttctgtatagcaaacttacagtcgataagtccagatggcagcaaggcaacgtgttctcttgcagcgtgatgcacgaagctctgcacaaccattacacgcagaagtccctcagcctgtctcctgggaaa

SEQ ID NO: 38507 - RNA, 642 nt, synthetic construct
  misc_feature 1..642: note = derived and/or modified sequence opt5 from Fibatuzumab_LightChain1
  source 1..642: mol_type = other RNA
gacatccagatgacccaaagccccagcttcctgtctgccagcgtgggcgatagagtcacaattacgtgccgggcttcccaggggatcatttcttacctcgcctggtatcagcagaagcctgagaaagcgccgaagcgcctgatctacgctgccagctcccttcaatctggagttcccagcagattttccggcagcgggtctggaaccgagttcacactgaccatttccagcctccagcctgaagactttgccacatattactgtggccagtatgctaactacccctataccttcgggcagggaacaaaactggaaatcaagcggaccgtggccgctccttctgtgtttatctttcccccttccgatgagcaacttaaaagcggcacggcctctgtcgtgtgcctgctcaataacttctacccgcgcgaagcgaaggttcagtggaaggtggacaatgccctgcagtccggcaacagccaggagtccgtcaccgagcaagattctaaagacagcacatactccctgagctctaccctcacactgtccaaggctgattatgaaaaacacaaggtgtacgcctgtgaggttacccatcaggggcttagctctcccgtgacgaaatccttcaatagaggagaatgc

SEQ ID NO: 38508 - RNA, 1344 nt, synthetic construct
  misc_feature 1..1344: note = derived and/or modified sequence opt5 from Ficlatuzumab_HeavyChain1
  source 1..1344: mol_type = other RNA
caggtgcaactggtccagcccggcgccgaggttaagaaacctgggaccagcgtgaagctctcctgcaaagctagcggatacacattcacgacctattggatgcactgggtgagacaggccccgggccaggggctggaatggatcggagagattaaccccacaaatggccataccaactacaatcaaaagtttcaggggcgggcgacacttaccgtcgacaaaagcacatccaccgcttatatggaactgtctagcctccgctccgaggatacggccgtgtactattgtgccagaaactacgttggatctatcttcgactattggggccagggcaccctgcttacagtgagctccgctagcaccaaggggccttctgtctttcccctggccccttccagcaagtctacatccggaggcaccgctgccctcgggtgcctggtgaaagattacttccccgaacctgttacggtgagctggaactctggagcgctgacatccggcgtccacacctttccggccgtgctccagagctccgggctgtactctcttagctccgtggtcacagttccctcttcttccctgggaacccaaacctatatttgtaatgtgaatcataagcctagcaacacaaaagtggacaagcgggtcgagcccaaatcttgcgataagacgcacacctgtcctccctgcccggctcctgagctcctgggcggccccagcgtgttcctttttcctcccaagcccaaagacacactgatgatctcccgcacccctgaagttacatgtgtggtcgtggatgtttctcatgaggacccggaagtgaagttcaattggtacgtcgatggggtggaggtccacaacgccaaaaccaagcccagagaggaacagtataatagcacgtaccgggtggtttccgtgctcacagtcctgcaccaggactggctgaacggaaaagagtataagtgcaaagtgagcaataaggctctccctgcccccattgaaaagaccatctctaaagcgaagggccagcctcgcgagccccaagtttacaccctgccgccttccagagaagagatgacaaagaaccaggtgagccttacctgtctggtcaaggggttttatccctctgatatcgccgtggagtgggaatccaatggacagcctgagaacaactacaaaacaacgccccctgtgctcgacagcgatggctccttctttctgtactctaaacttaccgttgacaagagccggtggcaacaggggaatgtcttctcctgctctgtgatgcatgaagctctgcacaaccattatacacagaaaagcctctccctgagccccggaaag

SEQ ID NO: 38509 - RNA, 1341 nt, synthetic construct
  misc_feature 1..1341: note = derived and/or modified sequence opt5 from Ficlatuzumab_HeavyChain
  source 1..1341: mol_type = other RNA
gtgcagctggtccaacccggcgccgaggttaagaaacctgggaccagcgtgaagctctcctgcaaagctagcggatacacattcacgacctattggatgcactgggtgagacaggccccgggccaggggctggaatggatcggagagattaaccccacaaatggccataccaactacaatcagaagtttcaagggcgggcgacacttaccgtcgacaaaagcacatccaccgcttatatggaactgtctagcctccgctccgaggatacggccgtgtactattgtgccagaaactacgttggatctatcttcgactattggggccagggcaccctgcttacagtgagctccgctagcaccaaggggccttctgtctttcccctggccccttccagcaagtctacatccggaggcaccgctgccctcgggtgcctggtgaaagattacttccccgaacctgttacggtgagctggaactctggagcgctgacatccggcgtccacacctttccggccgtgctccagagctccgggctgtactctcttagctccgtggtcacagttccctcttcttccctgggaacccagacctatatttgtaatgtgaatcataagcctagcaacacaaaagtggacaagcgggtcgagcccaaatcttgcgataagacgcacacctgtcctccctgcccggctcctgagctcctgggcggccccagcgtgttcctttttcctcccaagcccaaagacacactgatgatctcccgcacccctgaagttacatgtgtggtcgtggatgtttctcatgaggacccggaagtgaagttcaattggtacgtcgatggggtggaggtccacaacgccaaaaccaagcccagagaggaacaatataatagcacgtaccgggtggtttccgtgctcacagtcctgcaccaggactggctgaacggaaaagagtataagtgcaaagtgagcaataaggctctccctgcccccattgaaaagaccatctctaaagcgaagggccagcctcgcgagccccaggtttacaccctgccgccttccagagaagagatgacaaagaaccaagtgagccttacctgtctggtcaaggggttttatccctctgatatcgccgtggagtgggaatccaatggacagcctgagaacaactacaaaacaacgccccctgtgctcgacagcgatggctccttctttctgtactctaaacttaccgttgacaagagccggtggcagcaagggaatgtcttctcctgctctgtgatgcatgaagctctgcacaaccattatacacagaaaagcctctccctgagccccggaaag

SEQ ID NO: 38510 - RNA, 642 nt, synthetic construct
  misc_feature 1..642: note = derived and/or modified sequence opt5 from Ficlatuzumab_LightChain1
  source 1..642: mol_type = other RNA
gacatcgtgatgacccagagccccgattccctggccatgtctctcggcgagagagtcacactgaactgcaaggctagcgaaaatgttgtgtcctacgtgtcttggtatcaacagaaacctgggcagagcccgaaacttctgatttacggagcctccaaccgggagtctggcgtccccgaccgcttcagcgggtccggaagcgcgacggattttaccctcacaatctcttccgtgcaggctgaagacgttgccgattatcactgtggccaaagctacaattatccttacaccttcgggcagggaacaaaactggagattaagagaaccgtggccgctccctctgtctttatcttccctccctccgacgaacagcttaaaagcggcacagcctctgtggtttgcctgctcaacaatttttatcctcgggaggctaaggtgcagtggaaggtcgataacgccctgcaatccggcaatagccaggagtccgtgaccgaacaggactctaaagatagcacgtactccctgagctctaccctcacactgtccaaggcggactacgagaaacataaggtgtatgcctgtgaagtcacccaccaggggcttagctctccggttacaaagagcttcaaccgcggagagtgc

SEQ ID NO: 38511 - RNA, 1350 nt, synthetic construct
  misc_feature 1..1350: note = derived and/or modified sequence opt5 from Figitumumab_HeavyChain1
  source 1..1350: mol_type = other RNA
gaggtgcagctgctcgaaagcggcgggggactggtccaacccggcgggtcccttagactgtcttgcaccgccagcggattcacattttcctcttacgctatgaactgggttcggcaggcccctggcaaggggctcgagtgggtgagcgcgatctccggatctggcggcacgaccttctatgctgacagcgtgaaagggcgctttacaatttccagagataatagccggaccacactgtaccttcagatgaactctctgcgcgccgaagacaccgccgtctattactgtgctaaggatctcggatggtccgacagctattactattactacggcatggatgtgtgggggcagggaacaaccgttacggtgtcttccgccagcaccaaaggcccgtctgtcttccccctggctccttgctccagaagcacatccgagtctaccgccgcgctggggtgtctcgtgaaggactattttcccgaacctgttacagtgagctggaactccggagccctgaccagcggcgtccacacgttccccgctgtgcttcaatcttccggcctgtacagcctctctagcgtggtcacagttccttcctctaattttgggacccagacatatacctgcaatgtggatcataaaccgagcaacaccaaggtggacaagacagtcgagcggaaatgttgcgtggagtgtcccccttgccccgcccctcccgttgctggaccgtccgtgttcctgtttcctcccaagcctaaagatacgcttatgatcagccgcacccccgaagtcacatgtgtggttgtggacgtctctcacgaggatcccgaagtgcagttcaattggtacgtcgacggcgtggaggttcataacgccaagaccaaacctagagaggaacagtttaattccacattccgggtggtcagcgtgctgaccgttgtgcaccaagattggctcaacgggaaggagtataagtgcaaagtctctaataagggactgccggcgcccattgagaaaacgatctccaagacaaaaggccagcctcgcgaaccccaggtgtacaccctgcctcccagcagagaagagatgaccaagaaccaggtgtccctcacatgtctggttaaagggttttatccgtctgacattgccgtcgagtgggaaagcaatggacaacctgagaacaattacaagaccacaccccctatgcttgactccgatggctctttcttcctgtacagcaagctcacggtggacaaatcccggtggcagcagggcaacgtgtttagctgctctgtcatgcatgaagctctgcacaaccactatacccaaaagtcccttagcctgtctcccggg

SEQ ID NO: 38512 - RNA, 642 nt, synthetic construct
  misc_feature 1..642: note = derived and/or modified sequence opt5 from Figitumumab_LightChain1
  source 1..642: mol_type = other RNA
gacatccagatgacccaattccccagctccctgtctgccagcgtgggcgatagagtcacaattacgtgccgggcttcccaggggatccgcaacgacctcggatggtaccagcagaagcctggcaaagccccgaagagactgatttatgcggcttctcggcttcaccgcggggttcccagcagattttccggatctggcagcgggaccgagttcacactgaccatctccagcctccaacctgaagattttgccacatactattgtctgcagcataattcttacccctgctccttcggacagggcaccaaacttgagattaagcggacagtggccgctcctagcgtgtttatctttcccccttctgacgaacagctgaaatccggcaccgccagcgtcgtgtgtctcctgaacaatttctatccgcgcgaggctaaggttcaatggaaggtggataacgccctgcagtctggaaattcccaggaaagcgtcacggagcaggactccaaagattctacctacagcctctccagcacactgaccctttctaaggcggactatgagaaacacaaggtgtacgcctgcgaagttacacatcaagggctgtccagccccgtgaccaaatctttcaacagaggcgagtgt

SEQ ID NO: 38513 - RNA, 1359 nt, synthetic construct
  misc_feature 1..1359: note = derived and/or modified sequence opt5 from Firivumab_HeavyChain1
  source 1..1359: mol_type = other RNA
caggtgcaactggtccagagcggcgccgaggttaagatgcccgggtcctctgtgaaagtgagctgcaagacctccggagtcttcttttctagccacgctatctcctgggtgagacaggcccctggccaggggctcgaatggatgggaggcatttctccgatgttcgggacaacgcattacgcgcaaaaatttcagggacgggttaccatcacagctgaccagagcaccacaaccgcctatatggagctgacatcccttaccagcgaagatacggccgtgtactattgtgctcgcgacggcgccggctcttactatcccctgaactggttcgatccttgggggcagggaaccctcgtcacagtgtccagcgcttctaccaagggcccctccgtttttcctctggcccccagctctaaatccacaagcgggggaaccgcggcccttggctgcctggtgaaggactacttccctgagccggtcacggtgtcctggaactctggggctctcacaagcggagtgcacacctttcccgccgtcctgcaatccagcggcctgtattctctctccagcgttgtgacagtgccttctagctccctgggcacccagacctacatttgtaatgtcaatcataagccctctaacacaaaagtggataagagagttgaacctaaaagctgcgacaagacgcacacctgtcccccgtgccctgctcccgagcttctcgggggaccttccgtgttcctgtttcctcccaaacccaaggatacactgatgatcagccggaccccggaggtcacatgtgtggttgtggacgtctctcatgaagatcccgaggtgaagttcaattggtacgtcgacggcgtggaagttcacaacgccaaaaccaagcctcgcgaggagcagtataattccacgtacagagtggtcagcgtgcttacagttctgcaccaggattggctcaacgggaaagaatataagtgcaaagtgtctaataaggcgctgcccgcccctattgagaaaaccatctccaaggctaagggacaaccccgggaaccgcaggtctacaccctgcctcccagccgcgacgagctcaccaaaaaccaggtgtccctgacatgtcttgtgaagggcttttatccttctgatatcgccgttgaatgggagagcaatgggcaacccgagaacaattacaaaacaacgcctcccgtcctggactccgacggatctttctttctctatagcaagctgaccgtggataaatccagatggcagcagggcaacgtgttcagctgctctgtcatgcatgaaggccttcacaatcattacacacagaagtccctgagcctctctccggggaag

SEQ ID NO: 38514 - RNA, 642 nt, synthetic construct
  misc_feature 1..642: note = derived and/or modified sequence opt5 from Firivumab_LightChain1
  source 1..642: mol_type = other RNA
gagatcgtgctgacccagagccccgccacactctccctgtctcctggcgaaagagctacgcttagctgccgggcctccgagaacatttggaataacctggcgtggtaccaacagaagccggggcaggctccccgcctcctgatctctggagccagcaccggcgccacaggggtcccttccagattccggggatctggcagccgcaccgaatttacacttaccatttccagcctgcagtctgaggacttcgctatctatttttgtcaacagtacaattcctggcccagaacattcgggcctggaaccaaagttgaaattaagcggacggtggccgctcccagcgtgtttatcttccctccgtctgatgagcagctcaaatccggcaccgccagcgtcgtgtgcctgctgaacaatttttatccccgcgaggcgaaggttcagtggaaagtggacaacgccctccaatctggcaattcccaggaaagcgtcacagagcaggattccaaggactctacctacagcctgtccagcacacttaccctgtctaaggctgattatgaaaaacacaaggtgtacgcctgtgaggttacgcatcaggggctctccagccctgtgacaaaatctttcaacagaggagagtgc

SEQ ID NO: 38515 - RNA, 1347 nt, synthetic construct
  misc_feature 1..1347: note = derived and/or modified sequence opt5 from Flanvotumab_HeavyChain1
  source 1..1347: mol_type = other RNA
caggtgcaactggtccagagcggctccgagctcaagaaacccggggcctctgttaagatcagctgcaaggcttccggatacaccttcacatcttatgccatgaactgggtgagacaggcgcctggccaggggctggaaagcatgggatggattaatacgaacaccggcaatccgacatacgctcaagggtttaccggacggttcgtgttttccatggacacatctgtcagcaccgcctatcttcagatctccagcctgaaagccgaggatacagctatttactattgtgctccccgctactcttccagctggtatctcgactactggggccagggcaccctggtgacggtttcttccgctagcaccaaagggccttctgtgttcccccttgccccttccagcaagtccacatctggaggcaccgcggccctggggtgcctcgtcaaggattactttcccgaacctgtgacagttagctggaactccggagctctgaccagcggcgtgcacacgttcccggccgtcctgcagtcttccgggctctatagcctgtctagcgtggtgacagtcccctcctctagccttggaacccaaacatacatctgtaatgttaaccataaaccttccaataccaaggtggacaaaagagtggagcccaagagctgcgataaaacccacacatgtcctccctgcccggctcctgaactgctcggcggcccctctgtctttctgttccctcccaagcccaaggacacgcttatgatttcccggacccctgaggtgacatgtgttgtggtcgatgtgagccatgaggacccggaagttaaatttaactggtatgtggatggggtcgaggtgcacaatgccaagaccaaaccccgcgaggaacagtacaactctacatatagagtcgtgtccgttctgaccgtgctccatcaggactggctgaatggaaaggagtacaaatgcaaggtcagcaacaaagcgctgcctgcccccatcgaaaagacgatctccaaggctaaaggccagcctcgggagccccaagtgtatacactcccgccttctcgcgaagagatgaccaagaatcaggttagcctgacctgtcttgtgaaagggttctacccctccgatattgccgtcgaatgggagtctaacggacagcctgagaataactacaagacaacaccccctgtgctggacagcgatggctcctttttcctctatagcaaactgaccgtggacaagtctagatggcaacaggggaacgtcttttcctgcagcgttatgcacgaagcccttcacaatcattacacgcagaagtctctgtccctcagccccggaaaa

SEQ ID NO: 38516 - RNA, 645 nt, synthetic construct
  misc_feature 1..645: note = derived and/or modified sequence opt5 from Flanvotumab_LightChain1
  source 1..645: mol_type = other RNA
gagatcgtgctgacccagagccccgccacactcagcctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggctcatgtatacctttggccaggggacaaaactggagatcaagagaaccgtggctgccccttctgtgttcatttttcccccttccgatgaacagctgaaaagcggaacggcgtctgtcgtgtgcctcctgaacaatttctacccgcgggaggccaaggttcaatggaaagtggacaacgcccttcagtccggcaatagccaggagtccgtcaccgaacaggattctaaggacagcacatattccctgagctctaccctcacactgtccaaggctgattacgagaaacacaaggtgtacgcttgtgaagttacccatcaaggccttagctctcccgtgacgaaatcctttaaccgcggggagtgc

SEQ ID NO: 38517 - RNA, 1362 nt, synthetic construct
  misc_feature 1..1362: note = derived and/or modified sequence opt5 from Fletikumab_HeavyChain1
  source 1..1362: mol_type = other RNA
caggtgcaactggtccagagcggcgccgaggttaagagacccggggcttccgtgaaagtgtcttgcaaggccagcggatacaccttcacaaacgacatcattcactgggtccggcaggcgcctggccagcgcctcgaatggatggggtggatcaatgctggatatggcaacacgcaatactcccagaattttcaggatagagtgtctattacccgggacacaagcgcctccaccgcctatatggagctgatctctcttcgcagcgaagatacagctgtttactattgtgccagagagccgctgtggttcggggaatccagcccccatgactactatggaatggatgtgtggggccagggcaccacagtcaccgtgtcttccgctagcacgaaagggccttctgtttttcccctcgccccttgctcccggagcacctctgagtccacagcggccctgggatgtcttgtgaaggactacttccccgagcctgtcaccgtgagctggaactccggcgctctgacatctggggtgcacacctttccggccgtcctccaaagctccggactgtacagcctgtcttccgttgtgacggtgcccagctctagcctcggcacaaaaacctatacatgcaatgtcgatcataagccttccaacaccaaggtggacaaacgcgttgaatctaagtacgggcccccttgtcccccgtgccctgctcccgagttcctgggaggccctagcgtgtttcttttccctcccaaacccaaggataccctgatgatttccagaacaccggaagtcacgtgtgtggttgtggacgtcagccaggaggatcccgaggtgcagtttaattggtatgtcgacggcgtggaagttcacaacgccaaaaccaagcctcgggaggaacagttcaattctacataccgcgtggtctccgtgctcaccgttctgcatcaagattggcttaacgggaaggagtataaatgcaaggtgagcaataaaggactgccctcttccatcgaaaagacaatcagcaaagcgaagggccagcctagagagccccaggtctacaccctcccgccttcccaagaggaaatgacgaaaaaccaggtgtctctgacatgtctggtgaaggggttttatcccagcgacattgccgttgagtgggaatccaatggacagcctgagaacaattacaagaccacaccccctgtcctcgactctgatggcagcttctttctgtactcccggcttaccgtggacaaaagccgctggcaggaagggaacgtgttctcttgctccgtcatgcacgaggctctgcacaaccattatacccaaaagagcctctctctgtcccttggaaaa

SEQ ID NO: 38518 - RNA, 642 nt, synthetic construct
  misc_feature 1..642: note = derived and/or modified sequence opt5 from Fletikumab_LightChain1
  source 1..642: mol_type = other RNA
gccatccagctgacccaaagccccagctctctcagcgcttccgtgggcgacagagtcacaattacgtgccgggcctctcaggggatcagctccgcgctggcttggtaccagcagaagcctggaaaagccccgaaacttctgatttatgatgcctctagcctcgagtccggcgttcccagccgcttctctgggtccggaagcggcaccgactttacactgaccatctcttcccttcaacctgaagatttcgctacatactattgtcagcagtttaacagctaccccctgaccttcgggggaggcacaaaggtggagattaagagaaccgtggccgctccttctgtctttatctttcccccttccgacgaacagctcaaaagcggcacggcctccgtggtttgcctgctgaataacttctatccgcgggaggcgaaggtgcaatggaaggtcgataatgccctccagtctgggaacagccaggaatccgtgaccgagcaggacagcaaagattctacatactccctgagctctacccttacactgagcaaggctgactatgagaaacacaaggtttacgcctgtgaagtgacccatcaaggactctcctctcccgtcacgaaatccttcaatcgcggcgagtgc

SEQ ID NO: 38519 - RNA, 1341 nt, synthetic construct
  misc_feature 1..1341: note = derived and/or modified sequence opt5 from Fontolizumab_HeavyChain1
  source 1..1341: mol_type = other RNA
caggtgcaactggtccagagcggcgccgagctcaagaaacccgggtcctctgttaaggtgagctgcaaggcttccggatacatcttcacctctagctggattaactgggtgaaacaggcccctggccaggggctggaatggatcggaagaattgacccgtccgatggcgaggtccactataatcaagactttaaagataaggcgacacttacggtggacaagtctaccaacacagcttacatggaactgagctccctccggagcgaggataccgccgtttattactgtgcccgcgggttcctgccctggtttgctgactggggacagggcacacttgtgaccgtctcttccgccagcacaaaaggcccttctgtgttccccctggctccttccagcaagtctacctccgggggaacggccgcgctcggctgcctggttaaagattattttcccgaacctgtgaccgtcagctggaactccggggccctgacatctggagtgcataccttcccggctgtgctccagagctccggcctgtacagcctttcttccgtcgttacagtgcccagctctagcctggggacccagacgtatatctgtaatgtgaatcacaagccttccaacacaaaagtcgacaagaaggtggagcccaaatcttgcgataagacccatacatgtcctccctgcccggcccctgagctcctgggaggccccagcgtttttcttttccctcccaaacccaaggacaccctgatgatttccagaacccctgaagtgacatgtgtcgtggttgatgtgagccacgaggacccggaagtcaaatttaattggtacgtggatggcgtcgaggtgcataacgctaagacgaaaccccgggaggaacaatacaattctacctatcgcgttgtgtccgtcctcacagtgctgcaccaggactggctgaacgggaaggagtacaagtgcaaagttagcaataaggccctccctgcgcccatcgagaaaaccatctctaaggccaaaggacagcctagagaaccccaggtgtatacactgccgccttcccgggacgaacttaccaagaaccaagtcagcctgacgtgtctcgtgaagggcttctacccctccgatattgctgtggagtgggagtctaatgggcagcctgaaaacaattataaaacaacaccccctgttctggacagcgatggatcctttttcctttactctaagctgaccgtcgacaaaagccgctggcagcaaggcaacgtgttttcctgcagcgtgatgcacgaggccctccataaccactatacccagaagtctctgtccctgagccccgggaaa

SEQ ID NO: 38520 - RNA, 642 nt, synthetic construct
  misc_feature 1..642: note = derived and/or modified sequence opt5 from Fontolizumab_LightChain1
  source 1..642: mol_type = other RNA
gacatccagatgacccaaagcccctccacactgtctgccagcgtgggcgatagagtcacgattacctgcaaggcttccgagaacgttgacacatacgtgtcttggtatcagcagaaacctgggaaggccccgaaactcctgatctacggagcgagcaatcggtataccggcgtgccctcccgcttctctgggagcggatccggcacagattttacccttacaattagctctctgcagcctgacgatttcgctacctactattgtgggcaatcctacaactatccctttacgttcggacagggcaccaaggtcgaagtgaaaagaacagttgccgcccctagcgtgtttatctttcccccttctgacgagcagctcaagtccggcaccgctagcgtcgtgtgcctgcttaataacttctacccgcgggaagccaaggttcagtggaaagtggataatgctctgcaatctgggaactcccaggagagcgtcacagaacaggactccaaggattctacctacagcctctccagcacgctgacactgtctaaagccgactatgagaagcacaaagtgtacgcgtgtgaggtgacccatcagggactctccagccccgtcacaaagtctttcaatcgcggcgaatgc

SEQ ID NO: 38521 - RNA, 1344 nt, synthetic construct
  misc_feature 1..1344: note = derived and/or modified sequence opt5 from Foralumab_HeavyChain1
  source 1..1344: mol_type = other RNA
caggtgcaactggtcgagagcggcgggggagttgtgcagcccggcagatccctccggctgtcttgcgccgctagcgggttcaagttttccggatacggcatgcactgggtgcgccaggcccctgggaaaggacttgaatgggtcgcggtgatctggtatgacggctctaagaaatactatgttgatagcgtgaagggcagattcaccatttcccgggacaactctaaaaatacactgtacctccagatgaacagcctgcgcgctgaggatacggccgtctattactgtgccagacaaatggggtattggcattttgacctttggggacggggcaccctggtgacagtttccagcgcttctaccaaggggccgtccgtgttccccctcgcccctagctctaagtccacaagcggaggcaccgctgccctggggtgcctggtcaaagattactttcccgaacctgtgacagtgtcttggaactccggagcgctcaccagcggcgtccacacgttccccgccgttctgcagtcctctggcctttacagcctgtccagcgtggtgaccgtcccttcttccagcctcgggacacagacctatatctgtaatgtgaatcataagccgtctaacacaaaagttgacaagcgcgtggagcccaaaagctgcgataagacccacacgtgtcctccctgccctgctcccgaagccgagggaggcccgtccgtctttctgttccctcccaagcctaaagacacacttatgatttctagaacccccgaggtgacatgtgttgtggtcgatgtgagccatgaagaccccgaggtcaagtttaattggtacgtggatggggttgaagtgcacaacgctaaaaccaagcctcgggaggagcagtataattccacctaccgcgtcgtgagcgttctgacagtgctccaccaagactggctgaacggaaaagaatataagtgcaaagtctctaataaggccctgccggcgcccatcgagaagacgatttccaaagccaagggccagcctagagaaccccaggtgtacaccctccctcccagccgggaggaaatgaccaaaaaccaggtgtctctgacctgtcttgttaaggggttctatccgtccgatatcgctgtcgagtgggagagcaatggacaacctgaaaacaattacaaaacaacaccccctgtgctggactccgacggcagctttttcctctactctaagctgacggtggataagtcccgctggcagcagggcaacgtcttttcttgcagcgtgatgcatgaggcccttcacaaccattatacacaaaaatccctgagcctctctcccgggaag

SEQ ID NO: 38522 - RNA, 645 nt, synthetic construct
  misc_feature 1..645: note = derived and/or modified sequence opt5 from Foralumab_LightChain1
  source 1..645: mol_type = other RNA
gagatcgtgctgacccagagccccgccacactcagcctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctcccctcacctttggcgggggaacaaaagtggagatcaagagaaccgtggctgccccttctgtcttcatttttccgccctccgatgaacagctgaaaagcggcacggcgtctgtggtttgcctgctcaacaatttctatcctcgggaggccaaggtgcagtggaaagtcgacaacgctctgcaatccggcaatagccaggagtccgtgaccgaacaggattctaaggacagcacatactcccttagctctaccctgacactctccaaggccgattatgagaaacacaaggtttacgcttgtgaagtgacccatcaggggctgagctctcccgtcacgaaatcctttaaccgcggagagtgc

SEQ ID NO: 38523 - RNA, 1344 nt, synthetic construct
  misc_feature 1..1344: note = derived and/or modified sequence opt5 from Foravirumab_HeavyChain1
  source 1..1344: mol_type = other RNA
caggtgcaactggtcgagagcggcgggggagccgttcagcccggcagatccctccggctgtcttgcgctgccagcgggttcaccttttcctcttacggaatgcactgggtgcgccaggcgcctggcaaggggcttgaatgggtggctgtcatcctgtatgacggaagcgataaattctacgccgactccgtgaagggcagatttacaatttctcgggataacagcaaaaatacgctctatctgcagatgaactcccttcgcgccgaggacaccgctgtttactattgtgccaaggtggctgtcgccggcacacatttcgattactgggggcaaggaaccctggtgacagttagctctgcgtccaccaaaggcccgagcgtgtttcccctcgccccttcttccaagagcacatctgggggaaccgctgccctgggctgcctggtcaaggactatttccccgaacctgtgacggtgtcctggaatagcggggctctcacctccggagtccacacatttcccgccgttctgcagtctagcggcctttactccctgagctctgtggtgaccgtcccttccagctctctcggcacacagacctacatctgtaacgtgaatcataaaccgagcaacacgaaggttgataaaagagtggagcccaagtcctgcgacaaaacacacacctgtcctccctgccctgcgcccgaactgcttgggggaccgtctgtcttcctgtttcctcccaagcctaaggatacactcatgattagccggacccccgaggtgacctgtgttgtggtcgacgtgtcccatgaggatcccgaagtcaaattcaattggtatgtggacggcgttgaggtgcacaacgccaagacaaaacctcgcgaggaacagtacaatagcacgtatagagtcgtgtctgttctgaccgtgctgcaccaagattggctcaacgggaaggagtacaaatgcaaggtctccaataaagctctgccggcccccatcgaaaagacaattagcaaggctaaaggacagcctcgggagccccaggtgtatacccttcctccctctcgcgaagagatgacaaagaaccaggtgtccctgacctgtctcgttaaaggcttttacccgagcgacatcgccgtcgaatgggagtccaatgggcaacctgagaacaattataagacgacaccccctgtgctggactctgatggcagcttctttctttactccaaactgaccgtggacaagtctagatggcagcagggaaacgtcttcagctgctccgtgatgcatgaagccctccacaaccattacacccaaaagagcctgtctctgtcccccggc

SEQ ID NO: 38524 - RNA, 1344 nt, synthetic construct
  misc_feature 1..1344: note = derived and/or modified sequence opt5 from Foravirumab_HeavyChain
  source 1..1344: mol_type = other RNA
gaggtgcagctggtcgaaagcggcgggggagccgttcagcccggcagatccctccggctgtcttgcgctgccagcgggttcaccttttcctcttacggaatgcactgggtgcgccaggcgcctggcaaggggcttgagtgggtggctgtcatcctgtatgacggaagcgataaattctacgccgactccgtgaagggcagatttacaatttctcgggataacagcaaaaatacgctctatctgcagatgaactcccttcgcgccgaagacaccgctgtttactattgtgccaaggtggctgtcgccggcacacatttcgattactgggggcagggaaccctggtgacagttagctctgcgtccaccaaaggcccgagcgtgtttcccctcgccccttcttccaagagcacatctgggggaaccgctgccctgggctgcctggtcaaggactatttccccgagcctgtgacggtgtcctggaatagcggggctctcacctccggagtccacacatttcccgccgttctgcaatctagcggcctttactccctgagctctgtggtgaccgtcccttccagctctctcggcacacagacctacatctgtaacgtgaatcataaaccgagcaacacgaaggttgataaaagagtggaacccaagtcctgcgacaaaacacacacctgtcctccctgccctgcgcccgagctgcttgggggaccgtctgtcttcctgtttcctcccaagcctaaggatacactcatgattagccggacccccgaggtgacctgtgttgtggtcgacgtgtcccatgaagatcccgaggtcaaattcaattggtatgtggacggcgttgaagtgcacaacgccaagacaaaacctcgcgaggagcagtacaatagcacgtatagagtcgtgtctgttctgaccgtgctgcaccaggattggctcaacgggaaggaatacaaatgcaaggtctccaataaagctctgccggcccccatcgagaagacaattagcaaggctaaaggacaacctcgggaaccccaggtgtatacccttcctccctctcgcgaggaaatgacaaagaaccaggtgtccctgacctgtctcgttaaaggcttttacccgagcgacatcgccgtcgagtgggagtccaatgggcagcctgaaaacaattataagacgacaccccctgtgctggactctgatggcagcttctttctttactccaaactgaccgtggacaagtctagatggcaacagggaaacgtcttcagctgctccgtgatgcatgaggccctccacaaccattacacccaaaagagcctgtctctgtcccccggc

SEQ ID NO: 38525 - RNA, 642 nt, synthetic construct
  misc_feature 1..642: note = derived and/or modified sequence opt5 from Foravirumab_LightChain1
  source 1..642: mol_type = other RNA
gacatccagatgacccaaagcccctcctctctgagcgcctccgtgggcgatagagtcacaattacgtgccgggcttctcaggggatccgcaacgacctcggatggtaccagcagaagcctggcaaagccccgaagctgcttatttatgcggctagctccctgcaatctggggttcccagcagattctccggaagcggctctgggaccgattttacactcaccatctccagcctgcagcctgaggacttcgccacatactattgtcagcagcttaattcttatccccctacctttggaggcggcacaaaagtggaaattaagcggaccgtggccgctccctccgtcttcatctttcctccgagcgatgagcaactgaaatctgggacggcctccgtggtttgcctcctgaacaatttctacccccgcgaagctaaggtgcagtggaaggtcgacaacgccctgcagagcggaaattcccaggagtctgtgaccgaacaagatagcaaagactccacatacagcctctcttccaccctgacacttagcaaggcggattatgagaaacacaaggtttacgcctgtgaggtgacccatcagggcctgtctagccctgtcacgaaatcctttaacagaggggaatgc

SEQ ID NO: 38526 - RNA, 1341 nt, synthetic construct
  misc_feature 1..1341: note = derived and/or modified sequence opt5 from Fresolimumab_HeavyChain1
  source 1..1341: mol_type = other RNA
caggtgcaactggtccagagcggcgctgaggttaagaaacccgggtcctctgtgaaggtgagctgcaaggcttccggatacaccttctctagcaacgtcatctcctgggtgagacaggcccctggccaggggctcgaatggatgggaggcgttattccgatcgtggacattgcgaattatgctcaacggtttaaggggcgcgtcacaatcacggccgatgagtctaccagcacaacctacatggaactgtccagccttagatctgaggacacagccgtgtattactgtgcttccaccctgggactcgttctggatgccatggactattggggccagggcacacttgtgaccgtcagctctgcttccacgaaagggcccagcgtgttccctctggccccctgctctcggtccaccagcgaatccacagcggccctcggatgtctggtgaaggattactttcctgagcccgtcaccgtttcttggaacagcggcgctctgacatccggggtgcacaccttccctgccgtgctccagagctctggactgtattcccttagctctgtcgtgacggttccgagctcctctctgggcacaaagacctacacatgcaatgtggaccataaacccagcaacaccaaggtcgataaacgcgtggagtccaagtacgggcctccctgtcctagctgccccgctccggaatttctcggaggcccttctgttttcctgtttccccctaaacccaaggacacccttatgatttccagaacacccgaggtgacgtgtgtcgtggtcgatgtgagccaggaagaccctgaggttcaattcaattggtatgtggatggcgtcgaggtgcacaacgccaagaccaaaccgcgggaggaacagtttaattctacataccgcgttgtgtccgtcctgaccgtgctccatcaggactggctgaacgggaaggaatataaatgcaaggtgagcaataaaggactgccctcctctatcgagaagacaatcagcaaagcgaagggccagcctagagaaccccaagtttacaccctccctccctcccaggaggagatgacgaagaaccaggtctctctgacatgtcttgtgaaagggttctatccgagcgatattgccgtggaatgggagtccaatggacaacctgaaaacaattacaagaccacaccccctgtcctggacagcgacggctcctttttcctctattctcggctgaccgtggataaaagccgctggcaggaggggaacgtgttttcttgctccgttatgcacgaagcccttcataatcactacacccagaaaagcctgtctctcagcctgggaaaa

SEQ ID NO: 38527 - RNA, 645 nt, synthetic construct
  misc_feature 1..645: note = derived and/or modified sequence opt5 from Fresolimumab_LightChain1
  source 1..645: mol_type = other RNA
gagacggtgctgacacagagccccggcacgctctccctgtctcctggggaaagagccacccttagctgccgggcttcccaatctctgggaagctcctacctcgcctggtatcagcagaagccgggccaggcgccccgcctgcttatctacggggcttctagcagagcccctggcattcccgaccggttctccggaagcgggtctggaacagattttaccctgacaatctcccgcctcgagcctgaagacttcgccgtctattactgtcaacagtatgctgatagccccattacctttggccagggcacaagactggagatcaaacggaccgttgccgctccttctgtgttcatttttccgccctccgacgaacagctcaagagcgggacggcctctgtggtctgcctgctgaacaatttctaccctcgcgaggcgaaagtgcaatggaaggttgataacgcccttcagtccggaaatagccaggagtccgtgaccgaacaggactctaaagatagcacatattccctgagctctaccctcacactgtccaaggctgactacgagaagcacaaagtctacgcctgtgaagtgacccatcaaggccttagctctcccgttaccaagagctttaacagaggggagtgc

SEQ ID NO: 38528 - RNA, 1347 nt, synthetic construct
  misc_feature 1..1347: note = derived and/or modified sequence opt5 from Fulranumab_HeavyChain1
  source 1..1347: mol_type = other RNA
gaggtgcagctggtcgaaagcggcgggggactcgttcaacccggcgggtccctgagactttcttgcgccgctagcggattcaccctgcggtcctactctatgaactgggtgcgccaggcccctggcaaggggctcgagtgggtgagctatatctccagatctagccacacaatcttttacgcggactccgtcaaaggacggttcacgattagccgcgataatgctaagaactctctgtatcttcagatggactccctgagagatgaagacaccgccatgtactattgtgcccgggtgtacagctctggctggcatgtttccgattattttgactactggggccaggggattctcgtgacagtcagctctgcttccaccaaaggaccgagcgtgttccccctggccccttgctcccgctctacaagcgagtccaccgctgccctgggctgtctcgttaaggattactttcccgaacctgtgacagtcagctggaactctggggcgctgacctccggagtgcacacgttccccgccgtgcttcaaagctctggcctgtatagcctctcctctgtcgttaccgtgcctagctccaattttgggacacagacctacacatgcaatgtggaccataaaccgagcaacaccaaggtcgataagacggtggagagaaaatgttgcgttgagtgtcccccttgccccgctcctcccgtggccggaccgtctgtcttcctgtttcctcccaagcctaaagacacacttatgatctcccggacccccgaagtgacatgtgttgtggtcgatgtgagccacgaggaccccgaagtccagttcaattggtatgtggatggcgttgaggtgcataacgctaagaccaaacctcgcgaggaacagtttaattctaccttcagagtcgtgtccgttctgacagtggtccaccaagactggctcaacggcaaggagtacaagtgcaaagtgagcaataaggggctgccggcccccattgagaaaacgatctccaagaccaaaggacagcctcgggaaccccaggtgtatacactgcctccctctcgcgaagagatgaccaagaaccaggttagcctcacatgtctggtcaaaggcttttacccgtccgacatcgcggtggagtgggaatctaatgggcaacctgagaacaattataagaccacgccccctatgcttgatagcgacggatccttcttcctgtacagcaagctcacagtggataaatctagatggcagcagggcaacgtcttttcctgcagcgtgatgcacgaagccctgcataaccactacacccaaaagtctctttccctgagccccgggaaa

SEQ ID NO: 38529 - RNA, 642 nt, synthetic construct; identical to SEQ ID NO: 38518
  misc_feature 1..642: note = derived and/or modified sequence opt5 from Fulranumab_LightChain1
  source 1..642: mol_type = other RNA

SEQ ID NO: 38530 - RNA, 1356 nt, synthetic construct
  misc_feature 1..1356: note = derived and/or modified sequence opt5 from Futuximab_HeavyChain1
  source 1..1356: mol_type = other RNA
gaggtgcagctgcaacagcccggcagcgaactcgtcagacctggggcctccgttaagctgtcttgcaaagctagcggatacaccttcacatcctattggatgcactgggtgaagcagcggccgggccaggggcttgagtggatcggaaacatttaccccggctctcgcagcacgaattatgacgaaaaatttaagtccaaagccaccctgacagtggatacctctagctccacagcgtacatgcaactcagctctctgacctccgaggacagcgctgtctattactgtacaagaaacggggattattacgtgtcttccggagacgccatggattactggggccagggcaccagcgttacggtgtcttccgccagcaccaaggggccttccgtcttcccccttgctccttctagcaagtccacaagcggaggcaccgccgctctggggtgcctcgtgaaagactattttcccgaacctgttacagtgtcttggaactccggagccctgaccagcggcgtccatacgttcccggcggtgctgcagtctagcgggctctactccctgtctagcgtggtcacagttccctccagctctcttggaacccagacatatatctgtaatgtgaatcacaagccttccaacaccaaagtggataagcgggtcgagcccaaaagctgcgacaagacccatacatgtcctccctgcccggcccctgagctgctcggcggcccctctgtgtttctgttccctcccaagcccaaagatacgcttatgatttcccgcacccctgaagttacatgtgtggtcgtggacgttagccacgaggatccggaagtgaagtttaattggtacgtcgacggggtggaggtccataacgctaaaaccaagcccagagaggaacaatataattccacataccgggtggtttctgtgctgaccgtcctccaccaggattggctgaacggaaaagagtataagtgcaaagtgagcaataaggccctgcctgctcccatcgaaaagacgatttccaaagccaagggccagcctcgcgagccccaggtttacacactcccgccttctagagaagagatgaccaaaaaccaagtgagcctgacctgtcttgtcaaggggttctacccctccgacatcgcggtggagtgggaaagcaatggacagcctgagaacaattataaaacaacaccccctgtgctggactctgatggctcctttttcctctacagcaagctgaccgttgacaagtctcggtggcagcaagggaacgtcttttcctgcagcgtgatgcacgaagcccttcataaccactatacgcagaaatctctgagcctctcccccgga

SEQ ID NO: 38531 - RNA, 642 nt, synthetic construct
  misc_feature 1..642: note = derived and/or modified sequence opt5 from Futuximab_LightChain1
  source 1..642: mol_type = other RNA
gacatccagatgacccaaacaacgagctccctgtctgccagcctcggcgatagagtgaccatttcctgccggacatctcaggacatcgggaactacctgaattggtatcagcagaagcccgatggaaccgtcaaacttctgatttactatacaagccgcctccactccggcgttccttctagattcagcgggtccggaagcggcaccgacttttctctgacaatcaacaatgtggagcaagaagatgtggctacctacttctgtcagcattataacacggtcccgcccacctttgggggaggcacaaaacttgagattaagcggaccgtggccgcgccttccgttttcatctttccccctagcgacgaacagctgaagtctggcacagcttccgtggtctgcctcctgaataacttctacccccgcgaggccaaagtgcagtggaaggttgataatgccctgcaaagcgggaactctcaggaatccgtgaccgagcaggacagcaaggattccacgtattctctcagctccacactgacccttagcaaagctgactacgagaagcacaaagtctacgcctgtgaagtgacacatcagggactgtcttcccctgtgaccaagagctttaatagaggcgagtgc

SEQ ID NO: 38532 - RNA, 1335 nt, synthetic construct
  misc_feature 1..1335: note = derived and/or modified sequence opt5 from Galcanezumab_HeavyChain1
  source 1..1335: mol_type = other RNA
caggtgcaactggtccagagcggcgctgaggttaagaaacccgggtcctctgtgaaggtgagctgcaaggcttccggatacaccttcggcaactattggatgcagtgggtcagacaggcccctgggcaaggactcgaatggatgggcgcgatctacgaggggacaggaaagacggtgtatattcagaaatttgctgaccgggttaccatcacagccgataagtctaccagcacagcctacatggaactgtcctctcttcgcagcgaggacaccgctgtgtattactgtgccagactgtccgattatgtcagcggcttcggctactgggggcagggaacaaccgtgacggtttcttccgctagcaccaagggcccgtctgtgtttcccctcgccccttgctcccggagcacatctgaatccaccgcggccctggggtgtcttgtcaaagactacttccccgagcctgtgacagtgagctggaactccggagctctgacctctggcgtccacacgtttcccgccgttctccagagctccgggctgtatagcctgtcttccgtggtgacagtccctagctctagcctcggaaccaagacatatacctgcaatgtggatcataaaccgtccaataccaaggttgacaaacgcgtggagtctaagtacggacccccttgtcccccttgccccgctccggaagccgcgggcgggcctagcgtcttcctgtttccccctaagcccaaagatacacttatgatttccagaacgcccgaggtgacctgtgttgtggtcgacgtgagccaagaagatcctgaggtccagttcaactggtacgtggacggagttgaggtgcacaatgccaagacaaaaccgcgggaggaacagtttaactctacctatcgcgtcgtgtccgttctgacagtgctccatcaggattggctgaatggcaaggaatacaaatgcaaggtcagcaacaaagggcttccctcttccatcgagaagaccattagcaaggctaaaggacaacctagagaaccccaggtgtatacgctgcctccctcccaggaggagatgacaaagaatcaagtgtctctcacctgtctggttaaaggcttctacccgagcgacatcgccgtcgaatgggagtccaacgggcagcctgaaaataactacaagaccacaccccctgtgctggattctgacggcagctttttcctctattcccggctgaccgtggacaaaagccgctggcaggagggcaatgtcttttcttgctccgtgatgcacgaagcccttcataaccactacacacagaaaagcctgtctctctccctgggc

SEQ ID NO: 38533 - RNA, 642 nt, synthetic construct
  misc_feature 1..642: note = derived and/or modified sequence opt5 from Galcanezumab_LightChain1
  source 1..642: mol_type = other RNA
gacatccagatgacccaaagcccctcctctctgagcgcctccgtgggcgatagagtcacaattacgtgccgggcttctaaggacatcagcaaatacctcaactggtatcagcagaagcctgggaaagccccgaagctgcttatttactatacctccggataccactctggcgttcccagccgcttctccgggagcggatctggcacagattttaccctgacaatctccagcctccagcctgaggacttcgcgacctattactgtcaacagggggatgctctgccccctacatttggaggcggcaccaaagtggaaattaagagaacggtggccgccccctctgtcttcatctttcctccgtccgacgagcagcttaagagcgggaccgcttctgtggtttgcctgctcaataacttctatccccgggaagccaaagtgcagtggaaggtcgataatgctctgcaatccggaaacagccaggagtccgtgacagaacaggactctaaagatagcacctactccctgagctctacactcaccctgtccaaggccgactacgagaaacataaggtttatgcgtgtgaggtgacgcaccagggccttagctctcctgtcacaaagagctttaatcgcggggaatgc

SEQ ID NO: 38534 - RNA, 1371 nt, synthetic construct
  misc_feature 1..1371: note = derived and/or modified sequence opt5 from Galiximab_HeavyChain1
  source 1..1371: mol_type = other RNA
caggtgcaactgcaggagagcggccccgggctcgtcaagccttccgaaaccctgtctcttacatgcgccgttagcggaggctccatctctgggggatacggctgggggtggattagacagccgcccggaaaaggcctggagtggatcggcagcttctattcctctagcgggaacacgtactataatccttccctcaagagccaggtgaccatttctacagacacctccaaaaaccaatttagcctgaaacttaattctatgacagctgccgataccgcggtgtactattgtgtccgggaccgcctgttctccgtggttggaatggtgtacaacaattggtttgatgtctggggccccggggtgctcgttacagtgagctctgcttccaccaaaggacctagcgtcttccccctggccccttcctctaagagcacgtccggcgggaccgccgctctgggatgcctcgtgaaggactattttccggaacccgtgacagtcagctggaactctggcgccctgacctccggcgttcacacattccctgctgtgcttcagagctctgggctgtacagcctctcctctgtggtcaccgtgcccagctccagcctgggaacgcagacatacatctgtaatgttaaccataaaccttctaataccaaggtggataaaaaggccgagcccaaatcctgcgacaagacacacacctgtccgccttgccccgcgcctgaacttctgggcgggcccagcgtctttctctttccccctaagccgaaagataccctgatgatttctagaacacccgaggtgacgtgtgttgtggtcgacgtgtcccatgaggatcctgaagtcaagtttaactggtatgtggacggagttgaggtgcacaatgccaaaaccaagccccgggaggaacagtacaacagcacatatcgcgtcgtgtccgttctgaccgtgctccatcaagattggctgaatggcaaagagtacaagtgcaaagtctctaacaaggcccttcctgctcccatcgaaaagacaatcagcaaagctaaggggcagccgagagagcctcaggtgtataccctgcccccttcccgggacgaactcacgaaaaatcaggtgtctctgacatgtcttgttaagggattctaccccagcgatattgccgtcgagtgggaatccaacggccaacctgagaacaattataaaaccacacccccggtgctggacagcgacggctctttcttcctctactccaagctgaccgtggataagagccgctggcagcaggggaacgtcttttcttgctccgtgatgcacgaggcgctgcacaatcattacacccaaaagagcctctctctgagccctggaaag

SEQ ID NO: 38535 - RNA, 648 nt, synthetic construct
  misc_feature 1..648: note = derived and/or modified sequence opt5 from Galiximab_LightChain1
  source 1..648: mol_type = other RNA
gagagcgccctgacccagcccccttccgtgtctggcgctccggggcaaaaggtcacaatcagctgcacgggatccacctctaacattggcgggtacgacctccactggtatcagcagctgcccggaacagcccctaaacttctgatctacgatattaataagagacccagcggcatctccgaccggttctctgggagcaaatccggaaccgcggctagcctcgccattacaggcctgcagaccgaagatgaggccgactattactgtcaatcttatgattccagccttaacgctcaggtttttggcgggggaacacgcctgaccgtgctcggccagcctaaggccgctcccacggtgaccctgttccctccgtcttccgaggaactgcaggccaataaagcgacactcgtctgcctgatcagcgacttttaccccggggccgtgaccgttgcttggaaggccgattcttcccctgtgaaggctggagtcgaaacaaccacgcccagcaaacaatccaacaataagtatgccgcgtctagctacctttccctgacacctgagcagtggaaaagccatagatcttactcctgtcaggtgacccacgagggcagcacagttgaaaagaccgtggcccccaccgagtgctct

SEQ ID NO: 38536 - RNA, 1347 nt, synthetic construct
  misc_feature 1..1347: note = derived and/or modified sequence opt5 from Ganitumab_HeavyChain1
  source 1..1347: mol_type = other RNA
caggtgcaactgcaggagagcggccccgggctcgtcaagccttccggaaccctgtctcttacatgcgccgttagcggcgggtccatctctagctccaactggtggtcttgggtgagacagccgcccggaaaaggcctggaatggattggggagatctaccacagcggatccacgaattataaccctagcctcaagtctcgggtgaccatttccgtcgacaaaagcaagaatcagttctctctgaaactttccagcgtgacagctgccgataccgcggtttactattgtgctcgctggacaggcagaaccgacgcctttgatatctggggccaagggacaatggtgaccgtctcttccgccagcacgaagggaccctccgtgttccctctggctccctctagcaagtccaccagcggcgggacagccgctctcggatgcctggttaaagactactttcctgaaccggtgaccgtctcttggaactccggcgccctgacaagcggggtgcataccttccccgcggtgctccagtctagcggactgtattccctttctagcgtcgttacggtgccttccagctctctgggcacacagacctacatttgtaatgtgaaccacaagccctccaatacaaaagtcgataagaaagtggagcctaagagctgcgacaagacccatacctgtcccccgtgccctgcccccgaactcctgggcgggccttctgtttttcttttcccgcccaaacctaaggatacactgatgatctcccggacgccggaggtgacctgtgtcgtggttgacgtgagccacgaggatcccgaagtcaaatttaactggtatgtggacggagtcgaggtgcataatgctaagacaaaacctcgcgaagaacagtacaactccacctacagagttgtgtctgtcctcacagtgctgcaccaagattggctgaatggcaaggagtataaatgcaaggttagcaacaaggccctccccgctcctatcgagaaaaccatttccaaggccaaagggcagccccgggagccccaggtgtacacgctgcctccctctcgcgacgaacttacaaagaatcaggtcagcctgacctgtctcgtgaaaggattctatccttccgatatcgcggtggagtgggaaagcaacggccaacccgagaataactacaagaccacacctcccgttctggactctgacgggtcctttttcctttatagcaagctgaccgtcgataaatctagatggcagcagggaaacgtgttttcctgcagcgtgatgcacgaggccctccataatcactacacacaaaagtctctgagcctgtccccgggcaaa

SEQ ID NO: 38537 - RNA, 657 nt, synthetic construct
  misc_feature 1..657: note = derived and/or modified sequence opt5 from Ganitumab_LightChain1
  source 1..657: mol_type = other RNA
gacgtggtcatgacccagagccccctgtccctccctgttacaccgggcgagcccgcctctatcagctgcagatcctctcaaagcctgcttcactccaacgggtacaattatctggattggtacctccagaagcctggacagtctccccagctgcttatttatctgggcagcaaccgggcttccggggtgcctgaccgcttcagcggatctggctccgggacggattttaccctcaaaatcagcagagtggaagccgaggacgtcggagtgtactattgtatgcaaggcacacattggcccctgaccttcggccaggggacaaaggttgaaattaaacggaccgtggcggctccttctgtctttatcttcccgccctccgatgagcagcttaagagcggaacagcctctgtggtttgcctcctgaataacttttaccctcgcgaagccaaagtgcagtggaaggtcgacaatgctctgcaatccggcaacagccaggagtccgtgaccgagcaggattctaaggacagcacgtattccctgagctctaccctcacactgtccaaagccgattacgaaaagcacaaagtgtacgcttgtgaggtcacccatcaggggcttagctctcccgttacaaagagcttcaatagaggagaatgc

SEQ ID NO: 38538 - RNA, 1368 nt, synthetic construct
  misc_feature 1..1368: note = derived and/or modified sequence opt5 from Gantenerumab_HeavyChain1
  source 1..1368: mol_type = other RNA
caggtggagctggtcgaaagcggcgggggactcgttcaacccggcgggtccctgagactttcttgcgccgctagcggattcaccttttcctcttacgccatgagctgggtgcggcaggcgcctggcaaggggctggagtgggtgtccgctatcaacgcctctggaacacgcacgtattacgccgacagcgtcaaaggcagattcaccatttcccgggataatagcaagaacacactctatctgcagatgaactctcttcgcgctgaagacaccgccgtgtactattgtgctagaggcaaagggaatacacacaagccgtacggatatgttcggtactttgatgtgtggggccaggggaccctggtcacagtgtccagcgcctctaccaaaggaccctccgttttccctctcgcgcccagctctaagtccacgagcggcgggaccgccgctctgggatgcctggtgaaggactactttcctgagcccgtcacagtgtcctggaactctggcgccctcaccagcggcgtgcatacattccctgctgtcctgcaatccagcgggctttattctctgtccagcgttgtgaccgtgccgtctagctccctcggaacgcagacatacatctgtaatgtcaatcacaaaccctctaacaccaaggtggataaaaaggttgaacctaaaagctgcgacaagacacatacctgtcccccttgccccgccccggagctgcttggcgggccttccgtgtttctgtttccccctaagcccaaagataccctcatgattagccgcacacccgaggtcacgtgtgtggttgtggacgtctctcacgaagatcctgaggtgaagtttaattggtatgtcgacggagtggaagttcataacgcgaaaaccaagccgagagaggagcagtacaattccacatatcgggtggtcagcgtgctgaccgttctgcaccaggattggctcaacggcaaagaatacaagtgcaaagtgtctaataaggccctgcccgctcctatcgagaagacaatttccaaagccaaggggcaaccccgcgaacctcaggtctatacccttcccccgagcagagacgagctgacgaaaaaccaggtgtccctcacatgtctggtgaagggattctacccttctgatatcgctgttgaatgggagagcaatggccagcccgagaacaactacaaaaccacccctcccgtccttgactccgacggctctttcttcctgtatagcaagctcacagtggataagtcccggtggcaacaggggaatgtgtttagctgctctgtcatgcacgaagccctgcataaccactacacccagaaatccctgagcctctctcctggaaag

SEQ ID NO: 38539 - RNA, 645 nt, synthetic construct
  misc_feature 1..645: note = derived and/or modified sequence opt5 from Gantenerumab_LightChain1
  source 1..645: mol_type = other RNA
gacatcgtgctgacccagagccccgccacactctccctgtctcctggcgagagagctacgcttagctgccgggcctcccaatctgtcagctcctcttacctggcgtggtatcagcagaagccggggcaggctccccgcctcctgatttacggagccagctccagagccaccggcgttcctgctcggttcagcgggtctggatccggcacagattttacccttacaatcagctctctggaacccgaggacttcgccacctattactgtctccaaatttataacatgcctatcacatttgggcagggaaccaaagtggaaattaagcgcacggtggctgccccctccgtcttcatctttcctccgagcgatgagcagctgaaatctggcaccgcgtccgtggtttgcctgctcaataacttctaccccagagaagccaaggtgcagtggaaagtcgacaatgctctgcaaagcggcaactcccaggagtctgtgacagagcaggatagcaaggactccacctatagcctttcttccacactgaccctcagcaaggccgattacgaaaaacacaaggtttacgcttgtgaggtgacgcatcaggggctgtctagccctgtcacaaaatcctttaatcggggagaatgc

SEQ ID NO: 38540 - RNA, 348 nt, synthetic construct
  misc_feature 1..348: note = derived and/or modified sequence opt5 from Gemtuzumab_HeavyChain1
  source 1..348: mol_type = other RNA
caggtgcaactgcagcagagcggcgccgagctcgctaagcccggggcctccgtcaaaatgtcttgcaaggcgagcggatacaccttcacatcctatagaatgcactgggttaaacagcggcctggccaagggctggaatggatcggatacattaacccgtctacgggctataccgagtacaatcagaagtttaaagacaaggctacacttaccgccgataagagctcctctacagcctatatgcagctgagctccctcaccttcgaagacagcgctgtgtactattgtgcccgcgggggaggcgtgtttgattactggggccaggggacaaccctgacggtctcttcc

SEQ ID NO: 38541 - RNA, 351 nt, synthetic construct
  misc_feature 1..351: note = derived and/or modified sequence opt5 from Gemtuzumab_HeavyChain2
  source 1..351: mol_type = other RNA
caggtgcaactggtccagagcggcgccgaggttaagaaacccgggtcctctgtgaaggtgagctgcaaggcttccggaggcaccttctctagaagcgccatcatttgggtccggcaggcgcctgggcagggactcgaatggatgggcgggatcgtgccgatgtttggaccccctaactacgctcaaaaattccagggccgcgttacaattacggccgacgagtccaccaatacagcctatatggaactgtctagccttagatccgaggataccgctttttacttctgtgccggcgggtatggaatctacagccccgaagagtataacggcgggctggtgacagtctcttcc

SEQ ID NO: 38542 - RNA, 321 nt, synthetic construct
  misc_feature 1..321: note = derived and/or modified sequence opt5 from Gemtuzumab_LightChain2
  source 1..321: mol_type = other RNA
gacatccagatgacccaaagcccctccacactgtctgccagcgtgggcgatagagtcacgattacctgccgggcttcccagtctatcaacacatggctcgcctggtaccagcagaagcctgggaaagcgccgaagctgcttatgtataaagctagctccctggagtctggagttcccagccgcttcattggctccgggagcggaaccgaatttacactcaccatctcttccctgcaacctgacgatttcgccacatactattgtcagcagtacaatagcgactctaagatgtttggccaggggaccaaagtggaggtgaag

SEQ ID NO: 38543 - RNA, 318 nt, synthetic construct
  misc_feature 1..318: note = derived and/or modified sequence opt5 from Gemtuzumab_ozogamicin_LightChain1
  source 1..318: mol_type = other RNA
cagatcgtgctgacccaaagccccgccattatgtccgcttctcctggcgagaaggtcacaatcacgtgcagcgcctcctctagcatttcctacatgcactggttccagcagaaaccggggacctctcccaagctctggatctatacaaccagcaacctggcgtccggagttcctgctagatttagcggctctgggtccggaacaagctactctcttaccatttcccggatggaagccgaggacgccgctacatattactgtcatcagcgcagcacctatcccctgacgttcggctctgggaccaaactcgaactgaag

SEQ ID NO: 38544 - RNA, 1335 nt, synthetic construct
  misc_feature 1..1335: note = derived and/or modified sequence opt5 from Gevokizumab_HeavyChain1
  source 1..1335: mol_type = other RNA
caggtgcaactgcaggagagcggccccgggctcgtcaagccttcccagaccctgtctcttacatgcagcttctccggattttctctgagcacgtccggcatgggggttggatggatcagacagccgtctggcaaagggctcgaatggctggcccacatttggtgggacggagatgagagctacaacccctcccttaagagccggctgaccatctctaaagacacatccaagaatcaagtgagcctcaaaattacctctgtgacagctgccgataccgcggtctatttctgtgctcgcaacagatacgaccctccctggtttgtggattggggccagggcacactggttaccgtgtccagcgcctctacgaaggggccttccgtcttccccctggccccttgcagccggtccacctctgaaagcacagctgccctcggatgtctggtgaaggactattttccggagcccgttaccgtgtcctggaatagcggcgctcttacatctggggtccataccttccctgccgtgctgcagtccagcggactctactctctgagctccgtggtcacggttacatctagcaactttggcacccagacatatacctgcaatgtggatcacaaaccctccaacaccaaggtggacaaaacagtcgaacgcaagtgttgcgtggagtgtcctccctgcccggcgcctcccgttgccgggcctagcgtgttcctttttcctcccaaacccaaggatacgctgatgatctctagaaccccggaggtcacatgtgtggttgtggacgtctcccatgaagatcccgaggtgcaattcaattggtacgtcgacggaatggaagtgcacaacgctaagaccaaacctcgggaggagcagtttaatagcacattccgcgttgtgtctgtcctcaccgtggttcatcaggattggctgaacggcaaggaatataaatgcaaggtgtccaataaaggcctgcccgcccctattgagaagacgatcagcaaaacaaaggggcagcccagagaaccgcaagtctacaccctccctccctcccgggaggaaatgaccaagaaccaggtgtctctgacatgtcttgtgaaaggattttaccctagcgacatcgctgttgagtgggagtccaatggccagcccgaaaacaattataagaccacacctcccatgctggactctgatgggagcttcttcctctactccaaactgacggtcgacaagagccgctggcaacagggaaacgtgttttcttgctccgtgatgcacgaggcccttcacaaccattatacccagaaaagcctgtctctctccccgggc

SEQ ID NO: 38545 - RNA, 642 nt, synthetic construct
  misc_feature 1..642: note = derived and/or modified sequence opt5 from Gevokizumab_LightChain1
  source 1..642: mol_type = other RNA
gacatccagatgacccaaagcacatcctctctgagcgcctccgtgggcgatagagtcacgattacctgccgggcttctcaggacatcagcaactacctctcctggtatcagcagaagcccgggaaagccgttaagctgcttatttactatacatctaaactgcacagcggagtgccttcccgcttcagcggctctgggtccggaaccgattacacactcaccatcagctctctgcaacaggaggactttgcgacatatttctgtcttcagggcaagatgctgccgtggacctttgggcagggaacgaaactcgaaattaagagaaccgtggctgccccctccgtcttcatctttcctcccagcgatgagcaactgaagtctggcacagcctccgtggtttgcctgctcaataacttctaccctcgggaagctaaagtgcagtggaaggtcgacaatgccctgcagagcggcaactcccaggagtctgtgaccgaacaagatagcaaagactccacatatagcctttcttccaccctgacgctcagcaaggctgattacgagaaacataaggtttacgcctgtgaggtgacacaccaggggctgtctagccccgtcaccaagtcctttaatcgcggagaatgc

SEQ ID NO: 38546 - RNA, 1347 nt, synthetic construct
  misc_feature 1..1347: note = derived and/or modified sequence opt5 from Girentuximab_HeavyChain1
  source 1..1347: mol_type = other RNA
gacgtgaagctggtcgagagcggcgggggactcgttaaactgggcgggtcccttaagctgtcttgcgccgctagcggattcaccttttccaactactatatgtcttgggtgagacaaacacccgaaaaacggctcgagctggtggccgcgatcaatagcgatggcgggattacgtactatcttgacaccgtcaagggacgcttcacaatctccagagataacgctaaaaataccctgtacctccaaatgtctagcctgaagtccgaagacacagccctgttttattgtgcccggcaccgcagcggctacttctctatggattattggggccaggggacctccgtgacagttagctctgcttccaccaagggacctagcgtgtttccgctcgccccctcttccaaaagcacgtccggcgggaccgctgccctgggatgccttgtcaaggactacttccctgagcccgtgacagtttcttggaacagcggcgcgctgacctccggggtgcatacatttcctgccgtcctccagagctctggactgtactcccttagctctgtggtgaccgtccccagctcctctctgggcacgcagacatatatttgtaatgttaaccacaaacctagcaataccaaggtggataaaaaggtggaaccgaagtcctgcgacaaaacacatacctgtcccccttgccccgctcctgagctcctgggcgggcccagcgtcttcctgtttccgcctaagcccaaagataccctcatgatctctagaacacctgaggtgacgtgtgttgtggtcgacgtgtcccacgaagatcccgaggttaagttcaactggtacgtggacggagtcgaagtgcataatgccaaaaccaagccccgggaggagcaatataacagcacataccgcgtcgtgtctgttctgaccgtgcttcaccaggattggctgaatggcaaagaatataagtgcaaggtctccaacaaagctctccctgccccgattgagaagacaatcagcaaagcgaaggggcagcccagagaacctcaggtgtacaccctgcccccttcccgggacgagcttacgaaaaatcaagtttctctgacatgtctcgtgaagggattttatcccagcgacatcgccgtcgaatgggagtccaacggccagccggagaataactacaagaccacccctcccgtgctggattctgacgggagcttctttctgtactccaaactcacagtggataagagccgctggcagcagggaaacgttttctcttgctccgtcatgcacgaagctctgcataatcactatacccagaaaagcctttctctgtcccctggcaag

SEQ ID NO: 38547 - RNA, 642 nt, synthetic construct
  misc_feature 1..642: note = derived and/or modified sequence opt5 from Girentuximab_LightChain1
  source 1..642: mol_type = other RNA
gacatcgtgatgacccagagccaaagattcatgtccacaacggtcggcgatcgggtttctattacctgcaaagccagccagaacgtggtgtccgctgtcgcctggtaccagcagaaacccgggcaatctcctaagctgctcatctatagcgcgtccaatcgctacacaggagtgccggacagatttaccggctctgggagcggaacagatttcaccctgacaatttccaacatgcagagcgaggaccttgctgactttttctgtcagcagtattctaattacccctggacctttggcgggggaacgaaactggaaatcaagcggaccgttgccgccccttccgtgttcatttttccccctagcgatgagcaactcaaatctggcacagcttccgtcgtgtgcctgcttaacaatttctatccccgcgaagccaaggttcagtggaaggtggataacgctctgcagagcggcaattctcaggagtccgtcaccgaacaagacagcaaagattccacatactctctcagctccaccctgacgctgagcaaggccgactatgagaaacacaaggtgtacgcgtgtgaggtgacacatcaggggctctcttcccctgtcaccaagagctttaacagaggagaatgc

SEQ ID NO: 38548 - RNA, 1335 nt, synthetic construct
  misc_feature 1..1335: note = derived and/or modified sequence opt5 from Glembatumumab_HeavyChain1
  source 1..1335: mol_type = other RNA
caggtgcaactgcaggagagcggccccgggctcgtcaagccttcccagaccctgtctcttacatgcacggttagcggaggctccatctctagcttcaactactattggtcctggattagacaccatccggggaaaggactggaatggatcggctacatttattactctgggagcacctattccaatcccagcctcaagtctcgggtgacaatctccgtggacaccagcaaaaaccagttttctctgacactttccagcgtcaccgccgctgatacagccgtgtactattgtgcgcgcggatacaattggaactacttcgactattggggccaaggcaccctggttacggtgtcttccgctagcaccaaggggccttccgtctttcccctcgccccttgctctagaagcacatccgagagcaccgccgctctgggatgtctggtgaaagattacttccccgaacctgttacagtgtcttggaactccggcgccctcaccagcggggtccacacgtttccggctgtgctgcagtctagcggactttattccctgtctagcgtggtcacagttccctccagcaatttcggcacccagacatatacctgcaatgtggaccataagccttctaacaccaaggtggataaaacagtcgagcggaagtgttgcgtggaatgtcccccttgccccgccccgcctgttgcggggccctccgtgtttctcttccctcccaaacccaaggacacgctgatgattagccgcacccctgaggtcacatgtgtggttgtggatgtctctcacgaggacccggaagtgcagtttaattggtacgtcgatggagtggaggttcataacgccaaaaccaagcccagagaggaacaattcaattccacatttcgggtggtcagcgtgcttaccgttgtgcaccaggactggctgaacggcaaggagtacaaatgcaaggtctccaataaaggcctccctgctcccatcgaaaagacgatctctaaaacaaaggggcagcctcgcgagccccaggtgtataccctgccgcctagcagagaagagatgaccaaaaaccaagtgtccctgacatgtctcgttaagggattctacccctctgatattgccgtcgaatgggagagcaatggccagcctgagaacaactacaagaccacaccccctatgctggactccgatgggagctttttcctttattctaaactgacggtggacaagtcccggtggcagcaaggaaatgtgttcagctgctctgtcatgcacgaagctctccataaccactacacccagaaatccctgagcctttctcccggcaag

SEQ ID NO: 38549 - RNA, 645 nt, synthetic construct
  misc_feature 1..645: note = derived and/or modified sequence opt5 from Glembatumumab_LightChain1
  source 1..645: mol_type = other RNA
gagatcgtgatgacccagagccccgccacactgtccgtctctcctggcgaaagagctacgctcagctgccgggcctcccaatctgttgacaacaatctggtgtggtaccagcagaaaccggggcaggcgccccgccttctgatttatggagctagcaccagagccacaggcatccctgcccggttctccgggtctggaagcggcaccgagtttacactcaccatttccagcctgcaatctgaagatttcgctgtgtactattgtcagcagtacaacaattggcccccttggacatttgggcagggaaccaaagtcgagatcaagcgcacggtggccgctccctccgttttcatttttcctccgagcgacgaacaacttaaatctggcaccgcctccgtggtctgcctgctcaacaatttctatcccagagaggcgaaggtgcagtggaaagttgataacgccctgcagagcggcaattctcaggagtccgtgacagaacaagacagcaaggattccacctactctctgagctccacactcaccctgagcaaggctgactatgagaaacacaaggtctacgcctgtgaagtgacgcatcaggggctttcttcccctgtgacaaagagctttaaccggggagagtgc

SEQ ID NO: 38550 - RNA, 1332 nt, synthetic construct
  misc_feature 1..1332: note = derived and/or modified sequence opt5 from Goilixiab_HeavyChain1
  source 1..1332: mol_type = other RNA
gaggtgcagctggtcgaaagcggcgggggactcgccaagcccggcgggtccctgagactttcttgcgctgccagcggattccggtttaccttcaacaattactatgactgggttcgccaagcgcctggccaggggctggagtgggtgtccagaatctctagctccggagatccgacatggtacgctgactctgtgaaaggccggtttacgattagccgcgaaaacgccaagaataccctcttcctgcagaactcccttagagccgaggatacagctgtctattactgtgccagcctgaccacaggctctgactcctgggggcagggagtgctcgttaccgtgagctctgcttccacaaaaggccccagcgtctttcctctggccccctcttccaagagcacctccgggggaacggcggccctgggctgcctcgtgaaagattatttccctgaacccgttaccgtgtcttggaatagcggggctctgacatccggagtccacacctttcctgccgtgcttcaaagctctggcctgtactccctcagctctgtggtcacagttccgagctcctctctgggcacccagacgtatatctgtaacgtgaatcataagcccagcaacacaaaggtggacaaaaaggtcgagcctaaatcctgcgataagacccacacatgtcccccttgccccgctccggagcttctgggaggacctagcgtgttcctctttccccctaaacccaaggacaccctgatttctcggacccccgaagttacatgtgtggtcgtggatgtttcccatgaggaccctgaagtgaagttcaattggtacgtcgatggcgtggaggtccacaacgccaaaacgaagccgcgcgaggaacagtacaatagcacctatagagtggtttctgtgctgacagtcctccatcaggactggctgaacgggaaagagtacaagtgcaaagtgtccaataaggcgcttcccgcccctatcgaaaagaccattagcaaggctaagggacaaccccgggagcctcaggtttatacactgcccccgtcccgcgatgaactcaccaaaaaccaggtgtctctgacgtgtcttgtcaagggcttttaccctagcgacatcgccgtggagtgggagtccaatgggcagcccgaaaacaactataaaacaacccctcccgtgctggactctgatgggagcttctttctctactccaagctgaccgttgacaaaagcagatggcaacagggcaatgtcttctcttgctccgtgcacgaggctctgcacaaccattatacacagaaaagcctctctctgtcccctggcaag

SEQ ID NO: 38551 - RNA, 639 nt, synthetic construct
  misc_feature 1..639: note = derived and/or modified sequence opt5 from Goilixiab_LightChain1
  source 1..639: mol_type = other RNA
gacatccagacccaaagcccctcctctctgagcgcctccgtgggcgatcgggtcacaattacgtgccgggcttctcaggacatccgctactatctcaactggtaccagcagaagcctgggaaagccccgaagctgcttatttatgttgcgagctccctgcaatctggagtgcccagcagattctccggcagcgggtctggaaccgagtttacactcaccgtgtccagcctgcagcctgaagatttcgctacatactattgtcttcaggtctactctacaccccggacctttggccaggggaccaaagtggagatcaagcgcacggttgccgccccttccgtgttcatttttccccctagcgacgaacaactgaaatctggaaccgcttccgtcgtgtgcctcctgaataacttctatccgagagaggccaaggttcagtggaaggtggataatgctctgcagagcggcaactcccaggaatctgtcacagagcaagacagcaaagattccacctacagcctctcttccacactgacccttagcaaggccgactacgagaaacacaaggtgtatgcgtgtgaagtgacgcatcagggcctgtctagccccgtcacaaaatcctttaatagaggggagtgc

SEQ ID NO: 38552 - RNA, 1338 nt, synthetic construct
  misc_feature 1..1338: note = derived and/or modified sequence opt5 from Guselkumab_HeavyChain1
  source 1..1338: mol_type = other RNA
gaggtgcagctggtccaaagcggcgccgaagttaagaaacccggggagtccctcaagatctcttgcaaaggaagcggctactccttctctaactattggattgggtgggtgagacagatgcctggaaagggcctggaatggatggggatcattgacccgagcaattcctacacccggtattctcccagctttcagggacaggtgacaatctccgctgataaaagcatttctacggcctaccttcaatggtccagcctgaaggcgtctgacaccgctatgtattactgtgcccgctggtattacaagcctttcgatgtctggggccagggcacactcgtgaccgtttccagcgcctctacaaaagggccctccgtgtttcctctggctcccagctccaagtctaccagcggaggcacagccgctcttgggtgcctggtcaaagactacttccctgagccggtgaccgtttcctggaacagcggagccctcacgtctggcgtgcacacctttcccgcggtcctgcagtccagcgggctgtattctctcagctccgtggtgacagtcccttctagctccctgggaacccagacatacatctgtaatgttaaccataagcccagcaataccaaagtggataagaaggtggaacctaaatcttgcgacaagacgcacacatgtcccccgtgccctgcccccgagcttctgggcggcccttccgtcttcctctttccgcccaaacctaaggataccctgatgatcagcagaacaccggaggtgacctgtgttgtggtcgacgtgtctcatgaagatcccgaggttaaattcaactggtatgtggacggggtcgaagtgcacaatgctaagaccaaacctcgggaggagcaatacaactccacatatcgcgtcgtgagcgttcttacggtgctgcatcaggattggctcaatggaaaggaatacaagtgcaaagtctccaacaaggccctgcccgctcctattgagaaaaccatctctaaggccaaaggccagcccagagaaccccaggtgtatacactgcctcccagccgggacgagctcaccaagaatcaagtttccctgacatgtcttgtgaaggggttttacccttctgatattgcggtcgaatgggagagcaacggacagcccgagaataactacaaaaccacgcctcccgtgctggactccgacggcagcttctttctctattctaagctgacagtggataaatcccgctggcagcaagggaatgttttcagctgctctgtcatgcacgaagcccttcacaaccattacacccagaagtccctgagcctctctccggga

SEQ ID NO: 38553 - RNA, 651 nt, synthetic construct
  misc_feature 1..651: note = derived and/or modified sequence opt5 from Guselkumab_LightChain1
  source 1..651: mol_type = other RNA
cagagcgtgctgacccaacccccttccgtctctggcgccccggggcagagagttacaatcagctgcacgggatcctctagcaacattggctccgggtacgacgtgcactggtatcagcagctccccggaaccgctcctaagctgcttatctacggcaattctaaacggcccagcggggtgcctgatcgcttctccggaagcaagtctggcacatccgccagcctggcgattaccggcctccaatctgaggacgaagctgattattactgtgcctcctggacagacgggctgagccttgtcgtgtttggaggcgggaccaaactgacagttctcggacagcccaaggccgctccttctgtgaccctgttcccgccctccagcgaggaactgcaggccaacaaagctacgctcgtctgcctgatctccgatttttatcctggcgccgtgaccgttgcgtggaaggccgactctagccccgtgaaggctggggtcgagacaaccacaccttccaaacagagcaataacaagtacgccgcttcttcctatcttagcctgacccccgaacaatggaaatctcatagaagctactcctgtcaggtgacgcacgagggatctacagtggagaagaccgtcgccccgacagaatgcagc

SEQ ID NO: 38554 - RNA, 360 nt, synthetic construct
  misc_feature 1..360: note = derived and/or modified sequence opt5 from HuMab-001_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgggtattactggaactggatcagacagcctccgggaaaaggcctcgaatggattggggagatcaatcactccggatctacgaactataatcccagcctgaagtcccgggttaccatttctgtggacacaagcaaaaaccaattttcccttaagctgagctctgtgaccgccgcggatacagctgtctactattgtgcccgcggcaattacggctccgggtattactacttcgacctctggggaagaggcacccaggtgacagttagctct

SEQ ID NO: 38555 - RNA, 321 nt, synthetic construct
  misc_feature 1..321: note = derived and/or modified sequence opt5 from HuMab-001_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgattttcgctgccagctcccttcaaagcggagttccctctcgcttttccggcagcgggtctggaaccgacttcacactgaccatctccagcctccagcctgaagattttgccacatattactgtcagcagtatatttctttccccatcacctttggccaagggacaagactggagatcaaa

SEQ ID NO: 38556 - RNA, 366 nt, synthetic construct
  misc_feature 1..366: note = derived and/or modified sequence opt5 from HuMab-005_HeavyChain_gamma-Chain_VDJ-Region
  source 1..366: mol_type = other RNA
gaggtgcagctggtccaaagcggcgccgaagttaagaaacccggggagtccctcaagatctcttgcaaagctagcggatactccttccacttttattggattggctgggtgagacagatgcctgggaagggactggaatggatgggctctatctacccgggggacagcgatacccggtatcgcccctccttccagggacaggtgacaatttctgccgacaaaagcatctccacggcgtaccttcaatggaccagcctgaaggcttctgatacagccatttattactgtgccagacagcggggcgactattactacttttatggcatggatgtctgggggcagggaaccacagtgaccgtttccagc

SEQ ID NO: 38557 - RNA, 321 nt, synthetic construct
  misc_feature 1..321: note = derived and/or modified sequence opt5 from HuMab-005_LightChain_VJ-Region
  source 1..321: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggttccccgcctcctgatttacggcgcgagctccagagctaccgggatccctgaccggttcagcggatctggctccgggacagattttacccttacaattagccgcctggagcccgaagacttcgccgtgtattactgtcaacagtatggatcttccctcacctttggcggcgggacaaaagtggagatcaag

SEQ ID NO: 38558 - RNA, 357 nt, synthetic construct
  misc_feature 1..357: note = derived and/or modified sequence opt5 from HuMab-006_HeavyChain_VDJ-Region
  source 1..357: mol_type = other RNA
gaggtgcagctgctcgaaagcggcgggggactggtccaacccggcgggtcccttagactgtcttgcgccgctagcggattcaccttttccaattacgccctcatctgggttcggcaggcgcctggcaaggggctggagtgggtgtctattatccgcggaggcgctggcagcacatattacgccgactccgtgaaagggagattcacgatttctcgggataatagcaagaacaccctttatctgcagatgaactccctccgcgccgaagacacagctgtctactattgtgccaaagctagaatctggggaccgctgtttgattactggggccaggggaccctggtgacagttagctct

SEQ ID NO: 38559 - RNA, 324 nt, synthetic construct
  misc_feature 1..324: note = derived and/or modified sequence opt5 from HuMab-006_LightChain_VJ-Region
  source 1..324: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctcccctcacctttggcgggggaacaaaagtggagatcaag

SEQ ID NO: 38560 - RNA, 360 nt, synthetic construct
  misc_feature 1..360: note = derived and/or modified sequence opt5 from HuMab-019_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgactattactggaactggatcagacagcctccggggaaaggactcgaatggattggcgagatccaccatgttgggtccacgaattataacccctctcttaagagccgggtgaccatttccgtggatacatctaaaagccaattttccctgaagctgagctctgtcaccgccgcggacacagctgtgtactattgtgcccgcggatactatgattccggcgtttactacttcgactattgggcccagggcaccctcgtgacagtcagctct

SEQ ID NO: 38561 - RNA, 360 nt, synthetic construct
  misc_feature 1..360: note = derived and/or modified sequence opt5 from HuMab-021_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgactattactggaactggatcagacagcctccggggaaaggactcgaatggattggcgagatccaccattccgggtctacgaattataaccccagcctgaagtcccgggttaccatttctgtggatacaagcaaaaatcaattttcccttaagctgagctctgtgaccgccgcggacacagctgtctactattgtgcccgcggatactatgcctccggcgtgtactacttcgattattggggccaggggaccctcgttacagtgagctct

SEQ ID NO: 38562 - RNA, 321 nt, synthetic construct
  misc_feature 1..321: note = derived and/or modified sequence opt5 from HuMab-021_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttatcccattacctttggccaagggacaagactggagatcaaa

SEQ ID NO: 38563 - RNA, 360 nt, synthetic construct
  misc_feature 1..360: note = derived and/or modified sequence opt5 from HuMab-025_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgactattactggaactggatcagacagcctccggggaaaggactcgaatggattggcgagatccaccattccgggtctacgaattataaccccagcctgaagtcccgggttaccatttctgtggatacaagcaaaaatcaattttcccttaagctgagctctgtgaccgccgcggacacagctgtctactattgtgcccgcggatactatgattccggcgtgtactacttcgactattgggcccagggcaccctcgttacagtgagctct

SEQ ID NO: 38564 - RNA, 321 nt, synthetic construct
  misc_feature 1..321: note = derived and/or modified sequence opt5 from HuMab-025_LightChain_VJ-Region
  source 1..321: mol_type = other RNA
gacatccagatgacccaaagcccctcctctctgagcgcctccgtgggcgatagagtcacaattacgtgccgggcttctcaggggatcagccgctggctcgcctggtaccagcagaagcctgagaaagcgccgaagtccctgatttatgctgcctctagccttagatccggagttcccagccggttctctggctccgggagcggaaccgactttacactgaccatctcttccctccaacctgaagatttcgccacatactattgtcagcagtacaacagctatcccattacctttggccaggggacacgcctggagatcaaa

SEQ ID NO: 38565 - RNA, 360 nt, synthetic construct
  misc_feature 1..360: note = derived and/or modified sequence opt5 from HuMab-027_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgactatttttggaactggatcagacagcctccggggaaaggactcgaatggattggcgagatccaccattccgggtctacgaattacaaccccagcctgaagtcccgggttaccatttctgtggatacaagcaaaaatcaattctcccttaacctgagctctgtgaccgccgcggacacagctgtctattactgtgcccgcggactcatcggctccggctattactattttgattactgggaccaggggaccctggtgacagttagctct

SEQ ID NO: 38566 - RNA, 360 nt, synthetic construct
  misc_feature 1..360: note = derived and/or modified sequence opt5 from HuMab-032_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgggtattactggtcctggatcagacagcctccgggaaaaggcctcgaatggattggggagatcaaccactctggagacacgaattataaccccagcctgacctcccgggttacaatttctgtggataccagcaagaatcaattttcccttaaactgagctctgtgacagccgcggacaccgctgtctactattgtgcccgcctcttctacggctccggcatctattactttgattactgggggcagggaacactggtgaccgttagctct

SEQ ID NO: 38567 - RNA, 321 nt, synthetic construct
  misc_feature 1..321: note = derived and/or modified sequence opt5 from HuMab-032_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctaccttccgccttcaaagcggagttccctccagatttagcggctctgggtccggaacagacttcaccctgacaatcagctctctccagcctgaagattttgccacctactattgtcagcagtacaactcctttccccctacattcggccaagggaccaaagtggagattaag

SEQ ID NO: 38568 - RNA, 363 nt, synthetic construct
  misc_feature 1..363: note = derived and/or modified sequence opt5 from HuMab-033_HeavyChain_VDJ-Region
  source 1..363: mol_type = other RNA
caggtgcaactggtcgagagcggcgggggagttgtgcagaccggcagatccctccggctgtcttgcgccgctagcgggttcacattttcctctcacgccatgcattgggtgcgccaggcgcccggaaagggccttgaatgggtcgctgccatcagctacgacgggtccaacaaatattacgccgattctgtgaagggaagattcacgattagccgggacaattccaaaaacaccctgtatctccagatgaatagcctgcgcgctgaggatacagccgtttactattgtgctagaggcgactacatctcttccagcggcgtgtttgattattgggggcaaggaacccttgtcacagtgtcttcc

SEQ ID NO: 38569 - RNA, 360 nt, synthetic construct
  misc_feature 1..360: note = derived and/or modified sequence opt5 from HuMab-035_HeavyChain_VDJ-Region
  source 1..360: mol_type = other RNA
caggtgcaactgcagcagtggggcgccgggctcctgaagcccagcgagaccctttccctgacatgcgctatctacggaggctctttcagcgggtattactggtcctggattagacagcctccgggaaaaggcctcgaatggatcggggagattaaccactctggagacacgaattataaccccagcctgacctcccgggtcacaatctctgttgataccagcaagaatcaattttcccttaaactgagctctgtgacagccgcggacaccgctgtgtactattgtgcccgcctcttctacggctccggcatttattactttgattactgggggcagggaacactggtcaccgtgagctct

SEQ ID NO: 38570 - RNA, 360 nt, synthetic construct
  misc_feature 1..360: note = derived and/or modified sequence opt5 from HuMab-036_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgactattactggtcctggatcagacagcctccggggaaaggactcgaatggattggcgagatcaaccactctgggagcacgaattataacccctccctgaagtctcgggttaccattagcgtggatacatccaaaaatcaatttagccttaagctgtcttccgtgaccgccgcggacacagctgtctactattgtgcccgcctctactatggaagcggcacctactacttcgattattggggccaggggacactggtgaccgtttcttcc

SEQ ID NO: 38571 - RNA, 321 nt, synthetic construct
  misc_feature 1..321: note = derived and/or modified sequence opt5 from HuMab-036_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcacctggtaccagcagaagcctgagaaagccccgaagtctctgatttatgcggctagccgccttcaatccggagttcccagcagattctctggctccgggagcggaacagactttaccctgacaatctcttccctccagcctgaagatttcgccacctactattgtcagcagtacaacagctttccccctacattcggccaagggaccaaagtggagattaag

SEQ ID NO: 38572 - RNA, 366 nt, synthetic construct
  misc_feature 1..366: note = derived and/or modified sequence opt5 from HuMab-041_HeavyChain_VDJ-Region
  source 1..366: mol_type = other RNA
gaggtgcagctggtccaaagcggcgccgaagttaagaaacccggggagtccctcaagatctcttgcaaaggaagcggctactccttcacctcttattggattgggtgggtgagacagatgcctggaaagggcctggaatggatggggagcatctacccgggagactcccacacacggtatcgcccctcttttcagggccaggtgacgattagcgctgataaatccatcagcaccgcctaccttcaatggtcttccctgaaggcgagcgacacagctatgtattactgtgccagacagaagggcgatttctattactttttcgggctcgacgtctggggacagggcaccgccattacagtgtcttcc

SEQ ID NO: 38573 - RNA, 366 nt, synthetic construct
  misc_feature 1..366: note = derived and/or modified sequence opt5 from HuMab-044_HeavyChain_VDJ-Region
  source 1..366: mol_type = other RNA
gaggtgcagctggtccaaagcggcgccgaagttaagaaacccggggagtccctcaagatctcttgcaaaggaagcggctacagattctcctcttattggattgggtgggtgcggcagatgcctggaaagggcctggaatggatggggagcatctttccgggagactccgatacccgctactctcccagcttccagggccaggtgacaatttccgctgacaaaagcatcacgaccgcctatcttcaatggtcttccctgaaggcgagcgatacagctatgtactattgtgccagacaggccggcgactactattactacaacgggatggatgtctggggacagggcaccacagtgaccgtttcttcc

SEQ ID NO: 38574 - RNA, 357 nt, synthetic construct
  misc_feature 1..357: note = derived and/or modified sequence opt5 from HuMab-049_HeavyChain_VDJ-Region
  source 1..357: mol_type = other RNA
gaggtgcagctgctcgaaagcggcggggacctggtccaacccggaggctcccttagactgtcttgcgccgctagcgggttcaccttttcctcttacgccatgagctgggttcggcaggcgcctggaaagggcctcgagtgggtgtccgctatctctgggcgcggaggcacaacgtattacgccgatagcgtgaaaggcagattcaccatttcccgggacaacagcaagtctacactgtgtcttcagatgaactccctgcgcgccgaagataccgctgtctattactgcgccaaagctagagccaattgggactattttgattactgggggcagggaacactcgtgaccgttagctct

SEQ ID NO: 38575 - RNA, 321 nt, synthetic construct
  misc_feature 1..321: note = derived and/or modified sequence opt5 from HuMab-049_LightChain_VJ-Region
  source 1..321: mol_type = other RNA
gacatccagatgacccaaagcccctcctctgtgagcgcctccgtcggcgatagagttacaattacgtgccgggcttctcaggggatcagctcctggctggcctggtaccagcacaagcctggaaaagcgccgaagctcctgatttatgctgcctctatccttcagagcggcgtgccctcccgcttcagcgggtctggatccggcaccgactttacactgaccattagctctctcagacctgaggatttcgccacatactattgtcaacaggctaactcctttcccatcaccttcgggcagggaacacggctggaaatcaaa

SEQ ID NO: 38576 - RNA, 357 nt, synthetic construct
  misc_feature 1..357: note = derived and/or modified sequence opt5 from HuMab-050_HeavyChain_VDJ-Region
  source 1..357: mol_type = other RNA
gaggtgcagctgctcgaaagcggcgggggactggtccaacccggcgggtcccttagactgtcttgcgccgctagcggattcaccttttcctcttacgccatgaactgggttcggcaggcgcctggcaaggggctcgagtgggtgagcgctatctccggacgcggcggcacaacgtattacgccgactctgtgaaagggagattcaccattagccgggataattccaagaacacactgtatcttcagatgagctctctgcgcgccgaagacaccgctgtctactattgtgccaaagctagagccaattgggattactttgactattggggacagggcacactcgtgaccgtttccagc

SEQ ID NO: 38577 - RNA, 321 nt, synthetic construct
  misc_feature 1..321: note = derived and/or modified sequence opt5 from HuMab-050_LightChain_VJ-Region
  source 1..321: mol_type = other RNA
gacatccagatgacccaaagcccctcctctgtgagcgcctccgtcggcgatagagttacaattacgtgccgggcttctcaggggatcagctcctggctggcctggtaccagcacaagcctggaaaagcgccgaagctcctgatttatgctgcctctatccttcagagcggcgtgccctcccgcttcagcgggtctggatccggcaccgactttacactgaccattagctctctccaacctgaggatttcgccacatactattgtcagcaggctaactcctttcccatcaccttcgggcagggaacaagactggaaatcaaa

SEQ ID NO: 38578 - RNA, 360 nt, synthetic construct
  misc_feature 1..360: note = derived and/or modified sequence opt5 from HuMab-054_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgggtattactggtcctggatcagacagcctccgggaaaaggcctcgaatggattggggagatccaccattctggaagcacgaactataatccctccctgaagtctcgggttaccattagcgtggacacatccaaaaaccaatttagccttaagctgtcttccgtgaccgccgcggatacagctgtctactattgtgcccgcctctggtacggcagcggctcttattacttcgactactgggggcagggaaccctggtgacagtttccagc

SEQ ID NO: 38579 - RNA, 321 nt, synthetic construct
  misc_feature 1..321: note = derived and/or modified sequence opt5 from HuMab-054_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttttccccctaccttcggcgggggaacaaaagtggagattaag

SEQ ID NO: 38580 - RNA, 357 nt, synthetic construct
  misc_feature 1..357: note = derived and/or modified sequence opt5 from HuMab-055_HeavyChain_VDJ-Region
  source 1..357: mol_type = other RNA
gaggtgcagctgctcgaaagcggcgggggactggtccaacccggcgggtcccttagactgtcttgcgccgctagcggattcaccttttcctcttacgccatgaactgggttcggcaggcgcctggcaaggggctcgagtgggtgagcgctatctccggacgcggcggcacaacgtattacgccgactctgtgaaagggagattcaccattagccgggataattccaagagcacactgtgtcttcagatgaactctctgcgcgccgaagacaccgctgtctattactgcgccaaagctagagccaattgggattattttgactactggggacagggcacactcgtgaccgtttccagc

SEQ ID NO: 38581 - RNA, 366 nt, synthetic construct
  misc_feature 1..366: note = derived and/or modified sequence opt5 from HuMab-059_HeavyChain_VDJ-Region
  source 1..366: mol_type = other RNA
caggtgcaactggtccagagcggcgccgaggttaagaaacccggggcttccgtgagagtgccttgcaaggcctctggatacaccttcacacggtatggcatcagctgggtccgccaggcgccggggcagggactcgaatggatgggctggatttccgcttacaacgggaaaacgtattacgcccaaaagctgcagggaagagtgaccatgacaaccgacacatctaccagcacagcctatatggagcttcggtccctgcgctctgatgacaccgctgtttactattgtgccagaagccccctcctgtggtttgaggaactttacttcgattactggggccagggcacgctggtgaccgtctccagc

SEQ ID NO: 38582 - RNA, 324 nt, synthetic construct
  misc_feature 1..324: note = derived and/or modified sequence opt5 from HuMab-059_LightChain_VJ-Region
  source 1..324: mol_type = other RNA
gagatcgtgctgacccagagccccggcacactctccctgtctcctggggaaagagccacgcttagctgccgggcttcccaatctgtcagctccacctacctggcctggtatcagcagaagccgggacaggcgccccgcctcctgatttacggcgcttctagcagagccacagggatccctgaccggttctccggaagcggctctgggaccgattttacacttaccatttcccgcctggagcccgaagacttcgccgtttattactgtcaacagtatggaacaagcctctttaccttcggccctggcacgaaagtggatatcaag

SEQ ID NO: 38583 - RNA, 366 nt, synthetic construct
  misc_feature 1..366: note = derived and/or modified sequence opt5 from HuMab-060_HeavyChain_VDJ-Region
  source 1..366: mol_type = other RNA
gaggtgcagctggtccaaagcggcgccgaagttaagaaacccggggagtccctcaagatctcttgcaaaggaagcggctacagattcacctcctattggattgggtgggtgcggcagatgcctggaaagggcctggaatggatggggtctatctacccgggagacagctatacacgcaactccccctcttttcagggccaggtgacgattagcgctgataaatccatcgccaccgcgtaccttcaatggaatagcctgaaggcttctgacacagccatgtattactgtgccagacacgctggcgatttctattactttgacgggctcgatgtctggggacagggcaccacagtgaccgtttccagc

SEQ ID NO: 38584 - RNA, 327 nt, synthetic construct
  misc_feature 1..327: note = derived and/or modified sequence opt5 from HuMab-060_LightChain_VJ-Region
  source 1..327: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttcccctcccatcacctttggccagggcacaagactcgagattaaa

SEQ ID NO: 38585 - RNA, 366 nt, synthetic construct
  misc_feature 1..366: note = derived and/or modified sequence opt5 from HuMab-067_HeavyChain_VDJ-Region
  source 1..366: mol_type = other RNA
gaggtgcagctggtccaaagcggcgccgaagttaagaaacccggggagtccctcaagatctcttgcaaaggaagcggctactccttcacctcttattggattgggtgggtgagacagatgcctggaaagggcctggaatggatggggatcatttacccgggagacagcgatacacggtattccccctcttttcagggccaggtgacgatcagcgtcgacaaatccattagcaccgcttaccttcaatggtcttccctgaaggccagcgatacagcgatgtattactgtgctcgccagaagggcgactattactaccactatgggctcgatgtgtggggacagggcaccacagttaccgtgtcttcc

SEQ ID NO: 38586 - RNA, 366 nt, synthetic construct
  misc_feature 1..366: note = derived and/or modified sequence opt5 from HuMab-072_HeavyChain_VDJ-Region
  source 1..366: mol_type = other RNA
gaggtgcagctggtccaaagcggcgccgaagttaagaaacccggggagtccctcaagatctcttgcaaaggaagcggctactccttcacctcttattggattgggtgggtgagacagatgcctggaaagggcctggaatggatggggatcatttacccgggagacagcgatacacggtattccccctcttttcagggccaggtgacgatcagcgctgacaaatccattagcaccgcctaccttcaatggtcttccctgaaggcgagcgatacagctatgtattactgtgcccgccagaagggcgactattactacttcaacgggctcgatgtctggggacagggcaccacagtgaccgtttcttcc

SEQ ID NO: 38587 - RNA, 327 nt, synthetic construct
  misc_feature 1..327: note = derived and/or modified sequence opt5 from HuMab-072_LightChain_VJ-Region
  source 1..327: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttcccctagactcacctttggcggcgggacaaaagtggagatcaag

SEQ ID NO: 38588 - RNA, 363 nt, synthetic construct
  misc_feature 1..363: note = derived and/or modified sequence opt5 from HuMab-084_HeavyChain_VDJ-Region
  source 1..363: mol_type = other RNA
caggtgcaactggtccagagcggcgccgaggttaagaaacccgggtcctctgtgaaggtgagctgcaaggcttccggaggcaccttcagaacatacgccatcaactgggtccggcaggcgcctgggcagggactcgaatggatgggccgcattaatacggtgctggggatcgttaaccacgctcaaaaatttcagggaagagtgaccattacagccgacaaatctaccaatacagcctatatggagcttaacagcctgcggtccgaagataccgctgtctactattgtgcccgcgagaagggcgtggactactattacggcatcgaagtttgggggcagggaacaaccgtgacggtctctagc

SEQ ID NO: 38589 - RNA, 321 nt, synthetic construct
  misc_feature 1..321: note = derived and/or modified sequence opt5 from HuMab-084_LightChain_VJ-Region
  source 1..321: mol_type = other RNA
gacatccagatgacccaaagcccctcctctgtgagcgcctccgtcggcgatagagttacaattacgtgccgggcttctcaggggatcagctcctggctggcctggtaccagcacaagcctggaaaagcgccgaagctcctgatttatgtggcttctacccttcagagcggcgtgccctcccgcttcagcgggtctggatccggcacagactttaccctgacaatcagctctctccaacctgaggatttcgccacctactattgtcagcaggccaactcctttcccctgacattcgggggaggcaccaaagtcgaaattaag

SEQ ID NO: 38590 - RNA, 360 nt, synthetic construct
  misc_feature 1..360: note = derived and/or modified sequence opt5 from HuMab-091_HeavyChain_VDJ-Region
  source 1..360: mol_type = other RNA
caggtgcaactgcagcagtggggcgccgggctcctgaagcccagcgagaccctttccctgacatgcgctgtctctggaggcagcttctccgggtactattggacgtggatcagacagcctccgggaaaaggcctcgaatggattggggagatctaccactctggagacaccaactataatcccagcctgaagtcccgggttacaatttctgtggataccagcaaaaaccaattttcccttaagctgtacagcgtgacagccgcggacaccgctgtctattactgtgcccgcctctatttcggctctggcatctactacctggattattgggggcagggaacactggtgaccgtttccagc

SEQ ID NO: 38591 - RNA, 321 nt, synthetic construct
  misc_feature 1..321: note = derived and/or modified sequence opt5 from HuMab-091_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgtttggtaccagcagaagcctgagaaagccccgaagtctctgatttatgcggctagctcccttcaaagcggagtgccctctcgcttctccggcagcgggtctggaaccgactttacactgaccatctccagcctccagcctgaagatttcgccacatactattgtcagcagtacaactcttttccccctaccttcggccaagggacaaaagtggagattaag

SEQ ID NO: 38592 - RNA, 366 nt, synthetic construct
  misc_feature 1..366: note = derived and/or modified sequence opt5 from HuMab-093_HeavyChain_VDJ-Region
  source 1..366: mol_type = other RNA
gaggtgcagctggtccaaagcggcgccgaagttaagaaacccggggagtccctcaagatctcttgcaaaggaagcggctactccttcacctcttattggattgggtgggtgagacagatgcctggaaagggcctggaatggatggggcggatctacccgggagacagcgatacacgctattccccctcttttcagggccaggtgacgattagcgctgacaaatccatcaccacagcctaccttcaatggagctctctgagagcgtccgataccgctatgtattactgtgcccggcagcgcggcgactattactacttctttgggctcgatatttggggacagggcacaaccgtcacagtgagcctg

SEQ ID NO: 38593 - RNA, 372 nt, synthetic construct
  misc_feature 1..372: note = derived and/or modified sequence opt5 from HuMab-098_HeavyChain_VDJ-Region
  source 1..372: mol_type = other RNA
gaggtgcagctgctcgaaagcggcgggggactggtccaacccggcgggtcccttagactgtcttgcgccgctagcggattcaccttttccaattacggcatgtcttgggttcggcaggcccctgggaagggactcgagtgggtgagcgcgatctccggctctgcttatagcacatactatgccgactccgtgaaaggccgcttcacgattagcagagataattctaagaacaccctgtggcttcagatgaactccctgcgggccgaagacacagctgtctactattgtgccaaagctcactaccatgggagcggatcttattacaccctctttgattactggggccaggggacactggtgaccgtttccagc

SEQ ID NO: 38594 - RNA, 321 nt, synthetic construct
  misc_feature 1..321: note = derived and/or modified sequence opt5 from HuMab-098_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttatccctacacctttggccaagggacaaaactggagattaag

SEQ ID NO: 38595 - RNA, 372 nt, synthetic construct
  misc_feature 1..372: note = derived and/or modified sequence opt5 from HuMab-100_HeavyChain_VDJ-Region
  source 1..372: mol_type = other RNA
gaggtgcagctgctcgaaagcggcgggggactggtccaacccggcgggtcccttagactgtcttgcgccgctagcggattcacctttaataattacggcatgaactgggttcggcaggcccctgggaagggactcgagtgggtgtccgcgatctctggcacaggctatagcacgtactatgctgactccgtgaaagggcgcttcaccatttctagagataatagcaagaacacactgtaccttcagatgaactccctgcgggccgaagacaccgccgtctattactgtgctaaagcccactattttggaagcggctcttactacacactcttcgattattgggggcagggaaccctggtgacagtttccagc

SEQ ID NO: 38596 - RNA, 372 nt, synthetic construct
  misc_feature 1..372: note = derived and/or modified sequence opt5 from HuMab-106_HeavyChain_VDJ-Region
  source 1..372: mol_type = other RNA
gaggtgcagctggtccaaagcggcgccgaagttaagaaacccggggagtccctcaagatctcttgcaaaggaagcggctactccttcaccagatattggattgggtgggtgcggcagatgcctggaaagggcctggaatggatggggatcatttacccgggagactctgatacacgctatagcccctcctttcagggccaggtgacgatctctgctgacaaaagcatttccaccgcctaccttcaatggagctctctgaaggcgtccgatacagctatgtattactgtgccagactcaccggcgaccgggggttcgattattacagcggaatggacgtctggggccaggggacaaccgtgacagtttcttcc

SEQ ID NO: 38597 - RNA, 321 nt, synthetic construct
  misc_feature 1..321: note = derived and/or modified sequence opt5 from HuMab-106_LightChain_VJ-Region
  source 1..321: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttcctttaccttcggccctggcacaaaagtggatatcaag

SEQ ID NO: 38598 - RNA, 351 nt, synthetic construct
  misc_feature 1..351: note = derived and/or modified sequence opt5 from HuMab_10F8_HeavyChain_V-Region
  source 1..351: mol_type = other RNA
caggtgcaactggtcgagagcggcgggggagttgtgcagcccggcagatccctccggctgtcttgcaccgccagcgggttcacattttcccactacggaatgtattgggtgcgccaggctcctggcaaggggcttgaatgggtcgccgtgatctggtacgacggatcttatgagtacaacgaagatagcgttaaaggcagattcacgatttcccgggacaattctaagaacaccctgtatctccagatgaatagcctgcgcgcggaggatacagctgtgtactattgtgccagagaccgggtcggcctttttgattactgggggcaaggaaccctggtgacagtttccagc

SEQ ID NO: 38599 - RNA, 408 nt, synthetic construct
  misc_feature 1..408: note = derived and/or modified sequence opt5 from HuMab_10F8_HeavyChain_V-Region_Precursor
  source 1..408: mol_type = other RNA
atggagttcggcctgagctgggtgtttctcgtcgccctgcttagaggggttcagtgccaagtgcagctggtggaatccggaggcggggtcgtgcagcccggacggtctctccgcctgagctgtaccgcttccggcttcacattttctcactacgggatgtattgggttagacaggcccctggaaagggccttgagtgggtggcggtcatctggtacgacggcagctatgaatacaatgctgattccgtgaaagggcggttcacgatttctcgcgacaatagcaagaacaccctgtatctccaaatgaactccctgagagccgaggatacagccgtttactattgcgctcgggaccgcgtgggactgtttgattactggggccaggggaccctcgtcacagtgagctct

SEQ ID NO: 38600 - RNA, 321 nt, synthetic construct
  misc_feature 1..321: note = derived and/or modified sequence opt5 from HuMab_10F8_LightChain_V-Region
  source 1..321: mol_type = other RNA
gagatcgtgctgacccagagccccggcacactctccctgtctcctggggaaagagccacgcttagctgccgggcttcccaatctattagctcctcttacctggcctggtatcagcagaagccgggacaggcgccccgcctcctgatctacggccctagctccagagctaccgggattcccgaccggttcagcggatctggctccgggacagattttacccttacaatcagccgcctggagcctgaagacttcgccgtctattactgtcaacagtatgccggatctctcacctttggccccggcacaaaagttgatattaag

SEQ ID NO: 38601 - RNA, 381 nt, synthetic construct
  misc_feature 1..381: note = derived and/or modified sequence opt5 from HuMab_10F8_LightChain_V-Region_Precursor
  source 1..381: mol_type = other RNA
atggagacccccgcccagctcctgttcctgcttctgctctggctgcctgacacaacgggcgaaatcgtgcttacccaaagcccggggacactgtccctctctcccggagagagagctaccctgagctgccgggcctcccagtctattagctcctcttacctggcgtggtatcagcagaagcctggccaagctccccgcctcctgatctacgggcctagctccagagccacaggcattcccgatcggtttagcggatctgggtccggaaccgacttcacacttaccatcagccgcctggaacctgaggattttgccgtctattactgtcagcagtatgctggctctctcacgttcggcccggggaccaaagttgacattaag

SEQ ID NO: 38602 - RNA, 357 nt, synthetic construct
  misc_feature 1..357: note = derived and/or modified sequence opt5 from HuMab-111_HeavyChain_VDJ-Region
  source 1..357: mol_type = other RNA
caggtgcaactggtccagagcggcgccgaggttaagaaacccgggtcctctgtgaaggtgagctgcaaggcttccggaggcaccttctctagctacgggatctcctgggtcagacaggcccctggaccgggcctcgaatggatggggcggattatccccattctgggaatcgcgaactatgctcagaaatttcaaggccgcgtgacaattacggccgacaaatctaccaatacagcctacatggagcttagctccctgagaagcgaagataccgctgtttattactgtgcccgggaccaggagtattcttccaactggtactattggggccaggggacactcgtgaccgtcagctct

SEQ ID NO: 38603 - RNA, 321 nt, synthetic construct
  misc_feature 1..321: note = derived and/or modified sequence opt5 from HuMab-111_LightChain_VJ-Region
  source 1..321: mol_type = other RNA
gagatcgtgctgacccagagccccggcacactctccctgtctcctggggaaagagccacgcttagctgccgggcttcccaatctgtccgcagctcctacctggcctggtatcagcagaagccgggacaggcgcccagactcctgatttacggcgcttctagccgggccaccgggatccctgaccgcttctccggaagcggctctgggacagattttacccttacaatttccagactggagcccgaagacttcgccgtttattactgtcaactctatggaagctctcctacctttggccccggcacaaaagtggatatcaag

SEQ ID NO: 38604 - RNA, 363 nt, synthetic construct
  misc_feature 1..363: note = derived and/or modified sequence opt5 from HuMab-123_HeavyChain_VDJ-Region
  source 1..363: mol_type = other RNA
caggtgcaactggtccagagcggcgccgaggttaagaaacccggggcttccgtgaaggtgtcttgcaaagccgcgggatacaccttcacaaactatggcatcagctgggtcagacaggctcctgggcaggccctcgaatggatgggatggattacgacctactcctctaatacaatctatgcccaaaagctgcagggccgggtgaccatgacaaccgacacaagcacctccacggcttacatggagcttcgctctctgagaagcgatgacaccgccgtttattactgtgctcgggatcgcgtggtcgtgagaccggactattttgattactgggggcagggaacactcgttaccgtgtccagc

SEQ ID NO: 38605 - RNA, 321 nt, synthetic construct
  misc_feature 1..321: note = derived and/or modified sequence opt5 from HuMab-123_LightChain_VJ-Region
  source 1..321: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacacctctaacagagccacaggaatccctgcccggttcagcggctccgggagcggaaccgattttacacttaccatttcttccctggagcccgaagacttcgctgtttattactgtcaacagcgcagccactggcctagaacatttggccaggggaccaaagtggagatcaag

SEQ ID NO: 38606 - RNA, 363 nt, synthetic construct
  misc_feature 1..363: note = derived and/or modified sequence opt5 from HuMab-124_HeavyChain_VDJ-Region
  source 1..363: mol_type = other RNA
caggtgcaactggtccagagcggcgccgaggttaagaaacccggggcttccgtgaaggtgtcttgcaaagccgcgggatacaccttcacaaactatggcatcagctgggtcagacaggctcctgggcagggactcgaatggatgggctggattatcacgtacaatgggaacaccatttatgcccaacggtttcaggaccgcgtgacaatgaccacagatacctccacatctaccgcctacatggagctgagaagccttcggtccgacgatacggctgtttattactgtgcccgcgacagaatcattgtgcggccggattatttcgactactggggacagggcaccctggtcacagtgtctagc

SEQ ID NO: 38607 - RNA, 372 nt, synthetic construct
  misc_feature 1..372: note = derived and/or modified sequence opt5 from HuMab-125_HeavyChain_VDJ-Region
  source 1..372: mol_type = other RNA
gaggtgcagctgctcgaaagcggcgggggactggtccaacccggcgggtcccttagactgtcttgcgccgctagcggattcacctttacagactacgccatgaactgggttcggcaggcgcctggcaaggggctcgagtgggtgtccacgatctctggaagcggctatgctacctactatgccgattccgtgaaaggccgcttcacaatttctagagacaatagcaagaccacactgtaccttcagatgaactccctgcgggccgaagataccgctgtctattactgtgccaaagggcacacactcggaagcggctcttattacaccctgtttgactactgggggcagggaacgctggtgaccgtttccagc

SEQ ID NO: 38608 - RNA, 321 nt, synthetic construct
  misc_feature 1..321: note = derived and/or modified sequence opt5 from HuMab-125_LightChain_VJ-Region
  source 1..321: mol_type = other RNA
gacatccagatgacccaaagcccctcctctctgagcgcctccgtgggcgatagagtcacaattacgtgccgggcttctcaggggatcaacagctggctcgcctggtaccagcagaagcctgagaaagcgccgaagtccctgatttatgctgcctctagccttcaatccggagttcccagccgcttctctggctccgggagcggaaccgactttacactgaccatctcttccctccagcctgaagatttcgccacatactattgtcagcagtacaatagctatccctacacctttggccaagggacaaaactggagattaag

SEQ ID NO: 38609 - RNA, 369 nt, synthetic construct
  misc_feature 1..369: note = derived and/or modified sequence opt5 from HuMab-127_HeavyChain_VDJ-Region
  source 1..369: mol_type = other RNA
gaggtgcagctggtccaaagcggcgccgaagttaagaaacccggggagtccctcaccatctcttgcaagggaagcggctactccttctctatttattggatcgggtgggtgagacagatgcctggaaaaggcctggaatggatggggattatctttccgggagacagcgatattcggtactccccctctttccagggccaggtgacaatcagcgctgacaagtccatcagcacggcctatcttcaatggtcttccctgaaagcgagcgataccgctatgtactattgtgcccgccagcctggcgactggtctcccagacactggtactttgatctctgggggcggggaacactggtcaccgtgtccagc

SEQ ID NO: 38610 - RNA, 321 nt, synthetic construct
  misc_feature 1..321: note = derived and/or modified sequence opt5 from HuMab-127_LightChain_VJ-Region
  source 1..321: mol_type = other RNA
gtgatctggatgacccagagcccctccctgctctctgccagcacaggcgacagagtcacgatttcctgccggatgtctcaagggatcagctcctacctggcttggtatcagcagaagcctggaaaagccccggagcttctgatttacgcggcttctaccctccagagcggcgttccctcccgcttcagcgggtctggatccggcacagattttaccctgacaatcagctatcttcaatctgaagacttcgccacctactattgtcagcagtactattcctttcctctgacattcgggggaggcaccaaggtggagattaaa

SEQ ID NO: 38611 - RNA, 357 nt, synthetic construct
  misc_feature 1..357: note = derived and/or modified sequence opt5 from HuMab-129_HeavyChain_VDJ-Region
  source 1..357: mol_type = other RNA
caggtgcaactggtcgagagcggcgggggagttgtgcagcccggcagatccctccggctgtcttgcgccgctagcgggttcaccttttccacattcgccatccactgggtgcgccaggcgcctggaaagggccttgaatgggtcgctgtgatttcttacgacgggggacataaattttatgccgatagcgttaagggcagattcacgatctcccgggacaactctaaaaataccctgtacctccagatgaacagcctgcgcgccgaggatacagctatgtattactgtgccagaggccttggggtgtggggagcttttgactattggggccaagggaccctggtcacagtgtccagc

SEQ ID NO: 38612 - RNA, 318 nt, synthetic construct
  misc_feature 1..318: note = derived and/or modified sequence opt5 from HuMab-129_LightChain_VJ-Region
  source 1..318: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggtggacctttggccaggggacaaaagtggagatcaag

SEQ ID NO: 38613 - RNA, 375 nt, synthetic construct
  misc_feature 1..375: note = derived and/or modified sequence opt5 from HuMab-132_HeavyChain_VDJ-Region
  source 1..375: mol_type = other RNA
caggtgcaactggtccagagcggcgccgaggttaagaaacccggggcttccgtgaaggtgtcttgcaaagccagcggatacaccttcacatcctatggcatctcttgggtcagacaggcgcctgggcagggactcgaatggatgggctggattagcgcttacaacggaaattccaactatgtgcaaaagtttcaggggcgggttacgatgaccacagacaccacaacctctacagcctacatggagctgcgcagccttacctccgatgacacggccgtgtattactgtgctagagaatatagctacgattctggcacctacttctattacggcatggacgtctgggggcagggaacaaccgtgacagtttccagc

SEQ ID NO: 38614 - RNA, 324 nt, synthetic construct
  misc_feature 1..324: note = derived and/or modified sequence opt5 from HuMab-132_LightChain_VJ-Region
  source 1..324: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctatgtatacctttggccaggggacaaaactcgagatcaag

SEQ ID NO: 38615 - RNA, 360 nt, synthetic construct
  misc_feature 1..360: note = derived and/or modified sequence opt5 from HuMab-143_HeavyChain_VDJ-Region
  source 1..360: mol_type = other RNA
caggtgcaactgcagcagtggggcgccgggctcctgaagcccagcgagaccctttccctgacatgcgctgtctacggaggctctttcagcgggtattactggaactggatcagacagcctccgggaaaaggcctcgaatggattggggagatccaccattccggatctgccaattataaccccagcctgatgtcccgggttacgatttctgtggacaccagcaagaatcaattttcccttcagctgagctctgtgacagcggctgataccgccgtctactattgtgcccgcggctactatggctccgggtactactatttcgactactggggacagggcacactcgtgaccgttagctct

SEQ ID NO: 38616 - RNA, 321 nt, synthetic construct
  misc_feature 1..321: note = derived and/or modified sequence opt5 from HuMab-143_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagccgccttcaatccggagttcccagcagattctctggctccgggagcggaaccgactttacactgaccatctcttccctccagcctgaagatttcgccacatactattgtcagcagtacaacagctatcccattacctttggccaagggacacggctggagatcaaa

SEQ ID NO: 38617 - RNA, 366 nt, synthetic construct
  misc_feature 1..366: note = derived and/or modified sequence opt5 from HuMab-150_HeavyChain_VDJ-Region
  source 1..366: mol_type = other RNA
gaggtgcagctggtccaaagcggcgccgaagttaagaaacccggggagtccctcaagatctcttgcaaaggaagcggctactccttcacctcttattggattgggtgggtgagacagatgcctggaaagggcctggaatggatggggagcatctacccgggagactcccacacacggtatcgcccctcttttcagggccaggtgacgattagcgctgataaatccatcagcaccgcctaccttcaatggtcttccctgaaggcgagcgacacagctatgtattactgtgccagacaggccggcgattattactactataacgggatggacgtctggggacagggcaccacagtgaccgtttcttcc

SEQ ID NO: 38618 - RNA, 321 nt, synthetic construct
  misc_feature 1..321: note = derived and/or modified sequence opt5 from HuMab-150_LightChain_VJ-Region
  source 1..321: mol_type = other RNA
gagatcgtgctgacccagagccccggcacactctccctgtctcctggggaaagagccacgcttagctgccgggcttcccaatctgtcagctcctcttacctgacctggtatcagcagaagccgggacaggcgccccgcctcctgatttacggcgccagctccagagctacagggatccctgaccggttcagcggatctggctccgggaccgattttacacttaccattagccgcctggagcccgaagacttcgccgtttattactgtcaacagtatggatcttccctcacatttggcggcgggaccaaagtggagatcaag

SEQ ID NO: 38619 - RNA, 363 nt, synthetic construct
  misc_feature 1..363: note = derived and/or modified sequence opt5 from HuMab-152_HeavyChain_VDJ-Region
  source 1..363: mol_type = other RNA
caggtgcaagtcgttgagagcggcgggggagtggtgcagcccggcagatccctgcggctctcttgcgccgctagcgggttcaccttttcctcttacgccatgcactgggtccgccaggcgcctggaaagggcctggaatgggtggctgttatcagctatgacgggtcctacaaatattacgccgattctgtgaagggaagattcacaattagccgggacaactccaaaaatacgctttatctgcagatgaacagcctccgcgccgaggataccgctgtctactattgtgccagaggctctatcacaggctccaccggggtgtttgactactggggacaaggcacactggttaccgtgagctct

SEQ ID NO: 38620 - RNA, 321 nt, synthetic construct
  misc_feature 1..321: note = derived and/or modified sequence opt5 from HuMab-152_LightChain_VJ-Region
  source 1..321: mol_type = other RNA
gacatccagatgacccaaagcccctcctctctgagcgcctccgtgggcgatagagtcacaattacgtgccgggcttctcaggggatcaacagctggctcgcctggtaccagcagaagcctgagaaagcgccgaagtccctgatttatgacgcttctagccttcaatccggagttcccagccgcttctctggctccgggagcggaaccgattttacactgaccatctcttccctccagcctgaaaatttcgccacatactattgtcagcagtacaacagctatcccattacctttggccaagggacaagactggagatcaaa

SEQ ID NO: 38621 - RNA, 363 nt, synthetic construct
  misc_feature 1..363: note = derived and/or modified sequence opt5 from HuMab-153_HeavyChain_VDJ-Region
  source 1..363: mol_type = other RNA
caggtgcaactggtcgagagcggcgggggagttgtgcagcccggcagatccctccggctgtcttgcgccgctagcgggttcaccttttccgactacgtgatccactgggtccgccaggcccctggaaagggccttgaatgggtgacagttatttcttatgatgggagcaataaatactatgcggactccgtgaagggaagattcacgatctctcgggataatagcaaaaacaccctgtacctccagatgaactccctgagcgctgaggacacagccatgtattactgtgcccgcggcggcattaccgggacaaccggagtctttgattattggggccaagggacacttgtgaccgtttcttcc

SEQ ID NO: 38622 - RNA, 321 nt, synthetic construct
  misc_feature 1..321: note = derived and/or modified sequence opt5 from HuMab-153_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgacgctagctcccttcaaagcggagttccctctcgcttctccggcagcgggtacggaaccgatttttctctgacaatctccagcctccagcctgaagacttcgccatttattactgtcagcagtataaatcttaccccatcacctttggccaagggacaagactggagatcaag

SEQ ID NO: 38623 - RNA, 378 nt, synthetic construct
  misc_feature 1..378: note = derived and/or modified sequence opt5 from HuMab-159_HeavyChain_VDJ-Region
  source 1..378: mol_type = other RNA
gaggtgcagctggtccaaagcggcgccgaagttaagaaacccggggagtccctcaagatctcttgcaaaggaagcggctacaacttcacctcctattggattgggtgggtgagacagatgcctggaaagggcctggaatggatggggatcatttacccgggagactctgatacacggtatagcccctcctttcagggccaggtgacgatctctgctgacaaaagcatttccaccgcctaccttcaatggagctctctgaaggcgtccgatacagctatgtattactgtgcccgctggggcacctattacgacatcctcacagggtacttcaattggtttgatccttggggacagggcaccctggtcacagtgagctct

SEQ ID NO: 38624 - RNA, 321 nt, synthetic construct
  misc_feature 1..321: note = derived and/or modified sequence opt5 from HuMab-159_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtactatatttacccctggacctttggccaagggacaaaagtggagatcaag

SEQ ID NO: 38625 - RNA, 363 nt, synthetic construct
  misc_feature 1..363: note = derived and/or modified sequence opt5 from HuMab-160_HeavyChain_VDJ-Region
  source 1..363: mol_type = other RNA
caggtgcaactggtcgagagcggcgggggagttgtgcagcccggcagatccctccggctgtcttgcgccgctagcgggttcaccttttcctctcacgccatgcattgggtgcgccaggcgcctggaaagggccttgaatgggtcgctgccatcagctacgacgggtccaacaaatattacgccgattctgtgaagggaagattcacaattagccgggacaattccaaaaacacgatgtatctgcagatgaatagcctccgcgctgaggataccgccatgtgttactgcgctagaggctctatcacaggctccaccggggtttttgactattggggacaaggcacactggtgaccgtcagctct

SEQ ID NO: 38626 - RNA, 321 nt, synthetic construct
  misc_feature 1..321: note = derived and/or modified sequence opt5 from HuMab-160_LightChain_VJ-Region
  source 1..321: mol_type = other RNA
gacatccagatgacccaaagcccctcctctctgagcgcctccgtgggcgatagagtcacaattacgtgccgggcttctcaggacatcagctcctggctcgcctggtaccagcagaagcctgagaaagcgccgaagtctctgatttatgctgccagctcccttcaaagcggggttccctctcgcttctccggaagcggctctgggaccgattttacactgaccatctccagcctccagcctgaagacttcgccacatactattgtcagcagtacaactcttatcccattacctttggacaaggcacaagactggagatcaaa

SEQ ID NO: 38627 - RNA, 372 nt, synthetic construct
  misc_feature 1..372: note = derived and/or modified sequence opt5 from HuMab-162_HeavyChain_VDJ-Region
  source 1..372: mol_type = other RNA
gaggtgcagctgtgggaaagcggcgggggatccgtccaacccggcgggtctctcagactgagctgcgccgcttccggattcaccttttctagctacggcatgtcctgggttcggcaggcccctgggaagggacttgagtgggtgtctggcatcagcggctccgggtatagcacatactatgcggactctgtgaaaggacgcttcacgatttccagagataacagcaagaataccctgtacctccagatgaactctctgcgggctgaagacacagccgtctattactgtgccaaaggctattaccacgggtccggaagctactatacctcttttgattactggggccaggggacacttgtgaccgtttccagc

SEQ ID NO: 38628 - RNA, 321 nt, synthetic construct
  misc_feature 1..321: note = derived and/or modified sequence opt5 from HuMab-162_LightChain_VJ-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttatcccctgacctttggcgggggaacaaaagtggagattaag

SEQ ID NO: 38629 - RNA, 366 nt, synthetic construct
  misc_feature 1..366: note = derived and/or modified sequence opt5 from HuMab-163_HeavyChain_VDJ-Region
  source 1..366: mol_type = other RNA
gaggtgcagctggtccaaagcggcgccgaagttaagaaacccggggagtccctcaagatctcttgccagggaagcggctacagattcatttcctattggatcgggtgggtgcggcagatgcctggaaaaggcctggaatggatggggcgcatttacccgggagactctgataccagatatagcccctcctttcagggccaagtgacaatctctgtcgacaagagcatttccacggcttaccttcagtggagctctctgaaagcctccgataccgcgatgtattactgtgctcggcagcgcggcgactattactacttcaacgggctcgatgtgtggggacagggcacaaccgttacagtgagctct

SEQ ID NO: 38630 - RNA, 321 nt, synthetic construct
  misc_feature 1..321: note = derived and/or modified sequence opt5 from HuMab-163_LightChain_VJ-Region
  source 1..321: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttccctcacctttggcggcgggacaaaagtggagatcaag

SEQ ID NO: 38631 - RNA, 363 nt, synthetic construct
  misc_feature 1..363: note = derived and/or modified sequence opt5 from HuMab-166_HeavyChain_VDJ-Region
  source 1..363: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatcagctatgacgggtccaacgagtactatgccgattctgttaaaggaagattcacaattagccgggacaattccaagaacacgctgtacctccagatgaatagcctgcgcgccgaagataccgctgtgtattactgtgccagaggctctatcattggctccacaggggtctttgactattggggacaaggcacccttgtgacagttagctct

SEQ ID NO: 38632 - RNA, 321 nt, synthetic construct
  misc_feature 1..321: note = derived and/or modified sequence opt5 from HuMab-166_LightChain_VJ-Region
  source 1..321: mol_type = other RNA
gacatccagatgacccaaagcccctcctctctgagcgcctccgtgggcgatagagtcacaattacgtgccgggcttctcaggggatcagcaactggctcgcctggtaccagcagaagcctgagaaagcgccgaagtccctgatttatgacgcttctagccttcaatccggagttcccagccgcttctctggctccgggagcggaaccgattttacactgaccatctcttccctccagcctgaagacttcgccacatactattgtcagcagtacaatagctatcccattacctttggccaagggacaagactggagatcaaa

SEQ ID NO: 38633 - RNA, 363 nt, synthetic construct
  misc_feature 1..363: note = derived and/or modified sequence opt5 from HuMab-167_HeavyChain_VDJ-Region
  source 1..363: mol_type = other RNA
caggtgcaactggtcgagagcggcgggggagttgtgcagcccggcagatccctccggctgtcttgcgccgctagcgggttcaccttttcctcttacgccatccactgggtgcgccaggcgcctggaaagggccttgaatgggtcgctgtgattagctatgacgggtccaacaaatactatgccgattctgttaagggaagattcacaatcagccgggacaattccaaaaacacgctgtacctccagatgaatagcctgcgcgccgaggataccgctgtgtattactgtgccagaggctctattacaggctccaccggggtctttgactattggggacaaggcacacttgtgaccgttagctct

SEQ ID NO: 38634 - RNA, 363 nt, synthetic construct
  misc_feature 1..363: note = derived and/or modified sequence opt5 from HuMab-169_HeavyChain_VDJ-Region
  source 1..363: mol_type = other RNA
caggtgcaactggtccagagcggcgccgaggttaagaagcccggggcttccgtgaaggtgtcttgcaaagccagcggatacaccttcacaaactatggcatctcctgggtcagacaggcgcctgggcagggactcgaatggatgggctggctgtctgcttacagcgggaatacgatttatgcccaaaaacttcagggacgggtgaccatgacaaccgacacatccaccacaaccgcctacatggagctgcgctctctcagaagcgatgacacggctgtttattactgtgcccgggatcgcatcgtggtcagaccggactattttgattactggggccagggcaccctggtgacagtttccagc

SEQ ID NO: 38635 - RNA, 321 nt, synthetic construct
  misc_feature 1..321: note = derived and/or modified sequence opt5 from HuMab-169_LightChain_VJ-Region
  source 1..321: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctagaacctttggccaggggacaaaagtggagatcaag

SEQ ID NO: 38636 - RNA, 366 nt, synthetic construct
  misc_feature 1..366: note = derived and/or modified sequence opt5 from HuMab-7D8_HeavyChain_VH-Region
  source 1..366: mol_type = other RNA
gaggtgcagctggtcgaaagcggcgggggactcgttcaacccgacagatccctgcggctttcttgcgccgctagcggcttcacctttcacgattacgccatgcattgggtgcgccaggcgcctgggaagggactggagtgggtgtccacaatctcttggaacagcggcacgattgggtatgctgactccgtcaaaggaagattcaccatctctcgggataatgccaagaacagcctctacctgcagatgaactcccttcgcgccgaagacacagctctgtattactgtgccaaagatattcagtatggcaattactattacggcatggacgtgtgggggcaaggaaccacagttaccgtgagctct

SEQ ID NO: 38637 - RNA, 366 nt, synthetic construct; identical to SEQ ID NO: 38636
  misc_feature 1..366: note = derived and/or modified sequence opt5 from HuMab-7D8_HeavyChain_V-Region
  source 1..366: mol_type = other RNA

SEQ ID NO: 38638 - RNA, 321 nt, synthetic construct
  misc_feature 1..321: note = derived and/or modified sequence opt5 from HuMab-7D8_LightChain_VL-Region
  source 1..321: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctatcacctttggccaggggacaagactcgagattaaa

SEQ ID NO: 38639 - RNA, 321 nt, synthetic construct; identical to SEQ ID NO: 38638
  misc_feature 1..321: note = derived and/or modified sequence opt5 from HuMab-7D8_LightChain_V-Region
  source 1..321: mol_type = other RNA

SEQ ID NO: 38640 - RNA, 324 nt, synthetic construct
  misc_feature 1..324: note = derived and/or modified sequence opt5 from huMAb-anti-MSP10.1_LightChain_VJ-Region
  source 1..324: mol_type = other RNA
gagatcgtgctgacccagagccccgacattctctccctgtctcctggcgaaagagccacacttagctgccgggcttcccaagccctgacggcgaagtacctcgcttggtatcagcagaaaccggggcaggtcccccgcctgcttatctacggatctagcaccagagccacaggcattcctgatcggttccgcgggtccggatctggcaccgactttacactgaccatcagcagactcgagcccgccgattccgctgtttattactgtcaacagtatgaagacagcccttggacattcgggcagggaaccaagctggagattaaa

SEQ ID NO: 38641 - RNA, 324 nt, synthetic construct
  misc_feature 1..324: note = derived and/or modified sequence opt5 from huMAb-anti-MSP10.2_LightChain_VJ-Region
  source 1..324: mol_type = other RNA
gagatcgtgctgacccagagccccgacacactctccctgtctcctggcgaaacggccacccttagctgcagagcttcccaaacagtccggcgcaactctctggcctggtaccagcagaagccggggcaggcgcccagactcctgatttatggagctagcgatcgggccaccggcatccctgaccgcttctccgggtctggatttggcacagatttcacccttacagttagcgggctggagcccgaagactttgccgtgtactattgtcaacagtacggaacctcccctagaacgttcggccagggcaccaaactcgagattaag

SEQ ID NO: 38642 - RNA, 324 nt, synthetic construct
  misc_feature 1..324: note = derived and/or modified sequence opt5 from HUMAB-Clone_18_VJ-Region
  source 1..324: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaaaagagccaccggaatccctgctcggttcagcggctccgggagcggaacagattttacccttacaatttcttccctggagcccgaagacttcgccgtttattactgtcaacagcgcagcaagtggcctccctggacctttggccaggggacaaaagtggagtctaag

SEQ ID NO: 38643 - RNA, 324 nt, synthetic construct
  misc_feature 1..324: note = derived and/or modified sequence opt5 from HUMAB-Clone_22_VJ-Region
  source 1..324: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaaatggcctccctggacctttggccaggggacaaaggtggagatcaaa

SEQ ID NO: 38644 - RNA, 432 nt, synthetic construct
  misc_feature 1..432: note = derived and/or modified sequence opt5 from HuMab-L612_Chain_VDJ-Region_Precursor
  source 1..432: mol_type = other RNA
atggagttcggcctgacctggctctttctggtggccaaccttaagggggtccagtgcgaagttcaactgctcgacagcggaggcgggctggtgcagcccggaggctgtcttagactgtcctgcgctgcctctgggttcacatttagctcctgtgcgatgtcttgggtgcggcaggctcctggaaaaggcctcgagtgggtcagcgccatctccggctctgggggaagcacgtactatgccgattccgtgaagggccgcttcaccattagcagagacaaatctaagaatacactgtacctgcagatgaactccctccgggctgaagataccgccgtttattactgcgctaaagggggaaatgacatcctgacaggctattacgcctgggggcaaggaacccttgtgacagtcagctctggctccgcgagcgcc

SEQ ID NO: 38645 - RNA, 321 nt, synthetic construct
  misc_feature 1..321: note = derived and/or modified sequence opt5 from HuMab_LC5002-002_LightChain_V-Region
  source 1..321: mol_type = other RNA
gacatccagatgacccaaagcccctcctctctgagcgcctccgtgggcgatagagtcacaattacgtgccgggcttctcaggggatcagccgctgggttgcctggtaccagcagaagcctgagaaagcgccgaagtccctcatttatgctgcctctagcctgcaatccggagtgcccagcagattctctggctccgggagcggaaccgactttacacttaccatctcttccctgcagcctgaagatttcgccacatactattgtcagcagtacaacagctatccctggacctttggccaagggacaaaagtggagattaag

SEQ ID NO: 38646 - RNA, 357 nt, synthetic construct
  misc_feature 1..357: note = derived and/or modified sequence opt5 from HuMab_LC5002-002_gamma1-Chain_V-Region
  source 1..357: mol_type = other RNA
gaggtgcagctgctcgaaagcggcgggggactggtccaacccggcgggtcccttagactgtcttgcgccgctagcggattcacctttaacatctacgccatgaattgggttcggcaggcgcctggcaaggggctcgagtgggtgtccgtgatttctggacgcggcatcacaacgtattacgctgacagcgtcaaaggcagattcaccatttcccgggataactctaagaatacactgtatcttcagatgaacagcctgcgcgccgacgataccgccgtgtactattgtgctaaagggtccagctcttggacagactttgattactggggacagggcaccctcgttacagtgtccagc

SEQ ID NO: 38647 - RNA, 321 nt, synthetic construct
  misc_feature 1..321: note = derived and/or modified sequence opt5 from HuMab_LC5002-003_LightChain_V-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttatccctggacctttggccaagggacaaaagtggagattaag

SEQ ID NO: 38648 - RNA, 357 nt, synthetic construct
  misc_feature 1..357: note = derived and/or modified sequence opt5 from HuMab_LC5002-003_gamma1-Chain_V-Region
  source 1..357: mol_type = other RNA
gaggtgcagctgctcgaaagcggcggggacctgatccaacccggaggctcccttagactgtcttgcgccgctagcgggttcacctttaacatttacgccatgaattgggtccggcaggcgcctggaaagggcctcgagtgggtttccgtgatctctgggcgcggaattacaacgtattacgctgatagcgtgaaaggcagattcaccatctcccgggacaactctaagaatacactgtatcttcagatggatagcctgcgcgccgaagacaccgccgtctactattgtgctaaaggctccagctactggacagattttgactattgggggcagggaaccctcgtgacagtttcttcc

SEQ ID NO: 38649 - RNA, 321 nt, synthetic construct
  misc_feature 1..321: note = derived and/or modified sequence opt5 from HuMab_LC5002-005_LightChain_V-Region
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactctcaccctcccacctttggccaagggacaaaactggagattaag

SEQ ID NO: 38650 - RNA, 354 nt, synthetic construct
  misc_feature 1..354: note = derived and/or modified sequence opt5 from HuMab_LC5002-005_gamma1-Chain_V-Region
  source 1..354: mol_type = other RNA
gaggtgcaggtcctggacagcggcgggggactcgttcaacccggcgggtccctgagactttcttgcaccgccagcggattcacatttcggctgtacacgatgtcctgggtgcgccagacccctggcagagggctcgaatgggtgtctggaatcagcggctccggcctgtctacatatttcgctgatagcgtcaaggggcggtttaccatttcccgcgacaacagcaaaaatacagtgtaccttcagatgaactctctgagagccgaggataccgcggtttattactgtgctaaggaaggagactggatctatttcgattcctggggccaggggacactcgtgattgtcagctct

SEQ ID NO: 38651 - RNA, 321 nt, synthetic construct
  misc_feature 1..321: note = derived and/or modified sequence opt5 from HuMab_LC5002-007_LightChain_V-Region
  source 1..321: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccatcgggattcctgaccggttcagcggatctggctccgggaccgattttacacttaccatcagccgcctggagcccgaagacttcgccgtttattactgtcaacactatggatcttccctcacatttggcggcgggaccaaagtggagattaag

SEQ ID NO: 38652 - RNA, 369 nt, synthetic construct
  misc_feature 1..369: note = derived and/or modified sequence opt5 from HuMab_LC5002-007__gamma1-Chain_V-Region
  source 1..369: mol_type = other RNA
caggtgcaactggtccagagcggcgccgaggttaagaaacccgggtcctctgtgaaggtgagctgcaaagtctccggaggcaccttctctagctacgctttttcctgggtgagacaggcccctgggcagggactcgaatggatgggccggatcattccgatcctggggcgcacaaactatgcgcaaaagttccagggaagagttacgattaccgctgacaaatctacaagcaccgcctacatggaggtgtccagccttcggtctgaagatacagccgtctattactgtgctcgcgagggcgaaaccctggactatttttactatggcatggatgtgtgggggcagggaacaaccgttacggtgtccagc

SEQ ID NO: 38653 - RNA, 357 nt, synthetic construct
  misc_feature 1..357: note = derived and/or modified sequence opt5 from HuMab_LC5002-018_gamma1-Chain_V-Region
  source 1..357: mol_type = other RNA
gaggtgcagctgctcgaaagcggcgggggactggtccaacccggcgggtcccttagactgtcttgcgccgctagcggattcacctttaacatctacgccatgaattgggttcggcaggcgcctggcaaggggctcgagtgggtgtccgtgatttctggaagcggcgtcacaacgtattacgctgactccgtgaaaggccgcttcaccatctctagagataacagcaagaatacactgtatcttcagatgaactccctgcgggccgaagacaccgccgtttactattgtgctaaagggagctcttggtacgtggattttgactattggggacagggcacactcgtcaccgtgtccagc

SEQ ID NO: 38654 - RNA, 1347 nt, synthetic construct
  misc_feature 1..1347: note = derived and/or modified sequence opt5 from Ibalizumab_HeavyChain1
  source 1..1347: mol_type = other RNA
caggtgcagctgcagcagagcggccccgaggtcgttaagcctggggcctccgtgaaaatgtcttgcaaggctagcggatacaccttcacatcctatgtgatccactgggtcagacagaaaccgggccaagggctcgactggattggatacatcaacccctataatgatggcacggactacgatgaaaagtttaaagggaaggccaccctgacatctgacaccagcacatccaccgcgtatatggagctttctagcctgcggtccgaagatacagctgtgtactattgtgcccgcgagaaggacaactacgccaccggagcttggttcgcctactggggccagggcacgctcgttaccgtgagctctgcttccacaaaagggcctagcgtctttcccctggccccttgctctagatccaccagcgaatctacagcggcccttggatgtctggtgaaggattatttccccgagcctgttaccgtgtcctggaatagcggcgctctcacgtccggggtccatacatttccggccgtgctgcagtctagcggactgtactccctcagctctgtggtcaccgttccctccagctctctgggcacaaaaacctatacctgcaacgtggaccacaagcctagcaatacaaaagtggataagcgggtcgagtccaagtacgggcccccttgtccctcttgcccggctcctgagttccttggaggccccagcgtgtttctgttccctcccaaacccaaggacacgctcatgatttcccgcacccctgaggttacatgtgtggtcgtggatgttagccaggaagacccggaggtgcaatttaactggtatgtcgatggcgtggaggtccataatgccaaaaccaagcccagagaagaacagttcaactctacataccgggtggtttccgtgctgaccgtccttcaccaggactggctgaatgggaaagaatataagtgcaaagtgagcaacaagggactcccttcttccatcgagaagacgattagcaaagcgaagggccagccccgcgaacctcaagtttacacactgcccccgtcccaggaggagatgaccaaaaatcaggtgtctctgacctgtctcgtcaaggggttttaccctagcgacatcgccgtggaatgggagtccaacggacaacccgaaaataactataaaacaacccctcccgtgctggattctgacggcagcttctttctttactccagactgacagttgataagagccggtggcaggaggggaatgtcttctcttgctccgtgatgcatgaagctctccacaaccactatacgcaaaagagcctgtctctttccctgggaaaa

SEQ ID NO: 38655 - RNA, 657 nt, synthetic construct
  misc_feature 1..657: note = derived and/or modified sequence opt5 from Ibalizumab_LightChain1
  source 1..657: mol_type = other RNA
gacatcgtgatgacccagagccccgattccctggccgtctctctcggcgagagagttacaatgaactgcaagagctcccaatctctgctttacagcacgaatcagaaaaactatctggcttggtaccagcagaagcctgggcaatccccgaaactcctgatttattgggcctctacccgggaaagcggagtgcccgaccgcttctccggcagcgggtctggaacagattttacccttacaatctccagcgtgcaggcggaggacgtcgctgtgtactattgtcagcagtactattcttacagaaccttcggcgggggaacaaagctggaaattaaacggaccgttgccgccccttccgtgtttatctttccccctagcgatgagcaactcaagtctggcacggcttccgtcgtgtgcctgctgaataacttctacccccgcgaagccaaggttcagtggaaagtggacaatgctctccagagcggcaactcccaggagtctgtcaccgagcaagatagcaaggactccacatatagcctgtcttccacccttacactgagcaaagccgattacgaaaagcacaaagtgtatgcgtgtgaggtgacccatcaggggctctctagccctgtcacgaagtccttcaatagaggagaatgc

SEQ ID NO: 38656 - RNA, 1329 nt, synthetic construct
  misc_feature 1..1329: note = derived and/or modified sequence opt5 from Ibritumomab_tiuxetan_HeavyChain
  source 1..1329: mol_type = other RNA
caggcctacctgcaacagagcggcgccgagctcgtgagacccggggcctccgtcaagatgtcttgcaaagcgagcggatataccttcacatcctacaacatgcactgggttaagcagacgcctcggcagggcctggaatggatcggggctatttatccgggaaatggcgacacctcttacaaccaaaaatttaaggggaaagccacacttaccgtggataagagctcctctacagcctatatgcagctgagctccctcaccagcgaggactctgctgtgtacttctgtgcccgcgtcgtgtattactccaatagctactggtattttgatgtttggggaacaggcaccacggtgaccgtctctgctccctccgtgtaccctctggcccccgtttgcggcgacacaaccgggagctctgtgacacttggatgtctggtcaagggctatttccctgaacccgtgaccctcacgtggaactccgggagcctgtcctctggagtgcatacatttcctgcggtcctgcagagcgatctctacaccctgtccagctctgttacagtgacctccagcacctggccgtctcagagcatcacatgcaatgtggcccaccccgcttcctctacgaaagtcgacaagaaaattgagcctagaggccccaccatcaagccttgtcccccgtgcaaatgtcctgcccccaaccttctcgggggacctagcgtgttcatttttcctcccaagatcaaggatgttctgatgatctccctgagccccattgtgacatgcgtcgtggttgacgtgtctgaagatgacccggatgtccaaatctcctggttcgtgaataacgtcgaggtgcataccgctcagacacagacccaccgggaggactataatagcacgcttcgcgttgtgtctgccctgcccattcagcatcaagattggatgtccggcaaagaatttaagtgtaaagtcaacaataaggacctccctgcgcccatcgagagaacaattagcaaacctaagggctccgtgcgggctccccaggtttacgtgctgccgcctcccgaagaggagatgaccaaaaagcaggtcaccctgacatgcatggtgaccgacttcatgcctgaagatatctatgtggagtggacaaacaatgggaagacggaactcaactacaaaaataccgagcccgttctggactctgatggaagctactttatgtattccaaacttcgcgtcgagaaaaagaactgggtggaaagaaactcttacagctgttccgtggtccacgagggcctgcacaatcatcacacaaccaagagcttctctcgg

SEQ ID NO: 38657 - RNA, 627 nt, synthetic construct
  misc_feature 1..627: note = derived and/or modified sequence opt5 from Ibritumomab_tiuxetan_LightChain
  source 1..627: mol_type = other RNA
cagatcgtgctgagccaatcccccgccattctctctgctagccctggcgagaaagtcaccatgacatgcagagcctcctctagcgtttcctacatgcactggtatcagcagaaaccggggtctagccccaagccttggatctacgcgccctccaacctggctagcggagtgcctgcccggttctctggctccgggagcggaacgtcttattcccttaccattagccgcgtggaagccgaggacgctgccacatactattgtcagcaatggtcttttaatccccctaccttcggcgctgggacaaaactggaactcaagagagccgatgcggccccgaccgtctttatctttcccccttccgacgagcagctgaaaagcggaacagcttccgtggtttgccttctgaacaatttctacccccgggaagccaaggtgcagtggaaggtcgataacgctctccagtctggcaatagccaagagtccgtgaccgagcaggacagcaaagattctacgtattccctgagctctaccctgacactcagcaaggccgactacgaaaaacataaggtttacgcgtgtgaggtgacccaccagggcctgtcctctcctgtcacaaagagcttcaac

SEQ ID NO: 38658 - RNA, 1368 nt, synthetic construct
  misc_feature 1..1368: note = derived and/or modified sequence opt5 from Icrucumab_HeavyChain1
  source 1..1368: mol_type = other RNA
caggcccaagtggtcgagagcggcgggggagttgtgcagtccggcagatctctgcggctcagctgcgctgcctccgggttcgcgttttctagctacggaatgcactgggtgcgccaggctcccggcaaggggctggaatgggtcgccgtgatctggtatgacggatccaacaaatactatgccgattctgttagaggccggttcaccattagccgcgacaattccgagaacacactttacctgcagatgaatagcctcagagctgaagatacggccgtgtattactgtgctcgggaccattatggctctggggtccaccattacttttactatggactggatgtgtggggccaagggaccacagttaccgtgtccagcgcctctacaaagggaccttccgtcttcccgcttgcgcccagctctaaatccaccagcggcgggacagccgctctgggatgcctcgtgaaggactactttcctgagcccgtgaccgtctcctggaactctggcgccctgacgagcggcgttcacaccttccctgctgtgctgcagtccagcgggctctattctctgtccagcgtggtcacagtgccctctagctcccttggaacccagacatacatctgtaatgttaaccataaaccttctaataccaaggtggataagcgcgtcgaaccgaaaagctgcgacaagacgcacacatgtcccccttgccccgcccctgagctgctcggcgggccctccgtgtttctgttcccgcctaaacccaaggatacccttatgattagcagaacacctgaggttacctgtgtggtcgtggacgtctctcacgaagatcccgaggtgaaatttaactggtatgttgacggagtggaagtccataatgcgaagaccaagccccgggaggagcagtacaactccacatatcgcgtggttagcgtgctgacggtcctccaccaagattggctgaatggcaaagaatacaagtgcaaagtgtctaacaaggccctgcctgctccgatcgagaaaaccatttccaaggccaaagggcagcccagagaacctcaggtgtacacactgccccctagccgggaggaaatgaccaagaatcaggtttccctcacatgtcttgtcaagggattctatccctctgacatcgctgtggagtgggagagcaacggccaaccggaaaataactacaaaaccacgcctcccgtgctggactccgatggcagctttttcctctattctaagctgacagtcgacaaatcccgctggcagcaggggaacgtgtttagctgctctgttatgcatgaggcccttcacaatcactacacccaaaagtccctgagcctctctcctggaaaa

SEQ ID NO: 38659 - RNA, 645 nt, synthetic construct
  misc_feature 1..645: note = derived and/or modified sequence opt5 from Icrucumab_LightChain1
  source 1..645: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttcccctctcacctttggcggcgggacaaaagtggagatcaagagaaccgtggctgcccccagcgtcttcatttttcctccgtctgatgaacagctgaaatccggaacggctagcgtggtttgcctgctcaacaatttctacccccgggaggccaaggtgcagtggaaagtcgacaacgcgctgcaatccggcaattctcaggagagcgtgaccgaacaggattccaaggacagcacatattctctttccagcaccctgacactctctaaggccgattacgagaaacacaaggtttacgcttgtgaagtgacccatcaggggctgagctcccctgtcacgaaatcttttaaccgcggagagtgc

SEQ ID NO: 38660 - RNA, 675 nt, synthetic construct
  misc_feature 1..675: note = derived and/or modified sequence opt5 from Idarucizumab_HeavyChain1
  source 1..675: mol_type = other RNA
caggtgcaactgcaggagagcggccccgggctcgtcaagccttccgaaaccctgtctcttacatgcacggttagcggattctccctgacctcttacatcgtggactggattagacagccgcccggcaaagggctcgagtggatcggagtgatttgggccggcgggagcacaggatataactccgctctgcggtctcgcgtcagcatcaccaaggatacatccaaaaatcagtttagccttaagctgtcttccgtgaccgccgcggacacagctgtttactattgtgccagcgccgcttactattcttactataactacgatggcttcgcctactggggccaagggaccctcgtgacggtctccagcgcttctaccaaaggaccttccgtgtttcccctggcccctagctccaagtctacaagcggcgggaccgcggccctgggatgcctcgttaaggactatttccccgaacctgtgacagtctcctggaatagcggcgctctgacctctggggtgcacacgtttccggccgtgcttcagtccagcggactgtactctctcagctccgtcgttacagtgccctctagctccctgggcacccagacatatatttgtaacgtgaatcataaacctagcaacaccaaggtcgataaaaaggtggagcccaaatcttgc

SEQ ID NO: 38661 - RNA, 657 nt, synthetic construct
  misc_feature 1..657: note = derived and/or modified sequence opt5 from Idarucizumab_LightChain1
  source 1..657: mol_type = other RNA
gacgtggtcatgacgcagagccccctgtccctccctgttacactgggccaaccggcctctatcagctgcaagtcctctcagagccttctgtacacggatgggaaaacctatctctactggttcctgcagcggcccggacagtcccctcggcgccttatttatctggtgtctaagctcgacagcggcgtgcccgatagattttccgggagcggatctggcacagacttcaccctgaaaatctcccgggtcgaggctgaagatgtgggggtttactattgtctgcaaagcacacactttcctcataccttcggaggcggcacaaaggtggagattaaacgcaccgtcgccgcgccctctgtgtttatcttccctccgtccgacgaacagctcaagagcgggacggcttctgttgtgtgcctgcttaacaatttttaccccagagaggccaaggtccagtggaaagtggataacgccctgcagtccggaaatagccaagaatccgtgaccgagcaggactctaaggatagcacatattccctcagctctaccctgacactttccaaagctgactacgagaagcacaaagtctacgcctgtgaagttacccatcagggcctgagctctcctgtgaccaagagcttcaacagaggggagtgc

SEQ ID NO: 38662 - RNA, 1332 nt, synthetic construct
  misc_feature 1..1332: note = derived and/or modified sequence opt5 from Igatuzuab_HeavyChain1
  source 1..1332: mol_type = other RNA
caggtgcaactggtccagagcggcgccgaggttaagaaacccgggtcctctgtgaaggtgagctgcaaggcttccggattcacctttacagactacaaaatccactgggtcagacaggcccctggccaggggctcgaatggggatatttcaaccccaattctggctacagcacgtatgcgcaaaaatttcaggggcgggtgaccattacagctgataagtccacctctacagcctacgagctgagctcccttcgcagcgaagacaccgccgtttattactgtgctagactgtctcccggaggctattacgtggatgcctggggccaggggacaaccgtcacggtgtccagcgcttctaccaagggaccttccgttttccccctcgcccctagctctaaatccacaagcggcgggaccgcggccctgggatgccttgtgaaggactactttcccgagcctgtcacagtgtcctggaactctggcgctctgaccagcggggtgcatacgttcccggccgtcctccagtccagcggactgtattctctgtccagcgttgtgacagtgccctctagctccctcggcacccaaacatacatctgtaatgtcaaccacaaaccttctaataccaaggtggataaaaaggttgaacccaagagctgcgacaaaacccatacatgtcctccctgcccggctcctgagctgcttggcgggccctccgtgtttctgttccctcccaagcccaaagatacgctcattagccggacccctgaggtcacatgtgtggttgtggacgtctctcacgaagatccggaggtgaagtttaactggtatgtcgacggagtggaagttcataatgccaaaaccaagccccgcgaggagcagtacaactccacatatagagtggtcagcgtgctgaccgttcttcaccaggattggctgaatggcaaagaatacaagtgcaaggtgtctaacaaagcgctccctgcccccatcgagaagacgatttccaaagctaaggggcagcctcgggaaccccaagtctatacactgccgcctagccgcgacgagctgaccaaaaatcaggtgtccctcacctgtctggtgaagggattctacccctctgatatcgccgttgaatgggagagcaacggccagcctgagaataactacaagacaaccccgcctgtccttgactccgacgggagctttttcctgtattctaaactcacagtggataagtccagatggcaacagggaaatgtgtttagctgctctgtccacgaagctctgcataaccactacacgcagaaatcccttagcctgtctcccggc

SEQ ID NO: 38663 - RNA, 636 nt, synthetic construct
  misc_feature 1..636: note = derived and/or modified sequence opt5 from Igatuzuab_LightChain1
  source 1..636: mol_type = other RNA
gacatccagacccaaagcccctcctctctgagcgcctccgtgggcgatagagtcacaattacgtgccgggcttctcaggggatcaacaattacctcaactggtatcagcagaaacctggaaaagccccgaagcgcctgatttacaataccaacaatcttcaaacaggcgttcccagcagattctccgggtctggaagcggcaccgagtttacactgaccatctccagcctccagcctgaagacttcgcgacatattactgtctgcagcacaactcttttcccaccttcgggcagggaacgaaacttgagattaagcggaccgtggctgccccttccgtgtttatctttccccctagcgatgaacaactgaaatctggcacagcctccgtcgtgtgcctcctgaataacttctatccgcgcgaggctaaggttcagtggaaggtggacaatgccctgcagagcggcaactctcaggaatccgtcaccgagcaagatagcaaagactccacatactctctcagctccaccctgacgcttagcaaggctgattatgagaaacataaggtgtacgcctgtgaagttacacaccaggggctgtcttcccccgtgaccaagagcttcaatagaggagagtgc

SEQ ID NO: 38664 - RNA, 357 nt, synthetic construct
  misc_feature 1..357: note = derived and/or modified sequence opt5 from IGF-IR_HUMAB-1A_HeavyChain
  source 1..357: mol_type = other RNA
gaggtgcagctggtccaaagcggcgggggactcgttcaccccggcgggtccctgagactttcttgcgccggaagcggcttcacctttcggaactacgctatgtattgggtgcgccaggcccctgggaagggactggaatgggtgtccgcgatcggctctggcgggggaacatactatgctgacagcgtcaaaggcagattcacgatttcccgggataatgccaagaactctctctacctgcagatgaatagccttcgcgccgaggacatggctgtgtattactgtgccagagctccgaactgggggtccgatgcctttgacatctggggacagggcaccatggttacagtgagctct

SEQ ID NO: 38665 - RNA, 357 nt, synthetic construct
  misc_feature 1..357: note = derived and/or modified sequence opt5 from IGF-IR_HUMAB-23_HeavyChain
  source 1..357: mol_type = other RNA
gaggtgcagctggtccaaagcggcgggggactcgttcaccccggcgggtccctgagactttcttgcgccggaagcggcttcaccttttccaactacgctatgtattgggtgcggcaggcccctgggaagggactggaatgggtgtctgcgatcggcagcggcgggggaacatactatgctgactccgtcaaaggccgcttcacgatttctagagataatgccaagaacagcctctacctgcagatgaactcccttcgggccgaggacatggctgtgtatcattgtgcccgcgctccgaattgggggagcgaagcctttgatatctggggacagggcaccatggttacagtgtcttcc

SEQ ID NO: 38666 - RNA, 321 nt, synthetic construct; identical to SEQ ID NO: 38562
  misc_feature 1..321: note = derived and/or modified sequence opt5 from IGF-IR_HUMAB-23_LightChain
  source 1..321: mol_type = other RNA

SEQ ID NO: 38667 - RNA, 357 nt, synthetic construct
  misc_feature 1..357: note = derived and/or modified sequence opt5 from IGF-IR_HUMAB-8_HeavyChain
  source 1..357: mol_type = other RNA
gaggtgcagctggtccaaagcggcgggggactcgttcaccccggcgggtccctgagactttcttgcgccggaagcggcttcacctttcggtcctacgctatgtattgggtgcgccaggcccctgggaagggactggaatgggtgtctgcgatcggcagcggcgggggaacatactatgctgactccgtcaaaggcagattcacgatttctcgggataacgccaagaatagcctctacctgcagatgaactcccttcgcgccgaggacatggctgtgtattactgtgccagagctccgaattgggggagcgatgcctttgacatctggggacagggcaccatggttacagtgtcttcc

SEQ ID NO: 38668 - RNA, 321 nt, synthetic construct
  misc_feature 1..321: note = derived and/or modified sequence opt5 from IGF-IR_HUMAB-8_LightChain
  source 1..321: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttatccccctacctttggccccgggacaaaagtggacattaag

SEQ ID NO: 38669 - RNA, 708 nt, synthetic construct
  misc_feature 1..708: note = derived and/or modified sequence opt5 from ImAb1_LightChain
  source 1..708: mol_type = other RNA
atggacatgagagcccccgctcagttctttggcatcctgctcctgtggttccctgggattcggtgcgatatcaagatgacccaaagcccgtcctctatgtacgccagccttggagagcgcgtgacaattacgtgtaaagcgtcccaggacatcaagtcttatctgagctggtaccagcagaaaccctggaagtcccctaaaattctcatctattacgctacctctctggccgatggcgtccccagcagaatctccgggagcggatctggccaagactattcccttacaattagctctctggaatccgatgacaccgccacatactattgcctccagcacggggagagcccttacacctttggaggcggcacaaagctggaaatcaagcgggctgatgccgctcccaccgtttctattttccctccgtccagcgagcagctgacgtccgggggagcctctgtggtgtgttttctcaacaatttctaccccaaagacatcaacgtcaagtggaaaattgatggcagcgaacgccagaatggggtgctgaactcctggaccgaccaagatagcaaggactctacatattccatgagctctacccttacactgaccaaagatgagtacgagagacataatagctatacgtgcgaagcgacacacaagacctccacatctcctatcgttaagagctttaaccggaatgagtgt

SEQ ID NO: 38670 - RNA, 681 nt, synthetic construct
  misc_feature 1..681: note = derived and/or modified sequence opt5 from ImAb1_gamma1-Chain
  source 1..681: mol_type = other RNA
atgaacttcggctttagcctgatcttcctcgtgctggtccttaagggggttcagtgcgaggtgaaactggtggaatccggaggcgggctcgtcaagcccggaggctctctgaaacttagctgtgccgcttccgggtttaccttctctaattacgccatgagctgggtgagacaaacacctgagaagcggctggaatgggttgcgtccatttctagcgacggagatacgtattttccggacaacgtgaaaggccgcttcaccatctccagagagaatgctggcaacattctctttctgcagatgagctctctgcggtccgaagatacagccatgtactattgcgcccgcgggttcatgatcaccttttggggacagggcacactcgtcaccgtgagcgctgccaagacaacgcccccttctgtttaccccctggctcctgggtgtggagacaccaccggctccagcgtgacacttgggtgcctggtcaagggatatttccccgagtctgtgaccgtgacatggaatagcggcagcctctcctctagcgtccacacctttcctgccctgcttcagtccggcctgtacacgatgtcctcttccgttacagtgccgagctctacctggcccagccaaacagtgacctgttccgtcgcgcatcctgcctctagcaccacagtggat

SEQ ID NO: 38671 - RNA, 1344 nt, synthetic construct
  misc_feature 1..1344: note = derived and/or modified sequence opt5 from Imalumab_HeavyChain1
  source 1..1344: mol_type = other RNA
gaggtgcagctgctcgaaagcggcgggggactggtccaacccggcgggtcccttagactgtcttgcgccgctagcggattcaccttttccatctactctatgaactgggttcggcaggcccctggcaaggggctcgagtgggtgagctccattggatctagcggcggcacaacgtattacgcggactccgtgaaagggcgcttcaccatcagcagagataattctaagaacacactgtatcttcagatgaatagcctgcgggctgaagacaccgccgtctactattgtgccggatcccagtggctctacggcatggatgtgtgggggcaaggaacaaccgttacagtgtcttccgctagcaccaaaggcccgtctgtctttcccctggccccttccagcaagtccacgtctgggggaaccgctgccctgggctgcctcgtgaaagactatttccccgagcctgttacagtgagctggaactccggcgcgctgaccagcggggtccacacatttcccgccgtgcttcagtcttccggactgtacagcctctctagcgtggtcaccgttccttcctctagcctgggcacgcagacatacatttgtaatgtgaaccataagccgtccaataccaaggtggataaacgcgtcgaacccaagagctgcgacaaaacacacacctgtcctccctgccctgctcccgagcttcttgggggaccgtctgtgttcctctttcctcccaagcctaaagataccctgatgatctccagaacacccgaggttacgtgtgtggtcgtggacgttagccatgaagatcccgaggtgaagttcaactggtatgtcgacggcgtggaagtccacaatgccaagaccaaacctcgggaggagcagtacaactctacatatcgcgtggtttccgtgctgaccgtcctccatcaagattggctgaatgggaaggaatacaaatgcaaggtgagcaacaaagctctgccggcccccattgagaagacaatctccaaagcgaagggacagcctagagaaccccaggtttataccctgcctccctctcgggaggaaatgacgaagaatcaggtgagcctcacatgtctggtcaaaggcttttacccgtccgacatcgccgtggagtgggagtctaacggccaacctgaaaataactataagaccacaccccctgtgcttgatagcgacgggtccttctttctgtacagcaaactcaccgttgacaagtctcgctggcagcagggaaacgtcttctcctgcagcgtgatgcacgaggctctgcacaatcattacacccaaaaatctctgtccctcagccccggcaag

SEQ ID NO: 38672 - RNA, 642 nt, synthetic construct
  misc_feature 1..642: note = derived and/or modified sequence opt5 from Imalumab_LightChain1
  source 1..642: mol_type = other RNA
gacatccagatgacccaaagcccctcctctctgagcgcctccgtgggcgatagagtcacaattacgtgccggtctagccagcgcatcatgacctacctcaactggtatcagcagaagcctgggaaagctccgaagctgcttattttcgttgcctcccactctcaaagcggagtgccctccagatttcggggcagcgggtctgagacagacttcaccctgacaatctccggactccagcctgaagatagcgcgacctactattgtcagcagtctttttggacacccctgaccttcggcgggggaacgaaagtggagattaagcgcaccgtcgctgccccttccgtgtttatctttccccctagcgacgaacaacttaaatctggcacagcctccgttgtgtgcctgctcaataacttctacccgagagaggctaaggtccagtggaaggtggataatgccctgcagagcggcaactcccaggaatctgttaccgagcaagacagcaaagattccacatatagcctgtcttccaccctcacgctgagcaaggctgactacgagaaacataaggtgtatgcctgtgaagtcacacaccaggggctttctagccccgtgaccaaatccttcaatcggggagagtgc

SEQ ID NO: 38673 - RNA, 1347 nt, synthetic construct
  misc_feature 1..1347: note = derived and/or modified sequence opt5 from Imgatuzumab_HeavyChain1
  source 1..1347: mol_type = other RNA
caggtgcaactggtccagagcggcgccgaggttaagaaacccgggtcctctgtgaaggtgagctgcaaggcttccggattcacctttacagactacaaaatccactgggtcagacaggcccctggccaggggctcgaatggatgggatatttcaaccccaattctggctacagcacgtatgcgcaaaaatttcaggggcgggtgaccattacagctgataagtccacctctacagcctacatggagctgagctcccttcgcagcgaagacaccgccgtttattactgtgctagactgtctcccggaggctattacgtgatggatgcctggggccaggggacaaccgtcacggtgtccagcgcttctaccaagggaccttccgttttccccctcgcccctagctctaaatccacaagcggcgggaccgcggccctgggatgccttgtgaaggactactttcccgagcctgtcacagtgtcctggaactctggcgctctgaccagcggggtgcatacgttcccggccgtcctccagtccagcggactgtattctctgtccagcgttgtgacagtgccctctagctccctcggcacccaaacatacatctgtaatgtcaaccacaaaccttctaataccaaggtggataaaaaggttgaacccaagagctgcgacaaaacccatacatgtcctccctgcccggctcctgagctgcttggcgggccctccgtgtttctgttccctcccaagcccaaagatacgctcatgattagccggacccctgaggtcacatgtgtggttgtggacgtctctcacgaagatccggaggtgaagtttaactggtatgtcgacggagtggaagttcataatgccaaaaccaagccccgcgaggagcagtacaactccacatatagagtggtcagcgtgctgaccgttcttcaccaggattggctgaatggcaaagaatacaagtgcaaggtgtctaacaaagcgctccctgcccccatcgagaagacgatttccaaagctaaggggcagcctcgggaaccccaagtctatacactgccgcctagccgcgacgagctgaccaaaaatcaggtgtccctcacctgtctggtgaagggattctacccctctgatatcgccgttgaatgggagagcaacggccagcctgagaataactacaagacaaccccgcctgtccttgactccgacgggagctttttcctgtattctaaactcacagtggataagtccagatggcaacagggaaatgtgtttagctgctctgtcatgcacgaagctctgcataaccactacacgcagaaatcccttagcctgtctcccggc

SEQ ID NO: 38674 - RNA, 639 nt, synthetic construct
  misc_feature 1..639: note = derived and/or modified sequence opt5 from Imgatuzumab_LightChain1
  source 1..639: mol_type = other RNA
gacatccagatgacccaaagcccctcctctctgagcgcctccgtgggcgatagagtcacaattacgtgccgggcttctcaggggatcaacaattacctcaactggtatcagcagaaacctggaaaagccccgaagcgcctgatttacaataccaacaatcttcaaacaggcgttcccagcagattctccgggtctggaagcggcaccgagtttacactgaccatctccagcctccagcctgaagacttcgcgacatattactgtctgcagcacaactcttttcccaccttcgggcagggaacgaaacttgagattaagcggaccgtggctgccccttccgtgtttatctttccccctagcgatgaacaactgaaatctggcacagcctccgtcgtgtgcctcctgaataacttctatccgcgcgaggctaaggttcagtggaaggtggacaatgccctgcagagcggcaactctcaggaatccgtcaccgagcaagatagcaaagactccacatactctctcagctccaccctgacgcttagcaaggctgattatgagaaacataaggtgtacgcctgtgaagttacacaccaggggctgtcttcccccgtgaccaagagcttcaatagaggagagtgc

SEQ ID NO: 38675 - RNA, 1353 nt, synthetic construct
  misc_feature 1..1353: note = derived and/or modified sequence opt5 from Inclacumab_HeavyChain1
  source 1..1353: mol_type = other RNA
gaggtgcagctggtcgaaagcggcgggggactcgttagacccggcgggtccctgcggctttcttgcgccgctagcggattcaccttttccaactacgacatgcactgggtgcgccaagccacaggcaaggggctggagtgggtgtctgcgatcacggctgccggagatatttattaccctggcagcgtcaaaggcagattcaccatctcccgggaaaatgccaagaactctctctatctgcagatgaatagccttcgcgctggggacacagccgtgtactattgtgctagaggacggtactccggcagcgggtcttattacaacgattggtttgacccgtggggacagggcaccctggttacagtgtccagcgcctctaccaaagggccctccgtcttccctctcgcgccctgcagccgctctacatccgagagcaccgccgctctgggatgtctggtgaaggattactttcctgaacccgttacggtgtcctggaactctggcgccctcaccagcggcgtccatacattccctgctgtgctgcagtccagcgggctttattctctgtccagcgtggtcaccgttccgtctagctccctcggaacaaaaacctacacgtgcaatgtggaccacaagccctctaatacaaaggtggataaaagagtcgagagcaagtatggccctccctgtcctccctgcccggcccctgagtttgaagggggaccctccgtgttcctgtttcctcccaaacccaaggacacccttatgattagccggacacctgaggttacctgtgtggtcgtggatgtttctcaagaagacccggaggtgcagttcaactggtacgtcgatggcgtggaggtccataatgcgaaaaccaagccccgcgaggaacagtttaactccacatatagagtggttagcgtgctgacggtcctccaccaggactggctgaatgggaaggaatacaaatgcaaggtgtctaacaaaggactgccttccagcatcgagaagaccatttccaaagccaagggccaaccccgggaacctcaggtttatacactgcccccgtctcaggaggagatgaccaaaaatcaggtgagcctcacatgtcttgtcaagggcttctacccttccgatatcgctgtggaatgggagtctaacgggcaacccgaaaataactacaagaccacgcctcccgtgctggacagcgacggatcctttttcctctatagccgcctgacagttgataaatctagatggcaggagggcaacgtcttctcctgcagcgtgatgcatgaagcccttcacaatcactacacccagaagtctctgtccctcagcctggggaaa

SEQ ID NO: 38676 - RNA, 642 nt, synthetic construct
  misc_feature 1..642: note = derived and/or modified sequence opt5 from Inclacumab_LightChain1
  source 1..642: mol_type = other RNA
gagatcgtgctgacccagagccccgccacactcagcctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctctcacctttggcgggggaacaaaagtggagatcaagagaaccgtggctgccccctctgtcttcatttttcctccgtccgatgaacagctgaaaagcggcacggcgtctgtggtttgcctgctcaacaatttctatccccgggaggccaaggtgcagtggaaagtcgacaacgctctgcaatccggcaatagccaggagtccgtgaccgaacaggattctaaggacagcacatactcccttagctctaccctgacactctccaaggccgattatgagaaacacaaggtttacgcttgtgaagtgacccatcaggggctgagctctcctgtcacgaaatcctttaaccgcggagagtgc

SEQ ID NO: 38677 - RNA, 1347 nt, synthetic construct
  misc_feature 1..1347: note = derived and/or modified sequence opt5 from Indatuximab_ravtansine_HeavyChain1
  source 1..1347: mol_type = other RNA
caggtgcaactgcagcagagcggctccgagctcatgatgcccggggcctctgtcaagatcagctgcaaagctaccggatacacattctccaactattggattgaatgggttaagcagagacctggccacgggctggagtggatcggagaaattcttccgggcacggggcggaccatctacaatgagaaatttaagggaaaagccacattcaccgcggacatttctagcaacacagtgcaaatgcagctgtcctctctcaccagcgaagattccgctgtgtattactgtgcccgcagagactattacggcaatttttattacgccatggattactggggccaggggacaagcgtcaccgtgtcttccgctagcacgaagggaccctctgttttccctctggccccctgctcccggagcacctctgagtccacagctgcccttggctgtctggtgaaggactattttcctgagcccgtcaccgtgagctggaactccggggcgctcacatctggagttcataccttccctgccgtgctgcagagctccggcctgtacagcctctcttccgtcgtgacggtgccgagctctagcctggggacaaaaacctatacatgcaatgtcgatcacaagccctccaacaccaaagttgacaagcgcgtggaatctaaatacggacctccctgtcctagctgccccgctccggagtttcttggcggcccttccgtgttcctgtttccccctaagcccaaggataccctcatgatcagcagaacacccgaagtcacgtgtgtggttgtggacgtctctcaagaggatcctgaggtgcagttcaattggtatgttgacggggtggaagtccataacgccaaaaccaagccgcgggaggaacagtttaattccacataccgcgtggtcagcgtgctgaccgttcttcaccaggattggctgaacggaaaagagtataagtgcaaagtgtctaataagggcctcccctccagcatcgagaaaacaatttccaaggctaaggggcaacctagagaaccccaggtctacaccctgcctccctctcaggaggaaatgacgaaaaaccaagtgagcctgacatgtctcgttaagggattctacccgtccgacatcgccgtggagtgggaatctaatggccagcctgagaacaattataaaaccacaccccctgtcctggatagcgacgggtcctttttcctttacagccggctgaccgtggacaagtctcgctggcaggaaggaaacgtgttctcctgcagcgttatgcatgaggcgctccacaaccactatacccagaaatctctgtcccttagcctgggcaag

SEQ ID NO: 38678 - RNA, 642 nt, synthetic construct
  misc_feature 1..642: note = derived and/or modified sequence opt5 from Indatuximab_ravtansine_LightChain1
  source 1..642: mol_type = other RNA
gacatccagatgacccaaagcacatcctctctgagcgcctccctcggcgatagagtgacgatttcttgcagcgcttcccaggggatcaacaattacctgaactggtatcagcagaagcccgacggaaccgtcgagcttctgatttactatacatctaccctccaaagcggcgttccttcccggttcagcgggtctggatccggcacagattacagcctgaccatctctaatcttgaaccggaggacattgggacatattactgtcagcagtattccaaactgccccgcacctttggaggcggcacgaagctcgaaatcaaaagaaccgtggccgcgcctagcgtgttcatctttcccccttctgatgagcagctgaagtccgggacagctagcgtcgtgtgcctgctcaacaatttctacccccgggaagccaaagttcaatggaaggtggacaacgccctgcagtccggaaattctcaggagagcgtcaccgagcaggattccaaggacagcacatactctctttccagcaccctgacgctctctaaagctgattatgaaaagcacaaagtgtacgcctgtgaggttacacatcaaggcctgagctcccctgtgaccaagtcttttaaccgcggggaatgc

SEQ ID NO: 38679 - RNA, 1347 nt, synthetic construct
  misc_feature 1..1347: note = derived and/or modified sequence opt5 from Indusatumab_vedotin_HeavyChain1
  source 1..1347: mol_type = other RNA
caggtgcaactgcagcagtggggcgccgggctcctgaagcccagcgagaccctttccctgacatgcgctgtcttcggaggctcttttagcgggtactattggtcctggatcagacagcctccgggaaaaggcctcgaatggattggggagatcaaccaccggggaaatacgaacgacaatccctctcttaagagccgcgttaccatttccgtggatacatctaaaaaccaattcgcccttaagctgagctccgtgaccgcggctgacacagccgtctactattgtgccagagaacggggctacacctatggcaattttgatcattgggggcagggaacactcgtgaccgttagctctgcttccacgaaaggccctagcgtgttccccctggccccttcttccaagagcacctctgggggaacagctgccctgggctgcctcgtcaaggactactttcccgagcctgtgaccgtttcctggaacagcggggcgctgacatccggagtgcacaccttcccggccgtccttcagtctagcggcctgtattccctcagctctgtggtgacggtcccctccagctctctgggcacacagacctacatctgtaatgttaaccataaacctagcaatacaaaggtggataaaaaggtggaacccaaatcctgcgacaagacccacacctgtcctccctgcccggctcctgagcttctgggaggaccctctgtctttctcttccctcccaagcccaaagatacactgatgattagccgcacgcctgaggtgacctgtgttgtggtcgacgtgtcccatgaagatccggaggttaagtttaactggtacgtggacggcgtcgaagtgcacaatgccaaaacaaagcccagagaggagcaatataacagcacctaccgggtcgtgtctgttctgacagtgctccaccaggattggctgaatgggaaagaatataagtgcaaagtctccaacaaggctctgcctgcccccatcgagaagaccatcagcaaagcgaagggacagcctcgcgaaccccaggtgtacacgctgccgccttctagagacgagctcaccaaaaatcaagtttccctgacatgtcttgtgaagggcttctatcccagcgatattgccgtcgaatgggagtccaacgggcagcctgagaacaattacaaaaccacaccccctgtgctggactctgacgggagctttttcctctattccaagctgaccgtggataagtctcggtggcagcaaggcaacgtttttagctgctccgtcatgcatgaagctctgcacaatcattacacacagaaaagcctctctctgtcccccggcaag

SEQ ID NO: 38680 - RNA, 642 nt, synthetic construct
  misc_feature 1..642: note = derived and/or modified sequence opt5 from Indusatumab_vedotin_LightChain1
  source 1..642: mol_type = other RNA
gagatcgtgatgacccagagccccgccacactgtccgtctctcctggcgaaagagctacgctcagctgccgggcctcccaatctgttagccgcaacctggcgtggtaccagcagaagccggggcaggctcccagacttctgatttatggagcctccacccgggccacaggcatccctgctcgcttctctgggagcggatccggcaccgagtttacactcaccattgggagcctgcaatctgaagacttcgccgtgtactattgtcagcagtacaaaacatggcccagaacctttggacagggcacgaatgtggagatcaagcggaccgtcgctgccccttccgtgttcatttttccccctagcgatgaacaacttaaatctggcacagcgtccgttgtgtgcctgctcaacaatttctatccgcgcgaggccaaggtccagtggaaagtggacaacgctctgcagagcgggaatagccaggagtccgttaccgaacaagatagcaaggactccacatactctctgagctccaccctcacgctgagcaaggccgattatgagaaacacaaggtgtacgcttgtgaagtcacacatcagggactttcttcccccgtgaccaaatcttttaacagaggcgagtgc

SEQ ID NO: 38681 - RNA, 1353 nt, synthetic construct
  misc_feature 1..1353: note = derived and/or modified sequence opt5 from Inebilizumab_HeavyChain1
  source 1..1353: mol_type = other RNA
gaggtgcagctggtcgaaagcggcgggggactcgttcaacccggcgggtccctgagactttcttgcgccgctagcggattcaccttttcctctagctggatgaactgggtgcggcaggcccctggcaaggggctggagtgggtgggacgcatctacccgggcgacggcgatacaaattataacgtcaaattcaaggggagatttacgatttcccgggacgattctaaaaatagcctctacctgcagatgaactcccttaagaccgaagacacagcggtgtattactgtgctcgcagcggattcatcaccacagttagagattttgactattggggccaggggaccctggtgacagtctcttccgccagcaccaaaggaccctctgtgttccctctcgccccctccagcaagtctacgtccggcgggaccgctgccctgggatgcctggttaaggattactttcctgagcccgtgacagtcagctggaactccggcgctctcacctctggcgtgcacacattccctgccgtgctgcaaagctccgggctttatagcctgtcttccgtcgttaccgtgccgagctctagcctcggaacgcagacatacatttgtaatgtgaatcataaaccctccaacaccaaggtcgacaaacgggtggaacctaagtcttgcgataaaacacacacctgtcccccttgccccgcgccggagctgcttggcgggcctagcgtttttctgtttccccctaagcccaaggacaccctcatgatctcccgcacacccgaggtgacgtgtgtcgtggttgatgtgagccatgaagaccctgaggtcaaattcaattggtacgtggatggagtcgaagtgcacaacgccaagaccaaaccgagagaggagcagtataattctacataccgggttgtgtccgtcctgaccgtgctgcatcaggactggctcaacggcaaggaatataaatgcaaggttagcaataaagctctgcccgcccctattgagaagacaatctctaaggctaaagggcaaccccgcgaacctcaggtgtacacccttcccccgtccagagaggaaatgacgaagaaccaggtcagcctgacatgtctcgtgaaaggattctatccttccgacatcgccgtggagtgggagtctaatggccagcccgaaaacaactacaagaccacccctcccgttctggatagcgacggctcctttttcctttattctaaactgacagtcgataagagccggtggcaacaggggaatgtgttctcctgcagcgtgatgcacgaggcgctccacaaccattacacccagaagtctctgtccctgagccctggaaaa

SEQ ID NO: 38682 - RNA, 654 nt, synthetic construct
  misc_feature 1..654: note = derived and/or modified sequence opt5 from Inebilizumab_LightChain1
  source 1..654: mol_type = other RNA
gagatcgtgctgacccagagccccgacttccaatccgtcacacctaaggaaaaagttacgattacctgcagagcctctgagagcgtggatacatttggcatctccttcatgaactggtttcagcagaagccggaccagtctcccaaactcctgattcacgaagctagcaatcaagggtccggagtgccttctcggttcagcggctccgggagcggaaccgattttacacttaccatcaactctctggaggccgaagacgcggctacatactattgtcagcagtccaaggaggtccccttcacctttggcgggggaacgaaagtggagattaagcgcaccgttgccgcccctagcgtgttcatctttcccccttctgatgaacagctcaagtccggcacagctagcgtcgtgtgcctgcttaataacttctacccgagagaggccaaagttcaatggaaggtggacaatgctctgcagtctggcaactcccaggaaagcgtcaccgagcaggattccaaagactctacatatagcctctccagcaccctgacgctgtctaaggccgattacgagaaacataaggtgtatgcgtgtgaagtgacacaccaagggctctccagccccgtcaccaagtcttttaatcggggagagtgc

SEQ ID NO: 38683 - RNA, 90 nt, synthetic construct
  misc_feature 1..90: note = derived and/or modified sequence opt5 from Insulin_peglispro_Fragment1
  source 1..90: mol_type = other RNA
ttcgtgaaccagcacctgtgcggcagccatctcgtcgaggccctgtaccttgtttgtggggaaagaggatttttctataccaagcccaca

SEQ ID NO: 38684 - RNA, 63 nt, synthetic construct; identical to SEQ ID NO: 23400
  misc_feature 1..63: note = derived and/or modified sequence opt5 from Insulin_peglispro_Fragment2
  source 1..63: mol_type = other RNA

SEQ ID NO: 38685 - RNA, 495 nt, synthetic construct
  misc_feature 1..495: note = derived and/or modified sequence opt5 from Interferon_beta-1b_chain1
  source 1..495: mol_type = other RNA
agctacaacctgctcggcttcctgcagagatcctctaattttcaaagccagaaacttctgtggcagctcaacgggcggctggagtattgccttaaggaccgcatgaatttcgatatccccgaagagattaagcagctgcaacagtttcagaaagaagacgccgctctcaccatctacgagatgctgcagaacattttcgccatctttagacaagattcctctagcacaggatggaatgaaacgattgtggagaacctgctcgcgaatgtctatcaccagatcaaccatctgaagaccgttcttgaggaaaaactggagaaggaagacttcacacggggcaagctcatgtcctctctgcaccttaaacgctactatgggagaatcctgcattacctcaaggctaaagagtatagccactgtgcctggaccattgtgcgggtggagatcctgcgcaatttttacttcattaacagactgacaggatacctccggaat

SEQ ID NO: 38686 - RNA, 1347 nt, synthetic construct
  misc_feature 1..1347: note = derived and/or modified sequence opt5 from Intetumumab_HeavyChain1
  source 1..1347: mol_type = other RNA
caggtgcaactggtcgagagcggcgggggagttgtgcagcccggcagatcccggcgcctctcttgcgctgctagcgggttcaccttttccagatacacaatgcactgggtgcggcaggcccctggaaagggcctggaatgggtcgcggtgatctctttcgacgggagcaacaaatattacgttgattccgtgaagggacgctttacgatttctagagacaatagcgagaacaccctttatctgcaggtcaatatcctccgggctgaagatacagccgtgtactattgtgcccgcgaggctagaggctcctacgccttcgacatttggggccaagggaccatggttacagtgagctctgcttccaccaaaggaccgagcgtctttcccctggccccttcttccaagagcacatctggcgggaccgcggcccttggatgcctggtgaaagattatttccccgaacctgtgacggtctcctggaacagcggcgctctcacctccggggttcatacatttcccgccgtgctgcagtctagcggactgtactccctcagctctgtggtcaccgtgccttccagctctctgggcacacagacctacatctgtaatgttaaccacaagccgagcaatacgaaggtggacaaaaaggtcgagcccaaatcctgcgataagacacatacctgtcctccctgccctgctcccgagcttctgggcgggccgtctgtgttcctctttcctcccaaacctaaggacacactgatgattagccggacccccgaagttacctgtgtggtcgtggatgtctcccacgaggaccccgaagtgaagttcaactggtatgttgatggagtggaggtccataatgccaaaacaaagcctcgcgaggaacagtacaacagcacgtatagagtggtttctgtgcttaccgtcctgcaccaagactggctcaatggcaaagagtacaagtgcaaagtgtccaacaaggcgctgccggcccccatcgagaaaacaatcagcaaggctaaggggcagcctcgggaaccccaggtgtataccctgcctccctctcgcgatgaactcaccaaaaatcaggtttccctgacatgtcttgtcaagggattttacccgagcgacattgccgtggagtgggagtccaacggccaacctgaaaataactataaaacgacaccccctgtgctggactctgatgggagcttctttctctactccaagctgaccgtcgacaaatctagatggcagcagggaaacgtgttcagctgctccgttatgcacgaggcccttcataatcactacacccaaaagagcctgtctctctcccccggcaag

SEQ ID NO: 38687 - RNA, 645 nt, synthetic construct
  misc_feature 1..645: note = derived and/or modified sequence opt5 from Intetumumab_LightChain1
  source 1..645: mol_type = other RNA
gagatcgtgctgacccagagccccgccacactcagcctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctccctttaccttcggccctgggacaaaagtggatatcaagagaaccgtggctgccccgtctgtctttatttttcccccttccgacgagcagctcaaaagcggaacggcgtctgtggtttgcctgctgaacaatttctatccccgggaagccaaggtgcagtggaaagtcgataacgctctccaatccggcaatagccaggagtccgtgaccgagcaggactctaaggatagcacatactccctgagctctacccttacactgtccaaggccgactatgaaaaacacaaggtttacgcttgtgaggtgacccatcagggcctcagctctcctgtcacgaaatccttcaaccgcggggaatgc

SEQ ID NO: 38688 - RNA, 1347 nt, synthetic construct; identical to SEQ ID NO: 38546
  misc_feature 1..1347: note = derived and/or modified sequence opt5 from Iodine_(124I)_Girentuximab_HeavyChain1
  source 1..1347: mol_type = other RNA

SEQ ID NO: 38689 - RNA, 642 nt, synthetic construct; identical to SEQ ID NO: 38547
  misc_feature 1..642: note = derived and/or modified sequence opt5 from Iodine_(124I)_Girentuximab_LightChain1
  source 1..642: mol_type = other RNA

SEQ ID NO: 38690 - RNA, 1335 nt, synthetic construct
  misc_feature 1..1335: note = derived and/or modified sequence opt5 from Iodine_(131I)_derlotuxiab_biotin_HeavyChain1
  source 1..1335: mol_type = other RNA
caggtgcaactgaaggagagcggccccgggctcgtcgccccttcccagtctctgagcattacctgcacagtttccggattctctcttacggactacggcgtgagatggatccggcagccgcccgggaaaggactggaatggctcggcgtgatctggggagggggcagcacctattacaactccgctctgaagtctcgccttagcatttccaaagataatagcaagtctcaggtctttctgaaaaactccctccaaacagacgataccgcctattactgtgcgaaggagaagagacggggctattactatgctgactactgggggcagggaacaagcgtgaccgtttcttccgccagcacaaaaggcccttctgtgttccccctggccccttccagcaagtccacctctgggggaacggctgccctgggctgcctcgtcaaagattactttcccgaacctgtgaccgttagctggaactccggggctctgacaagcggagtgcacaccttcccggccgtccttcagtcttccggcctgtatagcctctctagcgtggtgacagtcccctcctctagcctgggcacccagacgtacatctgtaatgttaatcataagccttccaacacaaaagtggacaagaaggcggagcccaaaagctgcgataagacccacacatgtcctccctgcccggcccctgaacttctcgggggaccctctgtgtttctgttccctcccaaacccaaggacaccctgatttcccgcacccctgaggtcacatgtgtggttgtggatgtcagccatgaggacccggaagtgaaatttaattggtatgttgatggcgtggaggtccacaacgctaagacgaaacccagagaagaacaatacaattctacctatcgggtggtctccgtgctgacagttctccatcaggactggctgaacgggaaggagtacaagtgcaaagtgagcaataaggcccttcctgctcccatcgagaaaaccatctccaaggccaaaggacagcctcgcgagccccaggtctatacactgccgccttctagagatgaactcaccaagaaccaagtgagcctgacgtgtcttgttaagggcttctacccctccgacattgcggtggagtgggaatctaatgggcagcctgagaacaattacaaaacaacaccccctgtcctggacagcgatggatcctttttcctctatagcaagctgaccgtggacaaatctcggtggcagcaaggcaacgtgttttcctgcagcgttcacgaggccctgcacaaccattacacccagaagtctctctccctgagccccggcaaa

SEQ ID NO: 38691 - RNA, 639 nt, synthetic construct
  misc_feature 1..639: note = derived and/or modified sequence opt5 from Iodine_(131I)_derlotuxiab_biotin_LightChain1
  source 1..639: mol_type = other RNA
gagaacgtgctgacccagagccccgccatctccgcttctcctggcgaaaaggtcacaacgtgcagagccagctcctctgttagctcctcttacctccactggtatcaacagaaaagcggggcgtccccgaagctgtggatttacagcacctctaatcttgcttccggagtgcccgcccggttcagcggctctgggtccggaacaagctattctctgaccatctccagcgtggaggccgaagacgctgccacatactattgtcagcagtactccggctatcctctcacctttgggggaggcacaaaactggagattaagcgcaccgtcgctgccccctctgtgttcatctttcctcccagcgatgaacaacttaaatccggcacggcgagcgttgtgtgcctgctcaacaatttctaccctagagaggccaaggtccagtggaaggtggacaacgctctgcagtctggaaattcccaggagagcgttaccgaacaagattctaaagacagcacatactccctgtctagcaccctcacactgtccaaggccgattatgagaaacataaggtgtacgcttgtgaagtcacccaccaggggcttagctctccggtgacgaaatcctttaaccggggcgagtgc

SEQ ID NO: 38692 - RNA, 1350 nt, synthetic construct
  misc_feature 1..1350: note = derived and/or modified sequence opt5 from Iodine_(131I)_Derlotuximab_biotin_HeavyChain1
  source 1..1350: mol_type = other RNA
caggtgcaactgaaggagagcggccccgggctcgtcgccccttcccagtctctgagcattacctgcacagtttccggattctctcttacggactacggcgtgagatggatccggcagccgcccgggaaaggactggaatggctcggcgtgatctggggagggggcagcacctattacaactccgctctgaagtctcgccttagcatttccaaagataatagcaagtctcaggtctttctgaaaatgaactccctccaaacagacgataccgccatgtattactgtgcgaaggagaagagacggggctattactatgctatggactactgggggcagggaacaagcgtgaccgtttcttccgccagcacaaaaggcccttctgtgttccccctggccccttccagcaagtccacctctgggggaacggctgccctgggctgcctcgtcaaagattactttcccgaacctgtgaccgttagctggaactccggggctctgacaagcggagtgcacaccttcccggccgtccttcagtcttccggcctgtatagcctctctagcgtggtgacagtcccctcctctagcctgggcacccagacgtacatctgtaatgttaatcataagccttccaacacaaaagtggacaagaaggcggagcccaaaagctgcgataagacccacacatgtcctccctgcccggcccctgaacttctcgggggaccctctgtgtttctgttccctcccaaacccaaggacaccctgatgatttcccgcacccctgaggtcacatgtgtggttgtggatgtcagccatgaggacccggaagtgaaatttaattggtatgttgatggcgtggaggtccacaacgctaagacgaaacccagagaagaacaatacaattctacctatcgggtggtctccgtgctgacagttctccatcaggactggctgaacgggaaggagtacaagtgcaaagtgagcaataaggcccttcctgctcccatcgagaaaaccatctccaaggccaaaggacagcctcgcgagccccaggtctatacactgccgccttctagagatgaactcaccaagaaccaagtgagcctgacgtgtcttgttaagggcttctacccctccgacattgcggtggagtgggaatctaatgggcagcctgagaacaattacaaaacaacaccccctgtcctggacagcgatggatcctttttcctctatagcaagctgaccgtggacaaatctcggtggcagcaaggcaacgtgttttcctgcagcgttatgcacgaggccctgcacaaccattacacccagaagtctctctccctgagccccggcaaa

SEQ ID NO: 38693 - RNA, 645 nt, synthetic construct
  misc_feature 1..645: note = derived and/or modified sequence opt5 from Iodine_(131I)_Derlotuximab_biotin_LightChain1
  source 1..645: mol_type = other RNA
gagaacgtgctgacccagagccccgccatcatgtccgcttctcctggcgaaaaggtcacaatgacgtgcagagccagctcctctgttagctcctcttacctccactggtatcaacagaaaagcggggcgtccccgaagctgtggatttacagcacctctaatcttgcttccggagtgcccgcccggttcagcggctctgggtccggaacaagctattctctgaccatctccagcgtggaggccgaagacgctgccacatactattgtcagcagtactccggctatcctctcacctttgggggaggcacaaaactggagattaagcgcaccgtcgctgccccctctgtgttcatctttcctcccagcgatgaacaacttaaatccggcacggcgagcgttgtgtgcctgctcaacaatttctaccctagagaggccaaggtccagtggaaggtggacaacgctctgcagtctggaaattcccaggagagcgttaccgaacaagattctaaagacagcacatactccctgtctagcaccctcacactgtccaaggccgattatgagaaacataaggtgtacgcttgtgaagtcacccaccaggggcttagctctccggtgacgaaatcctttaaccggggcgagtgc

SEQ ID NO: 38694 - RNA, 1344 nt, synthetic construct
  misc_feature 1..1344: note = derived and/or modified sequence opt5 from Ipilimumab_HeavyChain
  source 1..1344: mol_type = other RNA
caggtgcaactggtcgagagcggcgggggagttgtgcagcccggcagatccctccggctgtcttgcgccgctagcgggttcaccttttcctcttacacaatgcactgggtgcgccaggcccctggaaagggccttgaatgggtcacgttcatcagctatgacgggaacaataaatactatgcggattccgtgaagggaagatttaccatttctcgggacaacagcaaaaatacactgtacctccagatgaactccctgcgcgctgaggataccgccatctattactgtgccagaacaggctggcttggcccgttcgactattgggggcaaggaaccctggttacagtgagctctgcttccaccaagggccccagcgtctttcctctcgccccctcttccaaaagcacgtctgggggaaccgctgccctgggctgcctggtgaaggattacttccctgaacccgttacagtgtcctggaatagcggggcgctcacctccggagtccatacatttcctgccgtgctgcagtctagcggcctttactccctgagctctgtggtcaccgttccgtccagctctctcggcacgcagacatatatttgtaacgtgaatcacaagcccagcaacaccaaagtggacaagcgggtcgagcctaaatcctgcgataagacacatacctgtcccccttgccccgctccggaactgcttgggggaccttctgtgttcctgtttccccctaaacccaaggacaccctcatgatcagccgcacacccgaggttacgtgtgtggtcgtggatgtttcccacgaggaccctgaagtgaagttcaattggtacgtcgatggcgtggaggtccataacgccaaaaccaagccgagagaagaacagtataatagcacataccgggtggtttctgtgctgaccgtcctgcaccaagactggctcaacgggaaagagtataagtgcaaagtgtccaataaggctctgcccgcccctattgagaaaacaatcagcaaggcgaagggacagccccgcgagcctcaggtttacacccttcccccgtctagagatgaactgacgaaaaaccaggtgtccctcacatgtctggtcaagggcttttatcctagcgacatcgccgtggagtgggaatccaatgggcaacccgagaacaactacaaaaccacccctcccgtgcttgactctgatggcagcttctttctgtactccaagctcacagttgacaaatctcggtggcagcagggaaatgtcttcagctgctccgtgatgcacgaggctctgcataaccactatacccaaaagagcctgtctctctcccctggcaag

SEQ ID NO: 38695 - RNA, 645 nt, synthetic construct
  misc_feature 1..645: note = derived and/or modified sequence opt5 from Ipilimumab_LightChain
  source 1..645: mol_type = other RNA
gagatcgtgctgacccagagccccggcacactcagcctgtctcctggggaaagagccacgcttagctgccgggcttcccaatctgtcggaagctcctacctggcctggtatcagcagaagccgggccaggcgccccgcctcctgatttacggggctttctctagagccaccggaatccctgaccggtttagcggctccgggagcggaacagatttcacccttacaatttctcgcctggagcccgaagactttgccgtttattactgtcaacagtatggctccagcccttggaccttcggccaggggacaaaagtggagatcaagagaaccgtggctgccccctctgtctttattttccctccgtccgatgaacagctcaaaagcggaacggcttctgtggtttgcctgctgaacaatttttacccccgggaggccaaggtgcaatggaaagtcgacaacgcgctccagtccggcaatagccaggagtccgtgaccgaacaggattctaaggacagcacatattccctgagctctacccttacactgtccaaggccgattacgagaaacacaaggtttacgcttgtgaagtgacccatcaagggctcagctctcctgtcacgaaatccttcaaccgcggagagtgc

SEQ ID NO: 38696 - RNA, 186 nt, synthetic construct
  misc_feature 1..186: note = derived and/or modified sequence opt5 from Iratumumab_HeavyChain1
  source 1..186: mol_type = other RNA
caggtgcaactgcagcagtggggcgccgggctcctgaagcccagcgagaccctttccctgacatgcgctgtctacggaggctctttcagcgcctattactggtcctggatcagacagcctccggggaaaggactcgaatggattggcgactattgggggcaaggatctctggttacggtgagctcc

SEQ ID NO: 38697 - RNA, 321 nt, synthetic construct
  misc_feature 1..321: note = derived and/or modified sequence opt5 from Iratumumab_LightChain1
  source 1..321: mol_type = other RNA
gacatccagatgacccaaagccccacatccctgtctgccagcgtgggcgatagagtcacgattacctgccgggcttcccaggggatctctagctggctcacatggtaccagcagaagcctgagaaagccccgaagtccctgatttatgcggcttctagccttcaatccggagttcccagccgcttctctggctccgggagcggaaccgactttacactgaccatctcttccctccagcctgaagatttcgccacatactattgtcagcagtacgacagctatcccattacctttggccaagggacgagactggagatcaaa

SEQ ID NO: 38698 - RNA, 1350 nt, synthetic construct
  misc_feature 1..1350: note = derived and/or modified sequence opt5 from Isatuximab_HeavyChain1
  source 1..1350: mol_type = other RNA
caggtgcaactggtccagagcggcgccgaggttgctaagcccgggacctccgtgaaactctcttgcaaggccagcggatacacattcacggactattggatgcagtgggtgaaacagagacctggccaagggctggaatggatcggaaccatttacccgggcgatggggacacaggatatgcgcagaagtttcagggcaaagctacccttacagccgataagtcctctaagaccgtctacatgcacctgagctccctcgcctctgaggacagcgctgtgtattactgtgcccggggcgattattacgggtccaacagcctggactactggggacagggcacatctgttaccgtgtccagcgcttctacgaaagggccctccgtcttccctcttgcccccagctctaagtccaccagcggaggcacagcggccctggggtgcctcgtgaaagattattttcctgaacccgttaccgtgtcctggaactctggagctctgacaagcggcgtccataccttccctgccgtgctgcaatccagcggcctctactctctgtccagcgtggtcacggttccgtctagctcccttgggacacagacctatatctgtaatgtgaatcacaagccctctaacacaaaagtggacaagaaggtcgagcctaaaagctgcgataagacccatacctgtcccccttgccccgctccggaactgctcggaggcccttccgtgtttctgtttccccctaaacccaaggacacacttatgattagccgcacgcccgaggttacctgtgtggtcgtggatgtttctcacgaggaccctgaagtgaaatttaattggtacgtcgatggggtggaggtccataacgccaagacaaaaccgagagaagaacagtataattccacctaccgggtggttagcgtgctgacagtcctccaccaggactggctgaacggaaaggagtataagtgcaaagtgtctaataaggcgctgcccgcccctatcgagaaaaccatttccaaggctaaaggccaaccccgcgagcctcaggtttacacgcttcccccgagcagagacgaactgacaaagaaccaggtgtcccttacctgtctggtcaaggggttctacccttctgatatcgccgtggagtgggaaagcaatggacaacccgagaacaattataaaaccacacctcccgtgctcgactccgatggctctttcttcctgtacagcaagctcaccgttgacaaatcccggtggcagcagggcaacgtctttagctgctctgtgatgcacgaggctctgcataatcactatacacagaagtccctcagcctgtctcctgggaaa

SEQ ID NO: 38699 - RNA, 642 nt, synthetic construct
  misc_feature 1..642: note = derived and/or modified sequence opt5 from Isatuximab_LightChain1
  source 1..642: mol_type = other RNA
gacatcgtgatgacccagagccacctgtccatgtctacaagcctcggcgatcccgtctccattacgtgcaaggcctctcaagacgttagcaccgtggtggcttggtaccagcagaaacctgggcagtccccgagacggctgatctattctgccagctaccgctatattggagtccccgatagattcacaggctccggggcgggaaccgactttacattcaccatcagctctgtgcaagctgaggatcttgccgtttactattgtcagcagcattactcccctccctatacatttggcgggggaaccaagctggaaattaaacggacggtggccgctcctagcgtcttcatctttcccccttctgacgagcagctcaagtccggcaccgccagcgtggtttgcctgcttaacaatttctacccgcgcgaagctaaagtgcaatggaaggtcgataacgccctgcagtctggcaattcccaggagagcgtgacagaacaggactccaaggattctacctacagcctctccagcacactgaccctgtctaaagcggactatgagaagcacaaagtgtacgcctgtgaggtcacgcatcaagggctctccagccccgttacaaagtcttttaacagaggagaatgc

SEQ ID NO: 38700 - RNA, 1347 nt, synthetic construct
  misc_feature 1..1347: note = derived and/or modified sequence opt5 from Itolizumab_HeavyChain1
  source 1..1347: mol_type = other RNA
gaggtgcagctggtcgaaagcggcgggggactcgttaagcccggcgggtccctgaaactttcttgcgccgctagcggattcaagttttccagatacgccatgtcttgggtgcggcaagcgcctggcaaacgcctggagtgggtggctaccatcagctccgggggatcttatatttactatccggacagcgtcaagggcagattcacaatctcccgggataacgtgaaaaatacgctctacctgcagatgagctctcttcgctccgaagacaccgccatgtattactgtgccagacgggattatgacctggattactttgacagctggggccaggggacactcgttaccgtgtcttccgctagcacaaagggaccctctgtcttccctctggccccctccagcaagtccacctctggcgggacagctgccctgggatgcctcgtgaaagattactttcctgagcccgttaccgtgagctggaactccggcgcgctgacgagcggggtccacaccttccctgccgtgcttcagtcttccggactgtatagcctctctagcgtggtcacagttccgtcctctagcctgggcacccaaacatacatttgtaatgtgaaccataagccctccaataccaaagtggacaagaaagtcgaacctaagagctgcgataagacgcacacatgtcccccttgccccgctccggagcttctgggcgggccttctgtgtttctctttccccctaaacccaaggacaccctgatgatctcccgcacacccgaggttacctgtgtggtcgtggatgttagccatgaagaccctgaggtgaaattcaactggtatgtcgatggagtggaagtccacaatgccaagaccaaaccgagagaggagcagtacaactctacatatcgggtggtttccgtgctgacggtcctccatcaggactggctgaatggcaaggaatacaaatgcaaggtgagcaacaaggcccttcccgctcctattgagaaaaccatctccaaggcgaaagggcagccccgcgaacctcaagtttatacactgcccccgtctagagacgagctcaccaagaatcaggtgagcctgacatgtcttgtcaaaggattctacccttccgatatcgccgtggaatgggagtctaacggccagcccgagaataactacaagaccacgcctcccgtgctggacagcgatgggtcctttttcctctatagcaagctgacagttgacaaatctcggtggcagcaaggaaatgtcttttcctgcagcgtgatgcacgaagctctgcacaaccattacacccagaagtctctctccctgagccctggcaaa

SEQ ID NO: 38701 - RNA, 642 nt, synthetic construct
  misc_feature 1..642: note = derived and/or modified sequence opt5 from Itolizumab_LightChain1
  source 1..642: mol_type = other RNA
gacatccagatgacccaaagcccctcctctctgagcgcctccgtgggcgatagagtcacaattacgtgcaaggcttctcgggacatccgcagctacctcacctggtatcagcagaaacctgggaaggccccgaaaacactgatttactatgcgacctcccttgctgatggagttccctctagattcagcggctccgggagcggacaggactactctctgacaatctccagcctcgagtctgatgacaccgccacatattactgtctgcaacacggcgaatccccttttacccttgggagcggaacgaagctggagattaaacggaccgtggccgctccctctgtgttcatctttcctccctccgatgaacagctcaagagcggcacagcctccgtcgtgtgcctgctgaacaatttctatcctcgcgaggctaaggttcagtggaaagtggacaacgccctccagtctggcaatagccaagaatccgtcaccgagcaggatagcaaggactctacatactccctgagctctacccttacgctgagcaaagcggattacgagaagcataaagtgtatgcctgtgaagttacacaccaggggctctcctctccggtgaccaagagctttaacagaggagagtgc

SEQ ID NO: 38702 - RNA, 1335 nt, synthetic construct
  misc_feature 1..1335: note = derived and/or modified sequence opt5 from Ixekizumab_HeavyChain1
  source 1..1335: mol_type = other RNA
caggtgcaactggtccagagcggcgccgaggttaagaaacccgggtcctctgtgaaggtgagctgcaaggcttccggatactctttcaccgactatcacatccattgggtcagacaggcccctggccaggggctcgaatggatgggagtgattaacccgatgtacggcacaacggattataatcaacggtttaaagggcgcgttaccatcacagcggacgagagcacctccacagcttacatggaactgtctagccttagatccgaggataccgccgtgtattactgtgcccggtatgactacttcacaggaaccggcgtctactggggccaggggacgctggtgaccgttagctctgcttccacaaaaggacccagcgtgtttcctctcgccccctgctctcgctccaccagcgaatctacagctgccctgggctgtcttgtcaaggattatttccctgagcccgtgaccgtgtcctggaacagcggggcgctgacgtccggagtccacacatttcctgccgttctccagtctagcggcctgtactccctgagctctgtggtgaccgtcccgtccagctctctcgggacaaagacctatacctgcaatgtggaccataaacccagcaacacaaaggttgataaaagagtggagtccaagtacggacctccctgtcctccctgcccggctcctgagttcctgggcggcccctctgtctttcttttccctcccaaacccaaggacacgctgatgattagccggacccctgaggtgacatgtgttgtggtcgatgtgtcccaggaagacccggaggtccaatttaattggtatgtggatggggttgaggtgcacaacgccaagaccaaaccccgcgaagaacagttcaatagcacatacagagtcgtgtctgttctcaccgtgctgcatcaggactggcttaacggaaaggaatataaatgcaaggtctccaataaaggcctgcctagctctatcgagaagacgatttccaaagctaaggggcagccccgggaacctcaagtgtacacactgcccccgagccaggaggagatgaccaagaaccaggtgtccctcacctgtctggttaaaggattttacccttctgatatcgccgtcgaatgggagagcaatggccaacccgaaaacaattataagacaacccctcccgtgctcgactccgacgggtctttctttctgtacagccgccttacagtggataaatccagatggcaggagggaaacgtcttcagctgctctgtgatgcacgaagcgctgcacaatcattatacgcagaagtccctcagcctgtctcttggc

SEQ ID NO: 38703 - RNA, 657 nt, synthetic construct
  misc_feature 1..657: note = derived and/or modified sequence opt5 from Ixekizumab_LightChain1
  source 1..657: mol_type = other RNA
gacatcgtgatgacccagacacccctgagcctctccgtcacgcctggccaaccggcctctattagctgcagatcctctcggagcctggttcactcccgcgggaacacctaccttcattggtatctgcagaagcccggacagtctcctcagctcctgatctacaaagtgagcaatagattcattggcgtgcccgatcggttttccgggagcggatctggcacagacttcacccttaagatctcccgcgtcgaggctgaagatgtgggggtttattactgtagccaatctacacatctgccttttaccttcggacagggcacaaaactcgagattaagagaaccgtggccgcgccctccgtctttatcttccctccgagcgacgaacagctgaaatctggcacggcttccgtggtttgcctgctcaacaatttttatccccgggaggccaaggtgcagtggaaggtcgataacgccctgcaaagcggaaattcccaggaatctgtgaccgagcaggacagcaaagattccacatacagcctttcttccaccctgacactcagcaaggctgactatgagaaacacaaggtgtacgcctgtgaagtcacccaccaggggctgtctagccctgttacgaaatccttcaaccgcggcgagtgc

SEQ ID NO: 38704 - RNA, 1347 nt, synthetic construct
  misc_feature 1..1347: note = derived and/or modified sequence opt5 from Labetuzumab_govitecan_HeavyChain1
  source 1..1347: mol_type = other RNA
gaggtgcagctggtcgaaagcggcgggggagttgtgcaacccggcagatccctccggctgtcttgcagcgcctccgggttcgactttaccacatactggatgtcttgggtgcgccaggctcctggaaagggccttgagtggatcggggaaattcacccggatagctccacgatcaactatgccccctctctgaaagacagattcaccattagccgggataatgcgaagaacacactctttctgcagatggactcccttcgccctgaggataccggagtctacttctgtgctagcctgtattttggcttcccctggtttgcctactggggccaggggacacctgtgaccgtttcttccgccagcacaaaaggaccctctgtgttccctctcgctccgtccagcaagtctacctccggcgggacggccgctctgggatgcctggtcaaagactattttcccgaacctgtgaccgttagctggaactccggcgccctcacatctggggtgcataccttccccgcggtcctgcaaagctccggactttacagcctgtcttccgtggtgacagtccctagctctagcctcggcacccagacgtatatctgtaatgttaatcacaagccctccaacacaaaggtggataaaagagtggagccgaagtcttgcgacaaaacccatacatgtcctccctgccctgcccccgagctgcttggcgggcccagcgtctttctgttccctccgaagcccaaagataccctcatgatttcccggacccctgaagtgacatgtgttgtggtcgacgtgagccacgaggatcccgaagttaagtttaattggtacgtggacggagtcgaggtgcataacgctaagacgaaacctcgcgaggaacagtacaattctacctatagagtcgtgtccgttctgacagtgctgcaccaggattggctcaacggcaaggagtacaaatgcaaggtcagcaataaagccctgcccgctccgatcgaaaagaccatctctaaagccaaggggcaacctcgggagccccaggtgtatacacttcctccctcccgcgaagagatgaccaagaaccaggttagcctgacgtgtctcgtgaaaggattctacccttccgacattgcggtcgagtgggaatctaatggccagcccgagaacaattataagacaaccccgcctgtgctggacagcgatgggtccttctttctttactctaaactgaccgtggacaagagcagatggcaacagggaaacgttttctcctgcagcgtcatgcacgaagccctccataaccactatacacagaaatctctgtccctgagccccggcaag

SEQ ID NO: 38705 - RNA, 639 nt, synthetic construct
  misc_feature 1..639: note = derived and/or modified sequence opt5 from Labetuzumab_govitecan_LightChain1
  source 1..639: mol_type = other RNA
gacatccagctgacccaaagcccctcctctctcagcgcctccgtgggcgatagagtcacaattacgtgcaaggcttctcaggacgttgggaccagcgtggcctggtaccagcagaaacctggaaaggcgccgaaactgcttatctattggacatccacccggcacacaggcgtgccctctcgcttcagcgggtccggaagcggcaccgattttacattcaccatttcttccctgcaacctgaggacatcgctacgtactattgtcagcagtacagcctctatagatcttttgggcagggaaccaaggtcgaaattaaacggacagtggccgccccctccgttttcatctttcctcccagcgatgagcaactgaagtctggcaccgcttccgtggtctgccttctgaacaatttctaccctcgcgaagccaaggtgcagtggaaagttgacaacgctctccagagcggcaattcccaggagtctgtgacagaacaagatagcaaggactccacctatagcctgtcttccacgctgacactcagcaaagccgattacgagaagcataaagtctacgcgtgtgaggtgacccaccaggggctgtctagcccggtgacaaagtcctttaacagaggagaatgc

SEQ ID NO: 38706 - RNA, 1341 nt, synthetic construct
  misc_feature 1..1341: note = derived and/or modified sequence opt5 from Lambrolizumab_HeavyChain1
  source 1..1341: mol_type = other RNA
caggtgcaactggtccagagcggcgttgaggtgaagaaacccggggcctccgtgaaggtctcttgcaaagctagcggatacaccttcacaaactattacatgtattgggtgagacaggcccctggccaggggctcgaatggatgggaggcatcaatccgtccaacgggggaacgaattttaacgagaagttcaaaaatcgggttaccctgacaaccgactctagcacaaccacagcgtacatggaacttaagtccctgcaatttgatgacaccgctgtgtattactgtgcccgcagagattatcggttcgacatgggctttgattactggggccaggggacgaccgtcacagtgtctagcgcctccaccaagggacccagcgttttccctctcgctccctgctctcgctccacaagcgagtctaccgccgctctgggctgtcttgtgaaagactactttcctgaacccgtcacggtgtcctggaacagcggggccctgacatctggagtgcacaccttccctgcggtcctccagtccagcggcctgtattccctgtctagcgttgtgacagtgccgtccagctctctcgggaccaagacctacacatgcaatgtcgatcataaaccctccaacacgaaggtggacaaaagagttgagagcaagtatggacctccctgtcctccctgcccggcccctgagtttctgggcggcccctctgtgttcctttttcctcccaagcccaaagataccctgatgattagccggacacctgaagtcacctgtgtggttgtggacgtctcccaggaggatccggaagtgcaattcaattggtacgtcgacggggtggaggttcacaacgctaagacaaaaccccgcgaggaacagtttaattctacctatagagtggtcagcgtgctcacggttctgcatcaggattggcttaacggaaaggagtacaaatgcaaggtgtccaataaaggcctgcctagctctatcgaaaagacaatttccaaggccaaagggcagccccgggagcctcaagtctataccctgcccccgagccaggaagagatgaccaagaaccaggtgtctctcacatgtctggtgaaaggattctacccttccgacatcgctgttgagtgggaaagcaatggccaacccgagaacaactacaagaccacacctcccgtcctcgactccgatgggtctttctttctgtatagccgccttacggtggacaaatccagatggcaggaaggaaatgtgttctcttgcagcgtcatgcacgaggccctgcataaccactacacccagaagtccctcagcctgtctcttggcaag

SEQ ID NO: 38707 - RNA, 654 nt, synthetic construct
  misc_feature 1..654: note = derived and/or modified sequence opt5 from Lambrolizumab_LightChain1
  source 1..654: mol_type = other RNA
gagatcgtgctgacccagagccccgccacactctccctgtctcctggcgaacgggctacgcttagctgccgggcctccaagggggtctctaccagcggatactcctatctgcactggtaccaacagaaaccgggccaggcgccccgcctcctgatttatcttgcttcttacctggagagcggggttcctgccagattctccggaagcggctctgggacagactttaccctcacaatctccagcctggaacccgaggatttcgccgtgtattactgtcagcattctcgggacctgcctctcacctttggaggcggcacaaaggtggaaattaaacgcaccgtcgctgccccctccgtgttcatctttcctccgagcgatgagcaactgaagtctgggacggcttccgttgtgtgccttctgaacaatttctatcccagagaggccaaagtccagtggaaggtggacaacgcgctccagagcggaaattcccaggaatctgttaccgagcaagatagcaaggactccacatacagcctgtcttccacccttacactgagcaaagccgattacgaaaagcacaaagtgtatgcttgtgaggtcacccatcagggcctctctagccctgtgacgaagtcctttaacagaggggagtgc

SEQ ID NO: 38708 - RNA, 669 nt, synthetic construct
  misc_feature 1..669: note = derived and/or modified sequence opt5 from Lampalizumab_HeavyChain1
  source 1..669: mol_type = other RNA
gaggtgcagctggtccaaagcggccccgaactcaagaaacctggggcctccgttaaggtgtcttgcaaagctagcggatacaccttcacaaactatggcatgaattgggtgagacaggccccggggcagggactggagtggatgggctggatcaacacgtacaccggggaaacaacctatgcggacgattttaagggacggttcgtcttttcccttgacacatctgtgagcaccgcttacctgcagatttcctctctcaaagccgaggatacagccgtttattactgtgaacgcgagggcggcgtgaataactgggggcaaggaaccctggtcacggtgagctccgctagcaccaagggcccctctgttttccctcttgccccctccagcaagtctacatccgggggaaccgctgccctgggctgcctcgtgaaagactattttcctgagcccgtcacagtgagctggaatagcggggcgctgacctccggagtgcacacgttccctgccgtcctgcagagctccggcctctactctctgagctccgttgtgacagtgccgtcttcttcccttggcacccagacatacatctgtaacgtcaatcataagcccagcaacaccaaagtggataagaaagttgaacctaagtcttgcgacaagacccacaca

SEQ ID NO: 38709 - RNA, 642 nt, synthetic construct
  misc_feature 1..642: note = derived and/or modified sequence opt5 from Lampalizumab_LightChain1
  source 1..642: mol_type = other RNA
gacatccaggtgacccaaagcccctcctctctgagcgcctccgtcggcgatagagttacaattacgtgcatcacctctacagacattgatgacgatatgaactggtaccagcagaaacctgggaaagtgccgaagctcctgatcagcggaggcaatacccttcggcccggggtgccttcccgcttctctggaagcggctccgggacagactttaccctgacaattagctctctccagcccgaggatgtcgctacctattactgtctgcaatccgacagccttccttatacgttcggacagggcaccaaagtggaaatcaagagaacagttgccgcgccctctgtgtttatcttccctccgtccgatgagcagctgaaaagcggcaccgcttctgtcgtgtgcctcctgaacaatttttacccccgggaagccaaggttcagtggaaggtggacaacgccctgcaatccgggaatagccaggagtccgtcacagaacaggattctaaagacagcacctattccctcagctctacgctgacactttccaaggctgattacgagaaacacaaggtgtatgcctgtgaggtgacccatcagggactgagctctcctgtcacaaagagcttcaaccgcggcgaatgc

SEQ ID NO: 38710 - RNA, 1353 nt, synthetic construct
  misc_feature 1..1353: note = derived and/or modified sequence opt5 from Lanadelumab_HeavyChain1
  source 1..1353: mol_type = other RNA
gaggtgcagctgctcgaaagcggcgggggactggtccaacccggcgggtcccttagactgtcttgcgccgctagcggattcaccttttcccactacatcatgatgtgggttcggcaggcccctggcaaggggctcgagtgggtgtctggaatttatagctccggcggcatcacagtgtacgcggactctgtcaaagggcgcttcacgattagcagagataactccaagaataccctgtatcttcagatgaacagcctgcgggctgaagacacagccgtgtactattgtgcctaccgcagaatcggagttccgcggcgcgatgagtttgacatttggggccaggggaccatggtgacagtctcttccgctagcaccaaaggaccctctgtgttccctctcgccccctccagcaagtctacatccggcgggaccgctgccctgggatgcctggttaaagattattttcctgaacccgtgacggtcagctggaactccggcgcgctcacctctggcgtgcatacattccctgccgtgctgcaaagctccgggctttacagcctgtcttccgtcgttaccgtgccgagctctagcctcggaacacagacctacatctgtaatgtgaatcacaagccctccaacacgaaggtcgacaaaagagtggagcctaagtcttgcgataaaacacatacctgtcccccttgccccgctccggagctgcttggcgggcctagcgtttttctgtttccccctaagcccaaagacacactcatgatctcccggacccccgaagtgacctgtgtcgtggttgatgtgagccacgaggaccctgaagtcaagttcaattggtatgtggatggagtcgaggtgcataacgccaagacaaaaccgcgcgaggaacagtacaattctacgtatagagttgtgtccgtcctgaccgtgctgcaccaggactggctcaacggcaaggagtacaaatgcaaggttagcaataaagctctgcccgcccctattgaaaagacaatctctaaagcgaaggggcaaccccgggagcctcaggtgtatacccttcccccgtcccgcgaagagatgacaaagaaccaggtcagcctgacctgtctcgtgaaaggattctacccttccgatattgccgtggagtgggaatctaatggccagcccgagaacaattataagacgacacctcccgttctggacagcgacggctcctttttcctttactctaaactgaccgtcgataagagcagatggcaacaggggaacgtgttttcctgcagcgtgatgcacgaagctctccataaccactacacccagaaatctctgtccctgagccctgga

SEQ ID NO: 38711 - RNA, 639 nt, synthetic construct
  misc_feature 1..639: note = derived and/or modified sequence opt5 from Lanadelumab_LightChain1
  source 1..639: mol_type = other RNA
gacatccagatgacccaaagcccctccacactgtctgccagcgtgggcgatagagtcacgattacctgccgggcttcccagtctatcagctcctggctcgcctggtaccagcagaagcctgggaaagcgccgaagctgcttatttataaggcttctacactggagagcggagttccctcccgcttcagcggctctgggtccggaaccgaatttacactcaccatcagctctctgcaacctgacgatttcgccacatactattgtcagcagtacaacacctattggacgtttggccaggggaccaaagtggagattaaaagaacagtggccgctccctccgtcttcatctttcctcccagcgacgaacaacttaagtctggaaccgcctccgtggtttgcctgctcaataacttctaccctcgggaggctaaggtgcagtggaaagtcgataatgccctgcagagcggcaactcccaggaatctgtgacagagcaagacagcaaggattccacctatagcctgtcttccacgctcacactgagcaaagcggactacgagaagcacaaagtttacgcctgtgaagtgacccatcagggcctttctagcccggtcacaaagtcctttaatcgcggggagtgc

SEQ ID NO: 38712 - RNA, 1317 nt, synthetic construct
  misc_feature 1..1317: note = derived and/or modified sequence opt5 from Landogrozumab_HeavyChain1
  source 1..1317: mol_type = other RNA
gaggtgcagctggtcgaaagcggcgggggactcgttcaacccggcgggtccctgagactttcttgcgccgctagcggactgaccttctcccggtaccctatgtcttgggtgcgccaggccccgggcaaggggctcgtgtgggtcagcgcgatcacatcctctggaggcagcacgtattactccgacaccgtgaaaggcagatttacaattagccgggataacgctaagaataccctgtatcttcagatgaactctctgcgcgccgaggacacagccgtttactattgtgctagactccccgattactgggggcagggaaccctggtgacagtctccagcgcctctaccaaaggcccttccgtgttccccctggctccttgcagccggtctacgtccgaaagcaccgccgcgctcgggtgtctggttaaggactattttcccgagcctgtgacagtctcctggaactctggagcccttaccagcggcgtgcacacattcccggctgtgctgcaatccagcgggctctactctctgtccagcgtcgttaccgtgccctctagctcccttggaacgaaaacatatacctgcaatgtggatcataagccttctaatacaaaggtcgacaaacgcgtggaaagcaagtacgggcccccttgtcccccgtgccctgcccccgagtttctgggcggcccttccgttttcctctttcctcccaaacccaaggataccctgatgatcagcagaaccccggaggtgacatgtgtcgtggttgacgtgtctcaggaagatcccgaggtccagttcaactggtacgtggacggagtcgaagtgcacaatgctaaaacgaagcctcgggaggagcagtttaactccacctatcgcgttgtgagcgtcctgacagtgctccatcaagattggctgaatggcaaggaatacaaatgcaaggtttctaacaaagggcttccctccagcattgagaagaccatctccaaagccaagggacagcctagagaaccccaggtgtatacactgccgccttctcaggaggaaatgaccaaaaatcaagtcagcctcacgtgtctggtgaagggcttctacccctccgacattgcggtggagtgggagtctaacgggcagcctgaaaataactataagacaacaccccctgttcttgatagcgacggatcctttttcctgtacagccggctcaccgtcgacaaatctcgctggcaggagggcaatgtgttttcctgcagcgtgatgcacgaagccctgcataaccactacacccaaaagtctctgtccctcagcctgggc

SEQ ID NO: 38713 - RNA, 645 nt, synthetic construct
  misc_feature 1..645: note = derived and/or modified sequence opt5 from Landogrozumab_LightChain1
  source 1..645: mol_type = other RNA
gagatcgtgctgacccagagccccggcacactctccctgtctcctggggaacgggccacgcttagctgccgggcttcctctagcgtctcctctagctacctgcactggtatcaacagaagccgggacaggcgccccgcctcctgatttactccaccagcaaccttgttgccggcatccctgacagattctctgggtccggaagcggcacagattttaccctgacaatttctcggctcgagcccgaagacttcgctgtgtattactgtcagcatcactccgggtatcattttaccttcggaggcggcacaaaagtggagatcaagcgcaccgtcgccgcccctagcgtgtttatttttcccccttctgatgaacaactgaaatccgggacggctagcgttgtgtgcctgctcaataacttctacccgagagaggccaaggtccagtggaaagtggacaatgctctgcagtccggaaactctcaggagagcgttaccgaacaagattccaaggacagcacatattctctttccagcaccctgacactctctaaggccgattacgagaaacacaaggtgtacgcgtgtgaagtcacccatcagggcctgagctcccccgtgacgaaatctttcaatagaggggagtgc

SEQ ID NO: 38714 - RNA, 1344 nt, synthetic construct
  misc_feature 1..1344: note = derived and/or modified sequence opt5 from Laprituximab_emtansine_HeavyChain1
  source 1..1344: mol_type = other RNA
caggtgcaactggtccagagcggcgccgaggttgctaagcccggggcctccgtgaaactctcttgcaaggcgagcggatacaccttcacatcctattggatgcagtgggtgaaacagagacctggccaagggctggaatgtatcggaacgatttacccgggcgacggggataccacatatacccagaagtttcagggaaaagctacacttaccgccgacaagtctagctccacagcctacatgcagctgtctagcctccggtccgaggatagcgctgtctattactgcgcccgctatgacgctcccggctacgccatggattactggggccaagggaccctggtgacggtttcttccgcgagcaccaagggaccttctgtgttcccccttgccccttccagcaaatctacatccggcgggaccgctgccctgggatgtctcgtcaaggactattttcccgaacctgtgacagttagctggaactccggcgctctgacctctggggtgcacacgttcccggccgtcctgcagagctccggactctacagcctgtcttccgtggtgacagtccccagctctagccttggcacccagacatatatctgcaatgttaaccataaaccttccaataccaaggtggataaaaaggtggagcccaagtcttgtgacaaaacccacacatgccctccctgtccggcgcctgaactgctcggcgggcccagcgtctttctgttccctcccaagcccaaagatacgcttatgatttccagaacccctgaggtgacatgcgttgtggtcgacgtgagccatgaggatccggaagttaagtttaactggtacgtggacggagtcgaggtgcacaatgccaaaaccaagccccgggaggaacagtataactctacataccgcgtcgtgtccgttctgaccgtgctccatcaagattggctgaatggcaaagagtataagtgtaaggtcagcaacaaagctctgcctgcccccatcgaaaagacgatttctaaagctaaggggcagcctagagagccccaggtgtacacactcccgccttcccgggacgaactgaccaaaaatcaagttagccttacctgcctggtgaagggattctacccctccgacatcgccgtcgagtgggaatctaacggccagcctgagaataactataagacaacaccccctgtgctcgatagcgacgggtcctttttcctgtactctaaacttaccgtggataagagccgctggcagcagggaaatgtcttttcctgtagcgttatgcacgaggccctgcacaaccattatacgcaaaaatctctctccctgagccccggc

SEQ ID NO: 38715 - RNA, 642 nt, synthetic construct
  misc_feature 1..642: note = derived and/or modified sequence opt5 from Laprituximab_emtansine_LightChain1
  source 1..642: mol_type = other RNA
gacatccagatgacccaaagcccctcctctctgagcgcctccgtgggcgatagagtcacaattacgtgccgggcttctcaggacatcaacaattacctcgcctggtatcagcacaaacctgggaaaggaccgaagctgcttattcattacaccagcacactgcaccccggcatcccttcccgcttctctgggagcggatccggcagagattatagcttttctatttccagcctcgagcccgaagacatcgcgacctactattgtctgcagtacgataaccttctgtatacattcgggcaaggaaccaaactcgagatcaagcggacagttgctgccccttctgtgtttatttttcccccttccgacgaacagctgaaaagcggcaccgcctctgtggtctgcctgctcaataacttctacccgcgcgaggctaaggtgcagtggaaggttgataatgccctgcagtccggcaacagccaagaatccgtgacggagcaggactctaaagatagcacctactcccttagctctacactgaccctctccaaggctgactatgagaaacataaggtctacgcctgtgaagtgacacaccaggggctgagctctcccgttaccaagagcttcaatagaggagagtgc

SEQ ID NO: 38716 - RNA, 1314 nt, synthetic construct
  misc_feature 1..1314: note = derived and/or modified sequence opt5 from Lealesoab_HeavyChain1
  source 1..1314: mol_type = other RNA
caggtgcaactgcaggagagcggccccgaactcaagaaacctggggagaccgtcaagatctcctgcaaagcctctggatacacattcagaaactatggcaattgggttaagcaggctccggggaaaggactgaagtggggctggattaacacgtacaccggggaacccacatatgccgacgattttaagggacggttcgcgtttagccttgagacctccgcttctacagcctacctgcagatcaataacgtgaaaaatgaagacaccgccacatatttctgtgctcgcaagggctgggattttaacggcagctccctcgactactgggggcaaggaaccacggtgaccgtctctagcgccaaaacaacccctccctccgtgtatcctctggctcccggcagcgccgcgcagacaaattctgttacccttgggtgcctggtgaagggatacttccctgagccggtcacggtgacatggaactccggcagcctctcttccggggttcacacctttcccgccgtgctgcagagcgatctgtacacactctcttccagcgtcaccgtgccttcctctcccagacctagcgagaccgtgacatgtaatgtcgctcatcccgcctccagcacgaaagttgacaagaagattgtgccgcgggattgcggatgtaaaccttgcatctgtaccgtgcccgaagtctcttccgtgttcatttttcctcccaagcccaaagacgttctgacaatcacccttacacctaaggtgacctgcgtcgtggttgatatcagcaaagacgatccggaggtgcagttctcttggtttgtcgacgatgtggaagtccacacggctcaaacacagccccgcgaggagcagttcaacagcacctttagatccgtgtctgaactgcctattcatcaggactggctcaatggcaaggagttcaaatgtcgggttaacagcgccgcgttccccgcccctatcgaaaagaccatttccaagacaaaaggccgccccaaggctccgcaagtgtataccatccctccccctaaagagcaggccaaggacaaagtcagcctgacatgcattacggactttttccccgaagatatcaccgtggagtggcagtggaatgggcaacctgctgagaactacaagaatacacagcccattaacaccaacggatcttattttgtttactccaagctgaatgtgcagaaaagcaactgggaagccggcaatacattcacctgttctgtccttcacgaggggctccataaccaccacacggaaaagtccctgagccattccccgggaaaa

SEQ ID NO: 38717 - RNA, 654 nt, synthetic construct
  misc_feature 1..654: note = derived and/or modified sequence opt5 from Lealesoab_LightChain1
  source 1..654: mol_type = other RNA
gacatccagctgacccaaacacccctcagcctgcctgtgtcccttggcgatcaggcctctattagctgcagatcctctcagagcatcgtccactccaacgggaatacgtacctggagtggtatctccagaagccgggacaatctcccaacctgcttatttacaaagttagcaatcggttctccggcgtgcctgaccgctttagcgggtctggatccggcaccgatttcacactgaagatcagcagagtggaagctgaggacctcggggtctattactgttttcagggatctcatgtgccccctaccttcggcggcgggacaaaactggaaattaagcgggccgatgcggctcccaccgtttccatctttcctccgagctctgagcagctgacatccggaggcgccagcgtggtctgcttcctcaacaatttttatcccaaagacatcaacgtgaagtggaagattgatgggtccgaacgccagaatggagttctgaactcttggaccgaccaagatagcaaagactccacgtactctagctccacccttacactgaccaaggatgagtatgagagacacaatagctacacatgtgaagccacccataaaacgtctacaagccctatcgtgaagtccttcaaccggaatgagtgc

SEQ ID NO: 38718 - RNA, 1335 nt, synthetic construct
  misc_feature 1..1335: note = derived and/or modified sequence opt5 from Lebrikizumab_HeavyChain1
  source 1..1335: mol_type = other RNA
caggtgaccctgagagagagcggccccgccctcgtcaagcctacacaaacgctgacccttacatgcaccgtttccgggttctctctgagcgcttactccgtgaactggatccggcagccgcccggaaaagccctcgaatggctggcgatgatttggggcgacgggaagatcgtgtataattctgctcttaaaagccgcctgacaatttccaaggatacctctaaaaaccaggtcgtgctcacaatgaccaatatggaccctgttgatacggccacctactattgtgccggagacggctactatccctacgctatggataactgggggcagggaagcctggtgacagtctccagcgcctctaccaagggcccttccgtgtttcccctggctccttgcagcagatctacatccgagagcaccgccgcgctcggctgtctggttaaggactatttcccggaacccgtgacggtctcttggaactccggggcccttacaagcggagtgcacacctttcctgctgtgctgcaatcctctggcctctacagcctgtccagcgtcgttacagtgccctcttccagccttgggaccaaaacctacacatgcaatgtggatcataagccttctaatacgaaagtcgacaagcgggtggagagcaaatatggacccccgtgtcctccctgccctgcccccgagttcctgggcgggccctccgtttttctcttccctccgaagcccaaggataccctgatgatctctcgcacacctgaggtgacctgtgtcgtggttgacgtgagccaggaggatcccgaagtccagtttaactggtacgtggacggagtcgaggtgcacaatgctaaaacaaagcctagagaagaacagttcaactccacctatcgggttgtgagcgtcctgacggtgctccatcaagattggctgaatggcaaagagtacaagtgcaaagtttctaacaagggccttccctccagcattgagaaaacaatctctaaggccaaggggcagccgcgcgaacctcaggtgtataccctgcccccttcccaggaagagatgaccaaaaatcaagtcagcctcacatgtctggtgaagggattttacccctccgacatcgcggtggaatgggagtctaacggccagcctgagaataactataaaaccacacccccggttcttgacagcgatgggtccttctttctgtactctagactcacggtcgacaagagccggtggcaggaaggaaacgtgttctcctgcagcgtgatgcacgaggccctgcataatcactacacccaaaaatctctgtccctcagcctgggcaag

SEQ ID NO: 38719 - RNA, 654 nt, synthetic construct
  misc_feature 1..654: note = derived and/or modified sequence opt5 from Lebrikizumab_LightChain1
  source 1..654: mol_type = other RNA
gacatcgtgatgacccagagccccgattccctgtctgtcagcctcggcgagagagccacaattaactgccgggcttccaagtctgttgacagctacgggaatagcttcatgcactggtatcaacagaaacctggacagccgcccaagctgcttatctacctggcctctaacctcgaaagcggcgtgcctgatcgcttttccgggagcggatctggcacggacttcaccctgacaatttccagccttcaggcggaggatgtggctgtctattactgtcaacagaataacgaagaccccagaacctttgggggaggcacaaaagtggagatcaagcggaccgttgccgccccttctgtgttcatttttcccccttccgatgaacagctgaaaagcggcacagcttctgtcgtgtgcctcctgaataacttctatccgcgcgaggccaaggttcagtggaaggtggacaatgctctgcaatccgggaacagccaggagtccgtcaccgaacaggattctaaagacagcacgtactccctcagctctaccctgacactttccaaggccgattatgagaaacataaggtgtacgcgtgtgaagtgacccaccagggactgagctctcccgtcacaaaatcctttaatagaggcgagtgc

SEQ ID NO: 38720 - RNA, 1227 nt, synthetic construct
  misc_feature 1..1227: note = derived and/or modified sequence opt5 from Lenercept_chain1
  source 1..1227: mol_type = other RNA
ctggtgccccacctcggcgacagagagaagcgggatagcgtctgccctcaggggaaatacatccatccgcagaacaattccatttgttgcaccaagtgtcacaaaggaacatatctgtacaacgactgccccggccctgggcaggatacggactgtcgcgaatgcgagtctggcagcttcaccgcctccgaaaatcatcttagacactgtctgtcttgcagcaagtgtcggaaagagatgggacaggttgaaatctcctcttgcacagtggatcgcgacaccgtgtgtgggtgcagaaagaaccagtatcggcattactggagcgagaatctctttcaatgcttcaactgttccctgtgccttaatggaacagtccacctgagctgtcaggagaagcagaacaccgtgtgcacatgtcacgctggctttttcctccgcgaaaatgagtgcgtttcttgttccaactgcaaaaagagcctggaatgtaccaaactgtgcctcccccagattgagaatgtgaagggcacggaggattctgggaccacagacaaaacccatacatgtcctccctgccctgccccggaactgcttggaggcccctccgtctttctgttccctcccaagcctaaggataccctcatgatcagcagaacgcccgaggtgacatgcgttgtggtcgacgtgtctcacgaagatccggaggtgaaatttaactggtatgtcgacggggttgaagtgcataatgcgaagaccaaacctcgggaggagcaatacaactccacatatcgcgtggtcagcgtgctgaccgttcttcaccaggattggctgaatggaaaggaatacaaatgtaaggtgtccaacaaagctctccccgcccctattgagaagaccatctctaaggccaaaggccagcccagagaaccccaggtctacacactgcctccgagccgggaggaaatgacgaagaaccaagtgtccctgacctgcctcgttaaagggttctatcccagcgacatcgctgtggagtgggagtctaatggacagcctgaaaacaattacaagacaacaccccctgtcctggactccgatggcagctttttcctttattctaaactgaccgtggacaagagccgctggcagcaaggcaacgtcttttcctgttctgtgatgcacgaggccctccataatcactacacccaaaagagcctgtcccttagccccgggaaa

SEQ ID NO: 38721 - RNA, 1347 nt, synthetic construct
  misc_feature 1..1347: note = derived and/or modified sequence opt5 from Lenzilumab_HeavyChain1
  source 1..1347: mol_type = other RNA
caggtgcaactggtccagagcggcgccgaggttaagaaacccggggcttccgtgaaggtgtcttgcaaagccagcggatactccttcaccaactattacatccactgggtcagacaggcgcctggccagcggctcgaatggatggggtggattaatgctggaaacggcaatacaaagtattctcaaaaatttcaggggcgcgtgacgatcaccagagacacaagcgcctccaccgcctacatggagctgtctagccttcggtccgaagatacagctgtttattactgtgtgcgcagacagcggttcccgtattactttgactactggggacagggcaccctggtcacagtgagctctgcctccaccaagggccccagcgttttccctctcgctccctcttccaagagcacgtctgggggaaccgccgcgctgggctgccttgtgaaagattattttcctgagcccgtcacagtgtcctggaacagcggggccctgacctccggagtgcatacattccctgctgtcctccaatctagcggcctgtactccctgagctctgttgtgaccgtgccgtccagctctctcgggacgcagacatatatttgtaatgtcaaccacaagcccagcaataccaaagtggacaagcgcgttgaacctaaatcctgcgataagacacatacctgtcccccttgccccgccccggagctgcttggaggcccttctgtgtttctgtttccccctaagcccaaagacaccctcatgatcagcagaacacccgaggtcacgtgtgtggttgtggatgtctcccacgaagaccctgaggtgaagttcaactggtacgtcgatggcgtggaagttcataatgctaaaaccaagccgcgggaggagcagtataacagcacataccgcgtggtctctgtgctgaccgttcttcaccaggactggctgaatgggaaagaatataagtgcaaagtgtccaacaaggccctccccgcgcctattgagaagacaatcagcaaagccaagggacaacccagagaacctcaggtctacaccctgcccccgtctcgggaggaaatgacgaaaaatcaggtgtccctgacatgtctcgtgaagggcttctaccctagcgatatcgctgttgagtgggagtccaacgggcaacccgaaaataactataaaaccacccctcccgtcctggactctgatggcagctttttcctttactccaagctgacagtggacaagtctcgctggcagcagggaaacgtgtttagctgctccgtcatgcacgaggccctccataatcactatacccagaaaagcctgtctctttcccctgggaag

SEQ ID NO: 38722 - RNA, 642 nt, synthetic construct
  misc_feature 1..642: note = derived and/or modified sequence opt5 from Lenzilumab_LightChain1
  source 1..642: mol_type = other RNA
gagatcgtgctgacccagagccccgccacactctccgtctctcctggcgaaagagctacgctgagctgccgggcctcccaatctgttgggaccaacgtggcgtggtaccagcagaagccgggacaggctccccgcgtgcttatttatagcacatcctctagagccaccggcatcacagaccggttcagcgggtccggaagcggcaccgattttacactgaccatttctcgcctcgagcctgaagacttcgccgtctactattgtcaacagtttaataaaagccccctgacgttcgggggaggcaccaaggtggagatcaaaagaacagttgctgccccttccgtgtttatttttcccccttctgatgaacagcttaagtccggcaccgctagcgtcgtgtgcctgctcaacaatttctacccgcgggaggccaaagttcagtggaaggtggacaacgcgctgcaatctggaaattcccaggagagcgtcacagaacaggattccaaggactctacctatagcctgtccagcacgctcacactgtctaaagccgattacgagaagcacaaagtgtatgcttgtgaagtgacccatcaggggctttccagccccgtcacaaagtctttcaaccgcggcgagtgc

SEQ ID NO: 38723 - RNA, 1326 nt, synthetic construct
  misc_feature 1..1326: note = derived and/or modified sequence opt5 from Lerdelimumab_HeavyChain1
  source 1..1326: mol_type = other RNA
gaggtgcagctggtcgaaagcggcgggggagttgtgcaacccggcagatccctccggctgtcttgcgccgctagcgggttcaccttttcctcttacggaatgcactgggtgcgccaggcccctggcaaggggcttgagtgggtcgcggtgatctggtatgacggaagcaacaaatactatgctgattccgttaagggcagattcacaatttctcgggacaatagcaaaaacacgctgtacctccagatggattccctgcgcgccgaagacaccgccgtgtattactgtggcagaacacttgagagctctctgtgggggcagggaaccctcgtcacagtgtccagcgcttctaccaagggcccgtccgtttttcccctggccccttgcagccggtctacatccgaaagcaccgctgccctggggtgtctcgtgaaagattatttccccgagcctgtcacggtgtcctggaactctggagcgctgaccagcggcgtgcatacatttcccgccgtccttcaatccagcgggctgtactctctctccagcgttgtgaccgtgccttctagctccctgggaacaaagacctacacgtgcaatgtcgaccacaagccgtctaatacaaaagtggataagcgcgttgagagcaaatatggacccccttgtccctcctgccctgctcccgagttccttggcgggccgagcgtgtttctgttccctcccaagcctaaagacaccctcatgatctctagaacacccgaggtcacctgtgtggttgtggatgtctcccaggaagaccccgaggtgcagtttaactggtacgtcgatggagtggaggttcataatgccaagaccaagcctcgggaagaacagttcaacagcacatatcgcgtggtctctgtgctgacggttctgcaccaagactggctcaatggcaaagaatacaagtgcaaagtgtccaacaaggggctgccgagctccattgagaaaaccatctctaaggctaaaggacagcccagagaacctcaggtctatacacttccccctagccaggaggagatgaccaagaatcaagtgtccctgacatgtctcgtgaagggcttttacccctctgatattgccgttgaatgggagagcaacgggcagccggaaaataactataaaaccacgcctcccgtcctggactccgacggcagcttctttctttactctcggctgacagtggataagtcccgctggcaggagggcaatgtgttcagctgctctgtcatgcatgaagcgctccacaaccactacacccaaaaatccctgagcctgtctctcggcaag

SEQ ID NO: 38724 - RNA, 645 nt, synthetic construct
  misc_feature 1..645: note = derived and/or modified sequence opt5 from Lerdelimumab_LightChain1
  source 1..645: mol_type = other RNA
agctccgagctgacccaggaccccgccgtgtctgtcgctctcggccaaacagttagaatcacgtgccagggggatagcctgcggtcctactatgcctcttggtaccagcagaagcctggacaagcgccggtgcttgtgatttatggcaaaaacaatcgccccagcgggatccctgacagattctccggatctagctccggcaacaccgctagcctgacaattaccggggcccaggccgaagatgaggctgactactattgtaattctcgggattccagctctacacaccgcggagtctttggcggcgggaccaagctcacagtgctgggacagcccaaagccgctccttccgttaccctttttccccctagctctgaagaactgcaggccaacaaggcgacgctcgtgtgcctgatctccgacttctacccgggcgccgtcaccgtggcttggaaagccgatagctcccccgttaaggctggggtggaaacaaccacaccttctaagcaaagcaataacaaatatgccgcgtccagctacctgtctctcacccccgagcagtggaagtcccatagaagctactcttgtcaggtcacgcacgagggaagcacagtggagaaaaccgtggcccctacagagtgctcc

SEQ ID NO: 38725 - RNA, 1353 nt, synthetic construct
  misc_feature 1..1353: note = derived and/or modified sequence opt5 from Lexatumumab_HeavyChain1
  source 1..1353: mol_type = other RNA
gaggtgcagctggtccagagcggcgggggagttgaaagacccggcgggtccctccggctgtcttgcgccgctagcggattcacctttgacgattacggcatgtcctgggtgcgccaggcccctgggaagggacttgagtgggtgtctggcatcaactggaatggcgggagcacaggatatgcggactccgtcaaaggcagagtgacgatttctcgggataacgctaagaatagcctgtacctccagatgaactccctgcgcgccgaagacaccgccgtttattactgtgctaaaatccttggggccggaagaggctggtatttcgatctgtgggggaagggaacaaccgtgacagtcagctctgcttccaccaaaggcccgagcgtgtttcccctcgccccttcttccaagagcacatctggcgggaccgcggccctgggatgcctggttaaggactacttccccgagcctgtgacggtctcctggaatagcggcgctctcacctccggggtgcacacatttcccgccgtgctgcagtctagcggactttattccctgagctctgtcgttaccgtgccttccagctctctcggcacacaaacctacatttgtaacgtgaatcataaaccgagcaacacgaaggtcgataaacgggtggaacccaagtcctgcgacaaaacacacacctgtcctccctgccctgctcccgagctgcttgggggaccgtctgttttcctgtttcctcccaagcctaaggatacactcatgatcagccgcacccccgaggtgacctgtgtcgtggttgacgtgtcccatgaagatcccgaggtcaaattcaattggtacgtggacggcgtcgaagtgcacaacgccaagacaaaacctagagaggagcagtataatagcacgtaccgggttgtgtctgtcctgaccgtgctgcatcaggattggctcaacggcaaggaatataaatgcaaggtttccaataaagcgctgccggcccccattgagaagacaatcagcaaggctaaagggcagcctcgcgaaccccaagtgtacacccttcctccctctagagaggaaatgacaaagaaccaggtctccctgacctgtctcgtgaaaggattttatccgagcgacatcgccgtggagtgggagtccaatggccagcctgaaaacaactacaagacgacaccccctgttctggactctgatgggagcttctttctttattccaaactgaccgtcgacaagtctcggtggcagcaaggaaatgtgttcagctgctccgtgatgcacgaggctctccacaaccattacacccaaaagagcctgtctctgtcccccggcaaa

SEQ ID NO: 38726 - RNA, 1353 nt, synthetic construct; identical to SEQ ID NO: 38725
  misc_feature 1..1353: note = derived and/or modified sequence opt5 from Lexatumumab_HeavyChain
  source 1..1353: mol_type = other RNA

SEQ ID NO: 38727 - RNA, 642 nt, synthetic construct
  misc_feature 1..642: note = derived and/or modified sequence opt5 from Lexatumumab_LightChain1
  source 1..642: mol_type = other RNA
agctccgagctgacccaggaccccgccgtgtctgtcgctctcggccaaacagttagaatcacgtgccagggggatagcctgcggtcctactatgcctcttggtaccagcagaagcctggacaagcgccggtgcttgtgatttatggcaaaaacaatcgccccagcgggatccctgacagattctccggatctagctccggcaacaccgctagcctgacaattaccggggcccaggccgaagatgaggctgactactattgtaattctcgggattccagcggaaaccacgtcgtgtttggcggcgggacaaagctcaccgttctgggacagcccaaagccgctccttctgtgacactttttcccccttccagcgaagaactgcaggccaataaggcgaccctcgtctgcctgatctctgacttctacccgggcgccgtgacggttgcttggaaagccgattccagccccgtgaaggctggggtcgaaaccacaaccccttccaagcaatctaacaataaatatgccgcgagctcctacctgagcctcacacccgagcagtggaagtctcatcgctcctacagctgtcaggtgacccacgagggatctacggtggagaaaacagtcgcccctaccgagtgcagc

SEQ ID NO: 38728 - RNA, 642 nt, synthetic construct; identical to SEQ ID NO: 38727
  misc_feature 1..642: note = derived and/or modified sequence opt5 from Lexatumumab_LightChain
  source 1..642: mol_type = other RNA

SEQ ID NO: 38729 - RNA, 1377 nt, synthetic construct
  misc_feature 1..1377: note = derived and/or modified sequence opt5 from Libivirumab_HeavyChain1
  source 1..1377: mol_type = other RNA
caggtgcaactggtcgagagcggcgggggagttgtgagacccggccggtccctccgcctgtcttgcgccgctagcgggttcgccttttccgactactctatcaactgggtgagacaggcgcctggaaagggccttgaatgggtcgctattatcagctatgatgggcggattacctactatcgcgactccgtgaaaggaagattcacaatctctcgggatgacagcaagaatacgctgtacctccagatgaactccctgcgcaccgaggatacagccgtttattactgtgccagacagtattacgacttttggagcgggtcttccgtgggccggaattacgatggcatggacgtctggggacttggcaccacagtgaccgttagctctgcttccacaaaagggccgagcgtgttccccctggccccttcttccaagagcacctccggaggcacggctgccctcgggtgcctggtcaaagattattttcccgaacctgtgaccgtgtcttggaacagcggagcgctgacatccggcgtccacaccttccccgccgttctccaaagctctggcctgtactcccttagctctgtggtgacagtccctagctcctctctggggacccagacgtatatttgtaatgtgaaccataagccgagcaatacaaaggttgacaaacgcgtggagcccaagtcctgcgataaaacccacacatgtcctccctgccctgctcccgaactcctgggaggcccgagcgtctttcttttccctcccaagcctaaagacaccctgatgatctctagaacccccgaggtgacatgtgttgtggtcgatgtgtcccatgaggaccccgaagtcaagtttaactggtacgtggacggggttgaggtgcacaatgccaagacgaaacctcgggaggaacagtataacagcacctaccgcgtcgtgtctgttctcacagtgctgcatcaggattggctgaatggaaaggagtataaatgcaaggtctccaacaaagctctcccggcccccatcgaaaagaccattagcaaagcgaagggccaacctagagagccccaggtgtacacactgcctccctcccgggaagagatgaccaagaatcaggtgtctcttacgtgtctggttaaagggttctacccgagcgacatcgccgtcgaatgggagtccaacggacagcctgagaataactataagacaacaccccctgtgctcgattctgacggcagctttttcctgtactccaaacttaccgtggataagagccgctggcaacagggcaacgtcttttcttgctccgtgatgcacgaagctctgcacaatcattatacccagaaaagcctctctctgtcccccgggaag

SEQ ID NO: 38730 - RNA, 657 nt, synthetic construct
  misc_feature 1..657: note = derived and/or modified sequence opt5 from Libivirumab_LightChain1
  source 1..657: mol_type = other RNA
gacatcgtgatgacccagagccccctgtccctctctgtcacacctggcgagccggccagcatttcctgcagatctagccaatccctgcttcaccggtctgggaacaattacctggattggtatctccagaagcccggacatagccctcagctgcttatctacgttggctccaaccgcgctagcggggtgcccgacagattctctggatccggcagcgggacggaatataccctgaaaatttctcgggtggaggccgaagatgtcggagtgtactattgtatgcaggcgctccaaacacctcgcacctttggccagggcacaaagctggagatcaaaagaaccgttgctgccccctccgtgttcatttttcctccgagcgacgaacagctgaagtctgggacagcctccgtcgtgtgcctcctgaataacttctacccccgggaggctaaagttcagtggaaggtggataatgcccttcaaagcggaaactcccaggagtctgtcaccgaacaggacagcaaggattccacgtatagcctgtcttccaccctcacactgagcaaagctgactacgagaagcacaaagtgtacgcctgtgaagtgacccatcagggcctttctagccctgtcacaaagtcctttaatcgcggggagtgc

SEQ ID NO: 38731 - RNA, 1350 nt, synthetic construct
  misc_feature 1..1350: note = derived and/or modified sequence opt5 from Lifastuzumab_HeavyChain
  source 1..1350: mol_type = other RNA
gaggtgcagctggtcgaaagcggcgggggactcgttcaacccggcgggtccctgagactttcttgcgccgctagcggattctccttttctgacttcgccatgagctgggtgcggcaggcgcctggcaaggggctggagtgggtggctaccatcggacgcgtcgcctttcacacatactatccggattccatgaaaggcagattcacgatttctcgggacaacagcaagaataccctctacctgcagatgaactcccttcgcgccgaagatacagctgtgtattactgtgccagacatcggggctttgacgttgggcacttcgatttttggggacagggcaccctggtgacagtcagctctgcttccaccaaagggcccagcgtgttccctctcgccccctcttccaagagcacatctggaggcaccgcggccctggggtgcctggttaaagactattttcctgagcccgtgacggtctcctggaatagcggagctctcacctccggcgtgcatacattccctgccgtgctgcaatctagcggcctttactccctgagctctgtcgttaccgtgccgtccagctctctcgggacacagacctatatctgtaacgtgaatcacaagcccagcaacacgaaggtcgataaaaaggtggaacctaaatcctgcgacaagacacatacctgtcccccttgccccgctccggagctgcttggaggcccttctgtttttctgtttccccctaaacccaaggatacactcatgattagccgcacccccgaggtgacctgtgtcgtggttgacgtgtcccacgaagatcctgaggtcaagttcaattggtacgtggacggggtcgaagtgcacaacgccaaaacaaagccgagagaggagcagtacaatagcacgtatcgggttgtgtctgtcctgaccgtgctgcatcaggattggctcaacggaaaagaatacaagtgcaaagtttccaataaggcgctgcccgcccctatcgagaaaacaattagcaaggctaagggccaaccccgcgaacctcaggtgtatacccttcccccgtctagagaggaaatgacaaagaaccaggtctccctgacctgtctcgtgaaggggttctaccctagcgacatcgccgtggagtgggagtccaatggacagcccgaaaacaattataaaacgacacctcccgttctggactctgatggcagcttctttctttactccaagctgaccgtcgacaaatctcggtggcaacagggcaacgtgttcagctgctccgtgatgcacgaggctctccataaccactatacccagaaaagcctgtctctgtcccctgggaag

SEQ ID NO: 38732 - RNA, 657 nt, synthetic construct
  misc_feature 1..657: note = derived and/or modified sequence opt5 from Lifastuzumab_LightChain
  source 1..657: mol_type = other RNA
gacatccagatgacccaaagcccctcctctctgagcgcctccgtgggcgatagagtcacaattacgtgccggtctagcgagaccctcgttcactcctctgggaacacatacctggaatggtatcagcagaagcctggaaaagctccgaaacttctgatctaccgcgtgagcaatagattctccggcgtgcccagccggttttctgggtccggaagcggcaccgacttcacactcaccatttcttccctgcagcctgaggattttgccacatattactgtttccaagggagctttaacccccttaccttcggacagggcacgaaagtcgaaatcaagcgcaccgtggcggctccttctgtttttatttttcccccttccgacgagcagctgaaaagcggcacagcctccgtggtctgcctcctgaataacttctatccgagagaagccaaggtgcagtggaaggttgataatgctctgcaatctgggaacagccaggagtccgtgaccgagcaggacagcaaagattctacatactccctcagctctaccctgacgcttagcaaggccgactatgaaaaacataaggtctacgcttgtgaggtgacacaccagggactgtcctctcccgtgaccaagagcttcaatcggggcgaatgc

SEQ ID NO: 38733 - RNA, 1347 nt, synthetic construct
  misc_feature 1..1347: note = derived and/or modified sequence opt5 from Lifastuzumab_vedotin_HeavyChain1
  source 1..1347: mol_type = other RNA
gtgcagctggtcgagagcggcgggggactcgttcaacccggcgggtccctgagactttcttgcgccgctagcggattctccttttctgacttcgccatgagctgggtgcggcaggcgcctggcaaggggctggaatgggtggctaccatcggacgcgtcgcctttcacacatactatccggattccatgaaaggcagattcacgatttctcgggacaacagcaagaataccctctacctgcagatgaactcccttcgcgccgaggatacagctgtgtattactgtgccagacatcggggctttgacgttgggcacttcgatttttggggacagggcaccctggtgacagtcagctctgcttccaccaaagggcccagcgtgttccctctcgccccctcttccaagagcacatctggaggcaccgcggccctggggtgcctggttaaagactattttcctgaacccgtgacggtctcctggaatagcggagctctcacctccggcgtgcatacattccctgccgtgctgcaatctagcggcctttactccctgagctctgtcgttaccgtgccgtccagctctctcgggacacagacctatatctgtaacgtgaatcacaagcccagcaacacgaaggtcgataaaaaggtggagcctaaatcctgcgacaagacacatacctgtcccccttgccccgctccggaactgcttggaggcccttctgtttttctgtttccccctaaacccaaggatacactcatgattagccgcacccccgaggtgacctgtgtcgtggttgacgtgtcccacgaggatcctgaagtcaagttcaattggtacgtggacggggtcgaggtgcacaacgccaaaacaaagccgagagaagaacagtacaatagcacgtatcgggttgtgtctgtcctgaccgtgctgcatcaggattggctcaacggaaaagagtacaagtgcaaagtttccaataaggcgctgcccgcccctatcgagaaaacaattagcaaggctaagggccaaccccgcgagcctcaggtgtatacccttcccccgtctagagaagagatgacaaagaaccaggtctccctgacctgtctcgtgaaggggttctaccctagcgacatcgccgtggaatgggagtccaatggacagcccgagaacaattataaaacgacacctcccgttctggactctgatggcagcttctttctttactccaagctgaccgtcgacaaatctcggtggcaacagggcaacgtgttcagctgctccgtgatgcacgaagctctccataaccactatacccagaaaagcctgtctctgtcccctgggaag

SEQ ID NO: 38734 - RNA, 657 nt, synthetic construct; identical to SEQ ID NO: 38732
  misc_feature 1..657: note = derived and/or modified sequence opt5 from Lifastuzumab_vedotin_LightChain1
  source 1..657: mol_type = other RNA

SEQ ID NO: 38735 - RNA, 1359 nt, synthetic construct
  misc_feature 1..1359: note = derived and/or modified sequence opt5 from Ligelizumab_HeavyChain1
  source 1..1359: mol_type = other RNA
caggtgcaactggtccagagcggcgccgaggttatgaagcccgggtcctctgtgaaagtgagctgcaaggcttccggatacaccttctcttggtattggctcgaatgggtcagacaggcccctggccacgggctggagtggatgggagaaatcgacccgggcacatttacgaccaactacaatgagaaattcaaggcgcgggtgacatttaccgctgatacaagcacctccacagcctatatggaactttctagcctgcgctccgaggacaccgccgtttactattgtgctagattcagccatttttctgggtccaactacgattatttcgactactggggacagggcacgctcgtgaccgtcagctctgcctccacaaaaggccccagcgtgtttcctctggctccctcttccaagagcacctccgggggaacagccgcgcttggctgcctggttaaggattacttccctgagcccgtgaccgtctcttggaatagcggggccctcacgtccggagtgcacacatttcctgctgtgctgcaaagctctggcctgtattccctcagctctgtcgttaccgtgccgagctcctctctggggacacagacctacatttgtaacgtgaatcataaacccagcaacaccaaggtcgacaaaaaggtggaacctaaatcctgcgataagacacacacgtgtcccccttgccccgccccggagcttctgggaggccctagcgttttcctctttccccctaagcccaaagacaccctgatgatctctcggacacccgaagtgacctgtgtcgtggttgatgtgtcccatgaggaccctgaggtcaagttcaattggtatgtggatggcgtcgaagtgcacaacgctaaaacaaagccgcgcgaggaacagtacaatagcacctatagagttgtgtctgtccttacggtgctgcaccaggactggctcaacgggaaagagtacaagtgcaaagtttccaataaggccctgcccgcgcctattgaaaagacaatcagcaaagccaagggacaaccccgggagcctcaggtgtataccctgcccccgtcccgcgatgagctcaccaaaaaccaggtctctctgacatgtcttgtgaagggcttttaccctagcgacattgctgtggaatgggagtccaatgggcagcccgaaaacaattacaaaaccacacctcccgttctggactctgatggcagcttcttcctctattccaagctgacggtcgacaagagcagatggcaacagggaaacgtgttttcttgctccgtgatgcatgaggcccttcacaaccattacacccagaaaagcctgtctctctcccctgggaag

SEQ ID NO: 38736 - RNA, 642 nt, synthetic construct
  misc_feature 1..642: note = derived and/or modified sequence opt5 from Ligelizumab_LightChain1
  source 1..642: mol_type = other RNA
gagatcgtgatgacccagagccccgccacactgtccgtctctcctggcgaaagagctacgctcagctgccgggcctcccaatctattgggaccaacatccactggtaccagcagaagccgggacaggcgccccgcctgcttatttattacgctagcgagtccatctctggcattcctgccagattcagcgggtccggaagcggcacagaatttaccctgacaatctcttccctccaaagcgaggacttcgccgtttattactgtcagcagtcttggtcctggcccaccacatttgggggaggcaccaaagtggaaatcaagcggacggtggctgcccctagcgtcttcatttttcccccttctgatgagcagctgaaatccggcaccgctagcgtggtttgccttctgaataacttctatccgcgcgaggccaaggtgcaatggaaagtcgacaatgcgctccagtccgggaactctcaggaaagcgtgacagagcaggattccaaggacagcacctactctctgtccagcacactgaccctctctaaggccgattatgaaaaacataaggtttacgcttgtgaggtgacgcaccaaggactgagctcccccgtcacaaaatcttttaatagaggcgagtgc

SEQ ID NO: 38737 - RNA, 1329 nt, synthetic construct; identical to SEQ ID NO: 38285
  misc_feature 1..1329: note = derived and/or modified sequence opt5 from Lilotomab_HeavyChain1
  source 1..1329: mol_type = other RNA

SEQ ID NO: 38738 - RNA, 642 nt, synthetic construct; identical to SEQ ID NO: 38286
  misc_feature 1..642: note = derived and/or modified sequence opt5 from Lilotomab_LightChain1
  source 1..642: mol_type = other RNA

SEQ ID NO: 38739 - RNA, 1338 nt, synthetic construct
  misc_feature 1..1338: note = derived and/or modified sequence opt5 from Lintuzumab_HeavyChain1
  source 1..1338: mol_type = other RNA
caggtgcaactggtccagagcggcgccgaggttaagaaacccgggtcctctgtgaaggtgagctgcaaggcttccggatacaccttcacagactataacatgcactgggtcagacaggcccctggccaggggctcgaatggatcggatacatttatccgtacaatggcgggacgggatataaccaaaaatttaaatctaaggcgaccatcacagctgatgagagcaccaatacagcctacatggaactgtcctctcttcggagcgaggacaccgccgtgtattactgtgctcgcggcagacccgccatggattactggggccaggggacactggttaccgtgtccagcgcttctacgaagggaccttccgtcttccccctcgcccctagctctaaatccaccagcggcgggacagcggccctgggatgccttgtgaaggactattttcccgaacctgttaccgtgtcttggaactccggcgctctgacaagcggggtccataccttcccggccgtgctccagtcctctggactgtacagcctgtccagcgtggtcacggttccctcttccagcctcggcacacagacctatatttgtaatgtgaaccacaaaccttctaatacaaaggtggataaaaaggtcgagcccaagagctgcgacaaaacccatacctgtcctccctgcccggctcctgagctgcttggcgggccctccgtgtttctgttccctcccaagcccaaagatacactcatgatctctcggacgcctgaagttacctgtgtggtcgtggacgttagccacgaggatccggaagtgaagtttaactggtacgtcgacggagtggaggtccataatgccaaaacaaagccccgcgaggaacaatataactccacctacagagtggttagcgtgctgacagtccttcaccaggattggctgaatggcaaagagtataagtgcaaggtgtctaacaaagcgctccctgcccccattgaaaagaccatctccaaagctaaggggcagcctcgggagccccaggtttacacgctgccgcctagccgcgacgaactgaccaaaaatcaagtgtctctcacatgtctggtcaagggattctacccctccgatatcgccgtggagtgggagagcaacggccagcctgaaaataactataagaccacaccccctgtgcttgactccgacgggagctttttcctgtactctaaactcaccgttgataagtccagatggcagcaaggaaacgtcttttcttgcagcgtgatgcacgaggctctgcataatcactatacacagaaatcccttagcctgtctcccggcaag

SEQ ID NO: 38740 - RNA, 654 nt, synthetic construct
  misc_feature 1..654: note = derived and/or modified sequence opt5 from Lintuzumab_LightChain1
  source 1..654: mol_type = other RNA
gacatccagatgacccaaagcccctcctctctgagcgcctccgtgggcgatagagtcacaattacgtgccgggcttctgagagcgttgacaactacgggatctccttcatgaattggtttcagcagaagcctggaaaagccccgaagctcctgatttatgcggcttctaaccagggcagcggggtgccctcccgcttcagcggatctggctccgggaccgattttacacttaccatcagctctctgcaacctgacgatttcgccacatactattgtcagcagtccaaagaagtgccctggacctttggacagggcacaaaggtcgagattaaaagaaccgtggccgctcctagcgttttcatctttcccccttctgacgaacaactcaagtccggcacggccagcgtggtctgcctgcttaataacttctacccgcgggaggctaaggtgcagtggaaagttgataatgccctgcagtccgggaactctcaggaaagcgtgaccgagcaagactccaaggatagcacatattctctctccagcaccctgacactgtctaaagcggactacgagaagcacaaagtctatgcctgtgaagtgacccatcagggactcagctcccccgtgacgaagtcttttaatcgcggcgagtgc

SEQ ID NO: 38741 - RNA, 1350 nt, synthetic construct
  misc_feature 1..1350: note = derived and/or modified sequence opt5 from Lirilumab_HeavyChain1
  source 1..1350: mol_type = other RNA
caggtgcaactggtccagagcggcgctgaggttaagaaacccgggtcctctgtgaaggtgagctgcaaggcttccggaggcaccttctctttttacgccatcagctgggtcagacaggcgcctgggcagggactcgaatggatgggcgggttcattccgatctttggagctgccaactatgcccaaaaattccagggccgggtgacaattacggctgacgagtccacctctacagcctacatggaactgagctcccttcgcagcgatgacaccgctgtttattactgtgccagaatcccctctggctcctattactatgattacgacatggatgtgtgggggcagggaacaaccgtcacagtgagctctgcgtccaccaaaggccctagcgtttttcccctggccccttgctctcggtccacgagcgagtccaccgctgccctcgggtgtctggtgaaggactacttccccgaacctgtcacagtgtcttggaatagcggagctcttacctccggcgtgcacacatttccggccgtcctgcagagctctgggctctattccctgagctctgttgtgaccgtgcccagctcctctctgggaacgaagacatatacctgcaacgtcgatcataaacctagcaatacaaaggtggacaaacgcgttgagtccaagtacggacccccttgtcccccgtgccctgcgcccgagttcctcggcgggcctagcgtgtttctgttccctcccaaacccaaggatacccttatgatttctagaaccccggaagtcacatgtgtggttgtggacgtctcccaagaggatcccgaagtgcagtttaactggtacgtcgacggagtggaggttcacaatgccaagacgaaacctcgggaggaacagttcaacagcacctatcgcgtggtctctgtgctgacagttctccatcaggattggctgaatggcaaggagtacaaatgcaaggtgtccaacaaagggcttcccagctccatcgaaaagaccatctctaaagctaagggacaacctagagagccccaggtctatacactgccgcctagccaggaagagatgaccaagaatcaagtgtccctcacgtgtctggtgaaaggcttttacccctctgacattgccgttgagtgggaaagcaacgggcagcctgagaataactacaagacaacaccccctgtcctggactccgatggcagcttcttcctctattctcggctgaccgtggacaaatcccgctggcaggaaggcaatgtgtttagctgctctgtcatgcacgaggcccttcataaccactacacccagaagtccctgagcctctctctgggcaaa

SEQ ID NO: 38742 - RNA, 642 nt, synthetic construct
  misc_feature 1..642: note = derived and/or modified sequence opt5 from Lirilumab_LightChain1
  source 1..642: mol_type = other RNA
gagatcgtgctgacccagagccccgtcacactcagcctgtctcctggcgaaagagccacgcttagctgccgggcttcccaatctgttagctcctacctggcctggtatcagcagaagccggggcaggcgccccgcctcctgatttacgacgcttctaacagagccaccggaatccctgcccggttcagcggctccgggagcggaacagattttacccttacaatttcttccctggagcccgaagacttcgctgtgtattactgtcaacagcgcagcaattggatgtatacctttggccaggggacaaaactcgagatcaagagaaccgtggccgctccttctgtcttcatttttcccccttccgatgaacagctgaaaagcggaacggcctctgtggtttgcctgctcaacaatttctacccgcgggaggcgaaggtgcaatggaaagtcgacaacgccctgcagtccggcaatagccaggagtccgtgaccgaacaggattctaaggacagcacatattcccttagctctaccctgacactctccaaggctgattacgagaaacacaaggtttacgcctgtgaagtgacccatcaaggcctgagctctcccgtcacgaaatcctttaaccgcggggagtgc

SEQ ID NO: 38743 - RNA, 1344 nt, synthetic construct
  misc_feature 1..1344: note = derived and/or modified sequence opt5 from Lodelcizumab_HeavyChain1
  source 1..1344: mol_type = other RNA
caggtgcagctggtccagagcggcgccgaggttaagaaacccggggcttccgtgaaggtgtcttgcaaagccagcggatacaccttctccacaatgtatatgtcttgggtcagacaggcgcctggccaggggctcgaatggatgggacggatcgacccggctaacgagcacacgaattacgcccaaaagtttcagggccgcgtgaccatgacaagagataccagcatttccacagcctatatggaactgtctcggcttaccagcgacgatacagctgtttactattgtgcccgctcctactattactacaacatggactattgggggcagggaaccctggtgacggtcagctctgcttccaccaaaggccccagcgtgttccctctcgccccctcttccaagagcacatctggcgggaccgcggccctgggatgccttgttaaggattactttcctgagcccgtgacagtctcctggaatagcggcgctctgacctccggggtgcatacgttccctgccgtgctccagtctagcggactgtattccctgagctctgtcgttacagtgccgtccagctctctcggcacccaaacatacatctgtaacgtgaatcacaaacccagcaacaccaaggtcgacaaaagagtggaacctaagtcctgcgataaaacccatacatgtcccccttgccccgctccggaggccgctgggggaccttctgtttttctgtttccccctaagcccaaggacacgcttatgattagccggacccccgaggtgacatgtgtcgtggttgatgtgtcccacgaagaccctgaggtcaaattcaattggtatgtggatggcgtcgaagtgcataacgccaagaccaaaccgcgcgaggagcagtacaatagcacatatagagttgtgtctgtcctgaccgtgctccaccaggactggctgaacggcaaggaatacaaatgcaaggtttccaataaagcgcttcccgcccctatcgagaagacgattagcaaggctaaagggcagccccgggaacctcaagtgtacacactgcccccgtctcgcgaggaaatgaccaagaaccaggtctccctcacctgtctggtgaaaggattctatcctagcgatatcgccgtggagtgggagtccaatggccagcccgaaaacaattacaagacaacccctcccgttctggactctgacgggagctttttcctctattccaaactgacagtcgataagtctagatggcaacagggaaacgtgtttagctgctccgtgatgcacgaggcccttcataaccactacacgcaaaagagcctgtctctctcccctggcaaa

SEQ ID NO: 38744 - RNA, 639 nt, synthetic construct
  misc_feature 1..639: note = derived and/or modified sequence opt5 from Lodelcizumab_LightChain1
  source 1..639: mol_type = other RNA
cagatcgtgctgacccaaagccccgccacactctccgtctctcctggcgagagagctacgctgagctgccgggcctcccagtctgttagctacatgcactggtatcagcagaagccggggcaagcgccccgccttctgatttacggagtgttcagacgggctaccggcatccctgaccgcttttccgggtctggaagcggcacagatttcaccctcacaattgggagactggaacccgaggactttgccgtgtattactgtcttcagtggtccagcgatcctcccaccttcggacagggcacaaaactggaaatcaagcggaccgtcgccgctccttctgtgtttattttcccgccctccgacgagcagctcaaaagcggcacggcctctgttgtgtgcctgctgaacaatttttatcctcgcgaagctaaggtccaatggaaagtggataacgccctccagtccgggaatagccaggagtctgttaccgagcaggactccaaggatagcacatactccctgtctagcacccttacactgtccaaggcggactatgaaaaacataaggtgtacgcctgtgaggtcacccaccaaggactcagctctcccgtgacgaaatccttcaacagaggcgaatgc

SEQ ID NO: 38745 - RNA, 1356 nt, synthetic construct
  misc_feature 1..1356: note = derived and/or modified sequence opt5 from Lokivetmab_HeavyChain1
  source 1..1356: mol_type = other RNA
gaggtgcagctggtcgaaagcggcggggacctcgttaagcccggaggctccctgagactttcttgcgtggccagcgggttcaccttttccaactacggaatgtcttgggtgcggcaagctcctggcaaagggctgcagtgggtcgccacaatcagctatggaggctcctacacgtattacccggataatattaagggccgcttcaccatctctagagacaacgcgaaaaatacactctatctgcagatgaacagccttcgggctgaggataccgccatgtactattgtgtgcgcgggtacggatacgacacaatggattattggggccaggggaccctggttacagtgtccagcgcctctaccacggctccctccgtctttcctctcgcccccagctgcggatctacctccggcagcacagtggctctggcctgtctggtttctgggtacttccctgaacccgtgaccgtctcctggaatagcggatccctcacatctggcgtgcacacctttcctagcgtgctgcaatccagcggcctttattctctgtccagcatggtcacggttccgtctagcagatggccctccgagacatttacctgcaacgtggcgcatcctgcctctaagacaaaagtggacaagcccgtccctaagcgggaaaatgggcgcgtgcccagaccgcctgattgtcccaaatgccctgctcccgagatgctcggaggccccagcgttttcattttccctccgaagcccaaagacaccctgcttatcgcccggacccctgaggtgacatgtgtcgtggttgatctggaccccgaagatcctgaggtgcagatttcctggtttgtcgacgggaagcagatgcagacggctaaaacccaaccccgcgaagaacagttcaacggaacatacagagtggtcagcgtgctcccgatcggccaccaggattggctgaaggggaagcagtttacctgcaaagttaataacaaggccctgccttctcccatcgagcggacaatttccaaagcgcgcggacaagcccatcagcctagcgtgtatgtcctgcccccttctagagaggagctctccaagaataccgtgagccttacgtgtctgatcaaagacttctttcccccggacattgatgttgaatggcagtccaacggccaacaggagcctgaatctaagtaccggacaacccctccccagctcgacgaggatggcagctatttcctgtactccaaactttctgtggacaagagccgctggcagagaggggataccttcatctgcgctgtcatgcacgaggccctgcataatcactacacacaagaatccctcagccactctcccgga

SEQ ID NO: 38746 - RNA, 651 nt, synthetic construct
  misc_feature 1..651: note = derived and/or modified sequence opt5 from Lokivetmab_LightChain1
  source 1..651: mol_type = other RNA
gagatcgtgatgacccagagccccgcctccctgtctctcagccaagaagagaaggtcacaattacgtgcaaggcttcccagtctgttagcttcgccggcaccgggctgatgcactggtaccagcagaagcctggacaagcgccgaaacttctgatctatagagcttccaacctcgaagccggcgtgccctctcggtttagcgggtccggaagcggcacagacttctcttttaccatttccagcctggagcctgaagatgtggccgtctactattgtcagcagtctcgcgagtacccctggacattcgggcagggaaccaaacttgagatcaaaagaaatgacgctcaacctgccgtgtatctgtttcagccctcccctgatcagctccatacaggcagcgcttctgttgtgtgcctgctgaactccttctacccgaaggacattaatgtcaagtggaaagtggatggcgttatccaggacaccgggatccaagaaagcgtgacggagcaggataaggactccacctattctctcagctccacactgaccatgagctctacagaatacctttcccacgagctgtacagctgtgagattacccataaatctctccccagcacgctgatcaagtcctttcagcggtctgaatgc

SEQ ID NO: 38747 - RNA, 1344 nt, synthetic construct
  misc_feature 1..1344: note = derived and/or modified sequence opt5 from Lorvotuzumab_mertansine_HeavyChain1
  source 1..1344: mol_type = other RNA
caggtgcaactggtcgagagcggcgggggagttgtgcagcccggcagatccctccggctgtcttgcgccgctagcgggttcaccttttcctctttcggaatgcactgggtgcgccaggcccctggcaaggggcttgaatgggtcgcgtacatcagctccggatcttttacaatttattacgctgacagcgtgaaaggcagattcacgatctcccgggataacagcaagaataccctgtatctccagatgaactctctgcgcgccgaggacacagccgtttactattgtgctagaatgcggaaaggctacgccatggattattgggggcaaggaacccttgtgacagtctccagcgcttctaccaagggcccgtccgtgtttcccctggcccctagctctaaatccacaagcgggggaaccgcggccctcggctgcctggttaaggactacttccccgaacctgtgacggtctcctggaactctggggctctgaccagcggagtgcatacatttcccgccgtgctccagtccagcggcctgtactctctttccagcgtcgttaccgtgccttctagctccctgggcacacagacctatatttgtaatgtgaatcacaagccgtctaacacgaaagtcgataagaaagtggagcccaagagctgcgacaaaacacatacctgtcctccctgccctgctcccgaactccttgggggaccgtccgttttcctgtttcctcccaagcctaaggatacactgatgatcagccgcacccccgaggtgacctgtgtcgtggttgacgtgtctcacgaggatcccgaagtcaaattcaattggtacgtggacggcgtcgaggtgcataacgccaagacaaaacctagagaggaacagtataattccacgtaccgggttgtgagcgtcctcaccgtgctgcaccaagattggctgaacgggaaggagtataaatgcaaggtttctaataaagcgctcccggcccccattgaaaagacaatctccaaggctaaaggacagcctcgcgagccccaggtgtacaccctgcctcccagcagagacgaacttacaaagaaccaggtctccctgacctgtctcgtgaaaggcttttatccgtctgatatcgccgtggagtgggaaagcaatgggcaacctgagaacaattacaagacgacaccccctgttctggactccgacggatctttctttctttacagcaaactgaccgtcgataagtcccggtggcagcagggcaacgtgttcagctgctctgtgatgcacgaggctctccataaccactatacccaaaagtccctgagcctgtctcccggcaaa

SEQ ID NO: 38748 - RNA, 657 nt, synthetic construct
  misc_feature 1..657: note = derived and/or modified sequence opt5 from Lorvotuzumab_mertansine_LightChain1
  source 1..657: mol_type = other RNA
gacgtggtcatgacccagagccccctgtccctccctgttacactgggccaaccggcctctatcagctgcagatcctctcagattatcattcacagcgatgggaacacgtaccttgagtggttccagcagcggcccggacaatcccctcgcagactgatctataaggtgtctaatcggtttagcggcgtgcccgaccgcttctccgggagcggatctggcaccgattttacactcaaaatttccagagtcgaagctgaggacgtgggggtttactattgtttccagggaagccatgtgcctcacacctttggccagggcacaaaggtcgaaatcaaacggaccgtggccgcgccctctgttttcatctttcctccgtccgatgagcagcttaagagcgggacagcttctgtggtctgcctgctgaacaatttctacccccgcgaagccaaagtgcaatggaaggtggacaacgccctccagtccggaaatagccaggagtccgtcaccgagcaggattctaaggacagcacgtattccctgagctctaccctgacactctccaaagctgattacgaaaagcataaagtttatgcctgtgaggtgacccaccaaggcctgagctctcctgtgacaaagagctttaacagaggggaatgc

SEQ ID NO: 38749 - RNA, 336 nt, synthetic construct
  misc_feature 1..336: note = derived and/or modified sequence opt5 from Lpathomab_VL
  source 1..336: mol_type = other RNA
gacgtggtcatgacccagacacccctgagcctccctgtttccctgggcgatcaagcctctatcagctgcacgtccgggcagtctcttgtgcacattaacggaaatacctacctgcattggtatctccagaagccgggccagagccccaaactgcttatctacaaggtgtccaacctgttctctggggtccctgacagatttagcggatccggcagcgggacagatttcaccctcaaaatttctcgggtggaggctgaagacctgggagtttatttttgttcccaaagcacacacttcccctttaccttcggcacaggcaccaagctggagatcaaa

SEQ ID NO: 38750 - RNA, 366 nt, synthetic construct
  misc_feature 1..366: note = derived and/or modified sequence opt5 from Lpathomab_gamma1-Chain_VDJ-Region
  source 1..366: mol_type = other RNA
caggtgcaactgcagcagagcggcgccgagctcgtcagacccgggacctccgttaaggtgtcttgcaaagctagcggatacggcttcatcaactatctgattgaatggatcaagcagcggcctgggcaaggacttgagtggattggcctgatcaatccggggtccgactacacaaactataatgaaaactttaaaggaaaggccacgctcaccgcggataaatctagctccacagcttacatgcacctgtctagccttacctccgaggacagcgccgtgtatttctgtgcccgcagatttggctactatggctctgggaattacttcgattactggggacagggcacaaccctgacagtctccagc

SEQ ID NO: 38751 - RNA, 1350 nt, synthetic construct
  misc_feature 1..1350: note = derived and/or modified sequence opt5 from Lucatumumab_HeavyChain1
  source 1..1350: mol_type = other RNA
caagtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatcagctatgaggaatccaacagataccatgctgactctgttaaaggacggttcacaattagccgcgataattccaagatcacgctgtatctccagatgaacagcctgagaaccgaggacacagccgtgtactattgtgcccgggatggcggcattgctgccccggggcccgactactggggacaaggcacccttgtcacagtgtcttccgctagcaccaaagggccttctgtttttcccctggcccctgcgtccaagagcacatctggaggcaccgccgctctcgggtgcctggtgaaagattatttccccgaacctgtcacggtgtcctggaatagcggagccctgacctccggcgtgcacacatttccggctgtcctccagtctagcggcctgtactcccttagctctgttgtgaccgtgccctccagctctctggggacacagacctacatctgtaacgtcaatcataagcctagcaacacgaaggtggacaaacgcgttgagcccaagtcctgcgataaaacacacacctgtcctccctgcccggcccctgagctcctgggaggcccctctgtgttcctttttcctcccaagcccaaagacacactgatgattagcagaacccctgaagtcacctgtgtggttgtggatgtctcccatgaggacccggaagtgaagttcaattggtatgtcgatggggtggaggttcacaacgcgaagacaaaaccccgggaggaacagtacaatagcacgtatcgcgtggtctctgtgctcaccgttctgcaccaagactggctgaacggaaaggagtacaaatgcaaggtgtccaataaagccctccctgctcccatcgaaaagacaatcagcaaagccaagggccagcctagagagccccaggtctataccctgccgccttctcgggaagagatgacaaagaaccaggtgtcccttacctgtctggtgaaagggttttaccccagcgatattgctgttgagtgggaatccaatggacaacctgagaacaattataagacgacaccccctgtcctcgactctgacggcagcttctttctgtactccaaacttaccgtggataagtctcgctggcagcagggcaacgtgttcagctgctccgtcatgcatgaagccctgcacaaccattacacccagaaaagcctctctctgtcccccgggaag

SEQ ID NO: 38752 - RNA, 657 nt, synthetic construct
  misc_feature 1..657: note = derived and/or modified sequence opt5 from Lucatumumab_LightChain1
  source 1..657: mol_type = other RNA
gacatcgtgatgacccagagccccctgtccctcacagtcacgcctggcgagccggcctctattagctgcagatcctctcaaagcctgctttactccaacgggtataattacctggattggtatctccagaagcccggacagtctcctcaggttctgatcagccttggctccaaccgggctagcggggtgcccgaccgcttctctggatccggcagcgggaccgattttacactgaaaatttctagagtggaagccgaggacgtcggagtgtactattgtatgcaagcgcggcagacccctttcacatttggccccggcaccaaggttgatatccgcagaacagtggctgccccttccgtcttcatttttccgcccagcgacgaacagctcaaatctgggaccgcctccgtggtttgcctgctgaataacttctaccctcgggaggctaaggtgcagtggaaagtcgataatgccctccaaagcggaaactcccaggaatctgtgacggagcaggacagcaaggattccacctatagcctgtcttccacacttaccctgagcaaggctgactacgagaaacacaaggtgtacgcctgtgaagtcacacatcagggcctctctagccccgttaccaaatcctttaatcgcggggagtgc

SEQ ID NO: 38753 - RNA, 324 nt, synthetic construct
  misc_feature 1..324: note = derived and/or modified sequence opt5 from Lulizumab_pegol_LightChain1
  source 1..324: mol_type = other RNA
gacatccagatgacccaaagcccctcctctctgagcgcctccgtgggcgatagagtcacaattacgtgccgggcttctcgccctatctggccgttcctcgagtggtaccagcagaagcccgggaaagcccctaagctgcttatttattttaccagcagactgcggcacggagttccctcccgcttctctggcagcgggtccggaacatgttttaccctcacaatcagctctctgcagcctgaagacttcgcgacctactattgccttcaaaacgtggctaatcccgccacattttcccagggcaccaaagtggagattaagaga

SEQ ID NO: 38754 - RNA, 324 nt, synthetic construct; identical to SEQ ID NO: 38753
  misc_feature 1..324: note = derived and/or modified sequence opt5 from Lulizumab_pegol_LightChain
  source 1..324: mol_type = other RNA

SEQ ID NO: 38755 - RNA, 1194 nt, synthetic construct
  misc_feature 1..1194: note = derived and/or modified sequence opt5 from Lumiliximab_HeavyChain1
  source 1..1194: mol_type = other RNA
gaggtgcagctggtcgaaagcggcgggggactcgccaagcccggcgggtccctgagactttcttgcgctgccagcggattccggtttaccttcaacaattactatatggactgggttcgccaggcgcctggccaggggctggagtgggtgctcacaacgggatccgattcttggggccagggcgtgctggtcaccgtgagctccgcttctacaaaagggccgagcgtttttccccttgccccttccagcaagtctacctccggaggcacagccgctctggggtgtctcgtgaaagactacttccccgaacctgtcaccgtgagctggaactctggagccctgacatccggcgttcacacctttcccgctgtgctgcagagctctgggctctattccctgagctccgtcgtgacggtgccttctagctcccttggaacccaaacatacatctgcaatgtcaaccataagccgagcaataccaaagttgataagaaggtggagcccaaatcttgtgacaagacacatacctgccctccctgtcctgcccccgaactgctcggcggcccgtccgtgttcctgtttcctcccaaacctaaggatacgcttatgattagcagaacacccgaggtgacctgcgtcgttgtggacgtctctcacgaggatcccgaagtgaaattcaactggtatgttgacggggtggaggtccacaatgcgaagacaaagcctcgggaggaacagtacaacagcacctatcgcgtggtctccgtgctgaccgttctccatcaggattggctgaatggaaaagagtacaagtgtaaagtgtctaacaaggccctgccggctcccatcgaaaagacaattagcaaggccaaaggccagcctagagagccccaagtctacacgctccctccctcccgggacgaactgaccaagaatcaggtgagccttacatgcctggttaaggggttttatccgtctgatatcgctgtggagtgggaatccaacggacagcctgagaataactacaaaaccacaccccctgtcctcgacagcgatggctctttctttctgtattccaaacttaccgtggacaaaagccgctggcagcaagggaatgtgttctcctgttctgttatgcacgaggccctgcacaaccattacacgcaaaagagcctctccctgtctcccggaaaa

SEQ ID NO: 38756 - RNA, 642 nt, synthetic construct
  misc_feature 1..642: note = derived and/or modified sequence opt5 from Lumiliximab_LightChain1
  source 1..642: mol_type = other RNA
gacatccagatgacccaaagcccctcctctctgagcgcctccgtgggcgatcgggtcacaattacgtgccgggcttctcaggacatccgctactatctcaactggtaccagcagaagcctgggaaagccccgaagctgcttatttatgttgcgagctccctgcaatctggagtgcccagcagattctccggcagcgggtctggaaccgagtttacactcaccgtgtccagcctgcagcctgaagatttcgctacatactattgtcttcaggtctactctacaccccggacctttggccaggggaccaaagtggagatcaagcgcacggttgccgccccttccgtgttcatttttccccctagcgacgaacaactgaaatctggaaccgcttccgtcgtgtgcctcctgaataacttctatccgagagaggccaaggttcagtggaaggtggataatgctctgcagagcggcaactcccaggaatctgtcacagagcaagacagcaaagattccacctacagcctctcttccacactgacccttagcaaggccgactacgagaaacacaaggtgtatgcgtgtgaagtgacgcatcagggcctgtctagccccgtcacaaaatcctttaatagaggggagtgc

SEQ ID NO: 38757 - RNA, 1347 nt, synthetic construct
  misc_feature 1..1347: note = derived and/or modified sequence opt5 from Lumretuzumab_HeavyChain1
  source 1..1347: mol_type = other RNA
caggtgcaactggtccagagcggcgccgaggttaagaaacccggggcttccgtgaaggtgtcttgcaaagccagcggatacaccttcagatcctcttatatcagctgggtccggcaggcgcctggccaggggctcgaatggatgggatggatttacgctggcacagggtccccgtcttataaccaaaagctgcagggacgcgtgacgatgaccacagacaccagcacatccaccgcctacatggagcttagaagcctgcggtctgatgacacagccgtttattactgtgctcgccacagagattattactccaatagcctcacctactggggccagggcacgctggtgaccgtctcttccgccagcacaaaagggccctctgtgtttcctcttgctccctccagcaagtccacctctggaggcacagccgcgctggggtgcctcgttaaggactatttccctgaacccgtgaccgtcagctggaactccggagccctgacgagcggcgtgcatacatttcctgctgtgctgcagtcttccgggctctacagcctgtctagcgtcgttaccgtgccgtcctctagccttggaacacaaacctatatctgtaatgtgaaccacaaaccctccaataccaaggtcgataaaaaggtggagcctaaaagctgcgacaagacacatacgtgtcccccttgccccgccccggaactgctcggcggcccttctgttttcctgtttccccctaagcccaaagatacccttatgatttcccggacacccgaggtgacctgtgtcgtggttgacgtgagccacgaggatcctgaagtcaagttcaactggtacgtggacggggtcgaggtgcataatgctaaaacaaagccgcgcgaggaacagtataactctacctacagagttgtgtccgtcctgacggtgctccaccaggattggctgaatggaaaagagtataagtgcaaagttagcaacaaggccctgcccgcgcctatcgaaaagacaatttccaaagccaagggccagccccgggagcctcaagtgtacacccttcccccgtctcgcgacgaactgaccaaaaatcaggtcagccttacatgtctggtgaaggggttttacccttccgatatcgctgtggagtgggaatctaacggacagcccgagaataactataaaaccacacctcccgttctcgacagcgacggctccttctttctgtacagcaagctcacggtcgataagtctagatggcaacaggggaatgtgttctcctgcagcgtgatgcacgaggccctgcataaccactatacccagaaatctctctccctgagccctgga

SEQ ID NO: 38758 - RNA, 660 nt, synthetic construct
  misc_feature 1..660: note = derived and/or modified sequence opt5 from Lumretuzumab_LightChain1
  source 1..660: mol_type = other RNA
gacatcgtgatgacccagagccccgattccctggccgtctctctcggcgagagagctacaattaactgcaagagctcccaatctgttctgaatagcgggaaccagaaaaattaccttacgtggtatcagcagaagcctggacaaccgcccaaactgctcatctactgggcctccacccgggaatctggcgtgcctgaccgcttcagcgggtccggaagcggcacagattttaccctgacaatttcttcccttcaggcggaggacgtggctgtctattactgtcagagcgattattcttacccctataccttcgggcagggaacaaagctggaaatcaaaagaaccgtggccgccccttccgtttttatttttccccctagcgacgagcaactcaagtctggcacggcttccgtggtctgcctgctgaacaatttctacccgcgggaagccaaggtgcagtggaaagttgataacgctctccagagcggcaattcccaggagtctgtgaccgagcaagacagcaaggattccacatacagcctgtcttccacccttacactgagcaaagccgactatgaaaagcacaaagtctacgcgtgtgaggtgacccatcaggggctctctagccccgtgacgaagtccttcaaccgcggagaatgc

SEQ ID NO: 38759 - RNA, 1329 nt, synthetic construct; identical to SEQ ID NO: 38285
  misc_feature 1..1329: note = derived and/or modified sequence opt5 from Lutetium_(177Lu)_lilotomab_satetraxetan_HeavyChain1
  source 1..1329: mol_type = other RNA

SEQ ID NO: 38760 - RNA, 642 nt, synthetic construct; identical to SEQ ID NO: 38286
  misc_feature 1..642: note = derived and/or modified sequence opt5 from Lutetium_(177Lu)_lilotomab_satetraxetan_LightChain1
  source 1..642: mol_type = other RNA

SEQ ID NO: 38761 - RNA, 1350 nt, synthetic construct
  misc_feature 1..1350: note = derived and/or modified sequence opt5 from Margetuximab_HeavyChain1
  source 1..1350: mol_type = other RNA
caggtgcaactgcagcagagcggccccgagctcgtcaagcctggggcctccctgaaactttcttgcaccgctagcggattcaacatcaaggacacatacattcactgggttaaacagagaccggaacaaggcctggagtggatcgggcggatttatcccacgaatggatacacccgctatgatcctaagtttcaggacaaagccacaatcaccgcggatacatcctctaacaccgcttacctccaggtgagcagactgacatccgaagacaccgccgtgtattactgttctcggtggggcggggatggattctatgccatggactactggggccagggcgctagcgtcacggtgtccagcgcctctaccaaggggccctccgtttttcctcttgctcccagctctaagtccacaagcggaggcaccgccgcgctggggtgcctcgtgaaagattacttccctgagccggtcacagtgtcttggaactccggagccctgaccagcggcgttcatacgtttcccgctgtgctgcaatcctctgggctctatagcctgtccagcgtcgtgacagtgccttcttccagccttggaacccagacatacatttgtaatgtcaatcacaagccctctaacaccaaagttgacaagcgcgtggaacctaaaagctgcgataagacccatacatgtcccccgtgccctgcccccgagctggtgggcggcccttccgtcttcctcctgcctcccaagcccaaagacacgcttatgatctctagaaccccggaggtgacatgtgttgtggtcgatgtgagccacgaagaccccgaggttaagtttaattggtatgtggatggggtcgaagtgcataacgctaaaaccaagcctcccgaggagcagtacaattccacactgcgggtcgtgagcgttctcaccgtgctgcaccaggactggctgaacggaaaagaatataagtgcaaagtctctaataaggccctccctgcgcccatcgagaagacgatttccaaagccaagggccaaccgcgcgaacctcaggtgtacacactgccccctagcagagacgagcttaccaaaaaccaggtttctctgacctgtctcgtgaaggggttctatccctccgatatcgctgtcgaatgggagagcaatggacaacctgagaacaattacaaaacaacacccctggtgcttgactccgatggcagctttttcctgtactctaagctcaccgtggacaagtcccggtggcagcaggggaacgtcttttcttgcagcgttatgcacgaagccctgcataaccactatacgcagaaatccctgagcctctctccgggaaag

SEQ ID NO: 38762 - RNA, 642 nt, synthetic construct
  misc_feature 1..642: note = derived and/or modified sequence opt5 from Margetuximab_LightChain1
  source 1..642: mol_type = other RNA
gacatcgtgatgacccagagccacaagttcatgtccacatctgtcggcgatagagttagcattacgtgcaaagcctcccaagacgtgaacaccgctgtggcctggtaccagcagaagcccgggcattctcctaaactgctcatctatagcgcgtcctttcggtacacaggagtcccggatcgcttcaccggctctagaagcgggacagactttaccttcacaatttccagcgtgcaggctgaggatctggccgtttattactgtcaacagcactataccacgccccctacctttggaggcgggacaaaggtggaaatcaaacggaccgtcgccgctccctctgtgttcatttttcctccctccgacgagcagcttaagagcggaacagcctctgttgtgtgcctgctcaataacttctaccctcgcgaagctaaggtccagtggaaagtggataatgccctgcaatccggcaacagccaggagtctgtgaccgaacaggactccaaggatagcacgtattccctttctagcacactgaccctctccaaagcggactacgagaagcataaagtctacgcctgtgaggttacacaccagggcctgagctctccggtgaccaagtcctttaatagaggggaatgc

SEQ ID NO: 38763 - RNA, 762 nt, synthetic construct
  misc_feature 1..762: note = derived and/or modified sequence opt5 from Marzeptacog_alfa_HeavyChain1
  source 1..762: mol_type = other RNA
atcgtgggcgggaaggtctgccccaagggagagtgtccttggcaggttctgctcctggtgaacggcgcccaactttgcgggggaaccctgattaatacaatctgggtggtcagcgctgcccactgtttcgacaagattaaaaactggagaaatctcatcgcggtgctgggcgaacatgatctttccgagcacgacggggatgaacagtctcggcgcgttgctcaggtgattatcccgagcacgtacgtccccggaaccacaaaccatgacatcgccctgctcagactgcaccagcctgtggttctgaccgatcatgtggtccccctctgcctgcctgagcggacattttccgaacgcacccttgccttcgtgagattttctctggtgagcggctggggccggctcctggaccgcggggctacagcccttgagctgcaagtcctcaatgttcccagactgatgacccaggattgtctgcagcagtcccggaaggtgggagactctcctaacattacggagtatatgttctgcgctggctacagcgatgggtccaaagacagctgtaagggagattctggcgggccgcacgccacccactatcgcggaacatggtacctcaccggcatcgtgtcctggggccaagggtgcgcgacagtcggacattttggcgtgtataccagagttagccagtacattgaatggctgcagaaacttatgcggtctgagccccgccctggggtgctgctcagagcccccttccct

SEQ ID NO: 38764 - RNA, 456 nt, synthetic construct
  misc_feature 1..456: note = derived and/or modified sequence opt5 from Marzeptacog_alfa_LightChain1
  source 1..456: mol_type = other RNA
gccaacgctttcctggaggaactcagacccggcagcctggagcgggaatgcaaggaggaacagtgttcctttgaggaggcccgcgaaatcttcaaagacgcggagagaaccaagctgttttggatttcttacagcgatggggaccaatgcgcttcctctccttgtcagaatggaggcagctgcaaagatcagcttcagtcctatatctgtttctgcctcccggcctttgaagggcggaactgtgagacacacaaggacgatcaactgatttgcgtgaatgagaacggaggctgtgaacagtactgctctgaccatacggggaccaaacgcagctgtagatgccacgagggatattcccttctggccgatggcgtcagctgcaatgctacagttgaatacccctgtggcaagatccctattctcgagaagcggaacgcctctaaaccccaggggcgc

SEQ ID NO: 38765 - RNA, 669 nt, synthetic construct
  misc_feature 1..669: note = derived and/or modified sequence opt5 from Matuzumab_HeavyChain1_variant_3c08_H
  source 1..669: mol_type = other RNA
caggtgcaactggtccagagcggcgccgaggttaagaaacccggggcttccgtgaaggtgtcttgcaaagccagcggatacaccttcacatcccactggatgcattgggtcagacaggcgcctggccaggggctcgaatggatcggagagtttaacccgtctaatggccggacgaactataatgaaaagttcaaaagcaaggctaccatgacagtggacacctccacaaacaccgcctacatggagctgtctagccttcgctccgaagatacagccgtttattactgtgctagcagagactatgattacgacgggcggtattttgattactggggacaaggcaccctggtgacggtctcttccgccagcaccaagggcccctctgtgttccctctcgctccctccagcaaatctacatccgggggaaccgccgcgctgggctgccttgttaaggactactttcctgagcccgtgacagtcagctggaactccggggccctgacctctggagtgcacacgttccctgctgtgctccagagctccggcctgtatagcctgtcttccgtcgttacagtgccgagctctagcctcgggacccagacatacatttgtaatgtgaatcataaaccctccaacaccaaggtcgataaaaaggtggagcctaagtct

SEQ ID NO: 38766 - RNA, 669 nt, synthetic construct
  misc_feature 1..669: note = derived and/or modified sequence opt5 from Matuzumab_HeavyChain1_variant_3c09_C
  source 1..669: mol_type = other RNA
caggtgcaactggtccagagcggcgccgaggttaagaaacccggggcttccgtgaaggtgtcttgcaaagccagcggatacaccttcacatcccactggatgcattgggtcagacaggcgcctggccaggggctcgaatggatcggagagtttaacccgtctaatggccggacgaactataatgaaaagttcaaaagcaaggctaccatgacagtggacacctccacaaacaccgcctacatggagctgtctagccttcgctccgaagatacagccgtttattactgtgctagcagagactatgattacgccgggcggtattttgactactggggacaaggcaccctggtgacggtctcttccgctagcaccaagggcccctctgtgttccctctcgccccctccagcaaatctacatccgggggaaccgcggccctgggctgccttgttaaggattactttcctgagcccgtgacagtcagctggaactccggggctctgacctctggagtgcacacgttccctgccgtgctccagagctccggcctgtatagcctgtcttccgtcgttacagtgccgagctctagcctcgggacccagacatacatttgtaatgtgaatcataaaccctccaacaccaaggtcgacaaaaaggtggagcctaagtct

SEQ ID NO: 38767 - RNA, 636 nt, synthetic construct
  misc_feature 1..636: note = derived and/or modified sequence opt5 from Matuzumab_LightChain1_variant_3c08_L
  source 1..636: mol_type = other RNA
gacatccagatgacccaaagcccctcctctctgagcgcctccgtgggcgatcgggtcacaattacgtgctctgctagctcctctgttacctacatgtattggtaccagcagaagcctgggaaagccccgaagctcctgatctatgacacaagcaaccttgcgtccggagtgcccagccggttctctggctccgggagcggaaccgattacacatttaccatttcttccctgcagcctgaggacatcgctacatattactgtcaacagtggagctctcacattttcacctttggccaggggacgaaagtggaaatcaagcgcaccgtcgccgccccctccgtgttcatctttcctcccagcgatgagcagctcaaatccggaacagcttctgttgtgtgcctgcttaataacttctatcctagagaagccaaggtccaatggaaggtggacaatgctctgcagagcggcaactcccaggagagcgttaccgaacaggattctaaagactccacatacagcctctctagcaccctgacgctgtccaaggccgattacgagaaacataaggtgtatgcgtgtgaggtcacacaccaaggcctctctagcccggtgaccaaatcctttaatagaggggaa

SEQ ID NO: 38768 - RNA, 636 nt, synthetic construct; identical to SEQ ID NO: 38767
  misc_feature 1..636: note = derived and/or modified sequence opt5 from Matuzumab_LightChain1_variant_3c09_B
  source 1..636: mol_type = other RNA

SEQ ID NO: 38769 - RNA, 1341 nt, synthetic construct
  misc_feature 1..1341: note = derived and/or modified sequence opt5 from Mavrilimumab_HeavyChain1
  source 1..1341: mol_type = other RNA
caggtgcagctggtccagagcggcgccgaggttaagaaacccggggcttccgtgaaggtgtcttgcaaagtcagcggatacaccctcacagaactgtccatccactgggtgagacaggcccctggcaaggggcttgagtggatgggaggcttcgacccggaagagaacgaaattgtttatgcgcagcggtttcaagggcgcgtgacgatgaccgaggatacatctaccgacacagcttacatggagctgagctccctcagatctgaagataccgccgtctattactgtgccatcgtgggatccttcagccccctgacacttggcctgtggggccaggggaccatggttacggtgagctctgcttccaccaaaggacctagcgtctttcccctcgccccttgctctcggtccacaagcgagtctaccgctgccctgggctgtctggtgaaggactatttccccgaacctgtgacagtctcctggaatagcggggcgctcacctccggagttcatacgtttccggccgtgctgcagtctagcggcctttactccctgagctctgtggtcacagtgccctccagctctctcgggaccaagacatatacctgcaacgttgatcacaaacctagcaataccaaggtggacaaacgcgtcgagtccaagtacggacccccttgtccctcttgcccggctcctgagttcctgggcggccccagcgtgtttcttttccctcccaaacccaaggatacactgatgatttccagaacgcctgaagttacctgtgtggtcgtggacgtcagccaggaggatccggaagtgcaatttaactggtacgttgacggggtggaggtccataatgccaagacaaaaccccgggaggaacagttcaactctacctatcgcgtggtttccgtgctcacagtcctgcaccaggattggctgaatggaaaggagtacaaatgcaaggtgagcaacaaaggcctcccttcttccatcgaaaagaccattagcaaagctaaggggcagcccagagagcctcaagtgtatacgctgcccccgtcccaggaagagatgacaaagaatcaggtttctcttacctgtctggtcaaaggattttaccctagcgacatcgccgtggaatgggagtccaacggccaacccgagaataactataagaccacacctcccgtgctcgattctgacgggagcttctttctgtactcccggcttaccgtcgacaaaagccgctggcaggaaggaaatgtgttctcttgctccgttatgcatgaggcgctgcacaaccactatacacaaaagagcctctctctgtccctgggcaaa

SEQ ID NO: 38770 - RNA, 651 nt, synthetic construct
  misc_feature 1..651: note = derived and/or modified sequence opt5 from Mavrilimumab_LightChain1
  source 1..651: mol_type = other RNA
cagagcgtgctgacccaacccccttccgtctctggcgccccggggcagagagttacaatcagctgcacgggatccggctctaacattggggctccctacgacgtgagctggtatcagcagctccctggaaccgcccccaagctgcttatctaccacaataacaaacggccttccggcgtgcccgatcgcttctctgggagcaagtccggaacaagcgcgtctctggctattaccggcctccaagccgaggacgaagccgattattactgtgctacagtcgaggccggcctgtccgggagcgtgtttggaggcgggaccaaacttacagttctgggacagcctaaggctgccccgtctgtgaccctctttcccccttccagcgaggaactgcaggcgaataaagccacgctggtctgcctcatctctgacttctatcccggcgctgtgaccgttgcctggaaggctgattccagccctgtgaaggccggggtcgaaacaaccacaccctccaaacagtctaacaataagtacgcggccagctcctatctgagccttaccccggagcaatggaaatctcatagatcctacagctgtcaggtgacgcacgagggatctacagtggaaaagaccgtcgctcctacagagtgcagc

SEQ ID NO: 38771 - RNA, 1359 nt, synthetic construct
  misc_feature 1..1359: note = derived and/or modified sequence opt5 from MDX-1303_HeavyChain1
  source 1..1359: mol_type = other RNA
caggtgcaactggtcgagagcggcgggggagttgtgcagcccggcagatccctccggctgtcttgcgccgctagcgggttcaccttttcctactatggaatgcactgggtgcgccaggcccctggcaaggggcttgaatgggtcgcggtgatctggcatgacgagtctattgtttactatgctgatagcgtgaaaggaagattcacaatctcccgggacaactctaagaatacgctgtacctccagatgaacagcctgcgcgccgaagataccgccgtctattactgtacaagagacccgggcgatccctattactactattacggccttgacgtgtgggggcaaggaaccacagttaccgtgtccagcgcttctacaaaaggcccttccgtctttcccctggcccctagctctaagtccaccagcgggggaacggctgccctcggctgcctggtgaaagattatttccccgagcctgtgaccgtctcttggaactccggggcgctgacaagcggagttcacacctttccggccgtgctccagtcctctggcctgtacagcctttccagcgtggtcacagtgccctcttccagcctgggcacccagacgtatatttgtaatgttaatcataagccttctaacacaaaggtggacaaacgggtcgaacccaagagctgcgataaaacccacacatgtcctccctgcccggctcctgagctccttgggggaccctccgtgttcctgtttcctcccaagcccaaagacaccctgatgatctctcgcacccctgaggttacatgtgtggtcgtggatgtcagccatgaagacccggaggtgaagttcaattggtacgttgatggcgtggaagtccacaacgccaagacgaaacccagagaggagcagtataattccacctaccgggtggttagcgtgctcacagtcctgcaccaagactggctgaacgggaaggaatacaaatgcaaggtgtctaataaagctctccctgcccccattgagaagaccatctccaaagcgaagggacagcctcgcgaaccccaggtgtatacactgccgcctagcagagaggaaatgaccaagaaccaggtttctcttacgtgtctggtcaaaggcttttacccctccgacatcgccgtggagtgggagagcaatgggcaacctgaaaacaattataagacaacaccccctgtgctcgattccgacggatctttctttctgtacagcaaacttaccgtcgataagtcccggtggcagcagggcaacgtgttctcttgcagcgttatgcatgaggctctgcacaaccattatacccaaaaatccctcagcctgtctcccggcaag

SEQ ID NO: 38772 - RNA, 645 nt, synthetic construct
  misc_feature 1..645: note = derived and/or modified sequence opt5 from MDX-1303_LightChain1
  source 1..645: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttccatgtacacctttggccagggcacaaaactcgagatcaagagaaccgtggctgcccctagcgtgttcatttttcccccttctgatgaacagctgaaatccgggacggctagcgtcgtgtgcctgctcaacaatttctatccgcgggaggccaaggttcaatggaaagtggacaacgcgctgcagtccggaaattctcaggagagcgtcaccgaacaggattccaaggacagcacatactctctttccagcaccctgacactctctaaggccgattacgagaaacacaaggtgtatgcttgtgaagttacccatcaaggcctgagctcccccgtgacgaaatcttttaaccgcggggagtgc

SEQ ID NO: 38773 - RNA, 1347 nt, synthetic construct
  misc_feature 1..1347: note = derived and/or modified sequence opt5 from Mepolizumab_HeavyChain1
  source 1..1347: mol_type = other RNA
caggtgaccctgagagagagcggccccgccctcgtcaagcctacacaaacgctgacccttacatgcaccgtttccgggttctctctgacaagctactccgtgcactgggtgcggcagccgcccggaaaaggcctcgaatggctgggggtcatctgggcttctggaggcaccgactataacagcgcccttatgtcccgcctgtctattagcaaggatacatccagaaatcaggtggttctcaccatgacgaacatggaccctgtggataccgcgacatactattgtgctcgggatccccctagctctctgctgcgcctcgactactgggggagaggaacccccgtcacagtgtccagcgcctctaccaaaggcccttccgtttttccgctggcccccagctctaagtccacgagcggcgggacagctgcccttggatgcctggtgaaagactatttccctgagcccgtcaccgtgtcctggaactctggcgctctcacaagcggggtgcatacctttcctgccgtcctgcagtccagcggactttactctctgtccagcgttgtgaccgtgccctctagctccctcggcacacaaacgtatatctgtaatgtcaatcacaagccgtctaacaccaaggtggataaacgggttgaacctaagagctgcgacaaaacacatacctgtcccccttgccccgcgcccgagctgctcgggggaccttccgtgttcctgtttccgcccaagcctaaagatacactgatgattagccgcacccccgaagtcacgtgtgtggttgtggacgtctctcacgaggatcctgaggtgaagttcaattggtacgtcgacggcgtggaagttcataacgccaagacaaaacccagagaggaacagtacaattccacctatcgggtggtcagcgtgcttaccgttctgcaccaggattggctcaacggcaaggagtacaaatgcaaggtgtctaataaagctctgccggcccctatcgagaagacaatttccaaagctaaggggcagccccgcgaacctcaagtctatacccttccccctagcagagaggaaatgacaaagaaccaggtgtccctgacgtgtctcgtgaaaggattttacccctctgacatcgccgttgagtgggaaagcaatggccagccggagaacaattataagaccacacctcccgtcctggactccgatgggtctttctttctgtacagcaaactcaccgtggacaagtcccggtggcagcaaggaaacgtgttcagctgctctgtcatgcacgaggcgctgcataaccactatacacagaaatcccttagcctgtctcccggcaag

SEQ ID NO: 38774 - RNA, 660 nt, synthetic construct
  misc_feature 1..660: note = derived and/or modified sequence opt5 from Mepolizumab_LightChain1
  source 1..660: mol_type = other RNA
gacatcgtgatgacccagagccccgattccctggccgtctctctcggcgagagagctacaattaactgcaagagctcccaatctctgcttaatagcgggaaccagaaaaattacctggcctggtatcagcagaagcctggacaaccgcccaaactcctgatctacggcgcgtccacgcgggaatctggggttcctgaccgcttcagcggatccggcagcgggaccgattttacacttaccatttcttccctgcaggctgaggacgtggccgtgtattactgtcagaacgtccacagcttcccctttacattcggaggcggcaccaagctcgaaatcaaaagaacagtggccgctccttctgtttttatttttcccccttccgatgagcagctcaagagcgggaccgcctctgtggtctgcctgctgaataacttctatccgcgggaagctaaggtgcaatggaaagttgacaatgccctgcagtccggaaacagccaggagtccgtgacggagcaggattctaaggacagcacctactcccttagctctacactgaccctctccaaagcggattatgaaaagcataaagtctacgcctgtgaggtgacacaccaaggcctgagctctcccgtgaccaagagcttcaatcgcggggaatgc

SEQ ID NO: 38775 - RNA, 1350 nt, synthetic construct
  misc_feature 1..1350: note = derived and/or modified sequence opt5 from Metelimumab_HeavyChain1
  source 1..1350: mol_type = other RNA
gaggtgcagctggtcgaaagcggcgggggagttgtgcaacccggcagatccctccggctgtcttgcgccgctagcgggttcaccttttcctcttacggaatgcactgggtgcgccaggcccctggcaaggagcttgaatgggtcgcggtgatcagctatgacgggtccattaaatactatgctgattctgttaagggaagattcacaatcagccgggacaactccaaaaatacgctgtacctccagatgaacagcctgcgcgccgaggataccgccgtgtattactgtgctagaacaggcgaatattctggctacgacaccgatccgcagtactcctgggggcaaggaacaaccgtcacagtgagctctgcctccaccaagggccccagcgtttttcctcttgctccctgctctcggtccacgagcgagtccaccgccgcgctggggtgtctcgtgaaagactatttccctgagcccgtcacagtgtcttggaatagcggagccctgacctccggcgtgcatacatttcctgctgtcctgcagagctctgggctctactccctgagctctgttgtgaccgtgccgagctcctctcttggaacgaagacatatacctgcaacgtcgatcacaagcccagcaatacaaaagtggacaagcgcgttgaatccaaatacggccctccctgtcctagctgccccgccccggagttcctgggcgggccttctgtgtttctctttccccctaagcccaaacccaccctgatgatttccagaacccctgaagtcacatgtgtggttgtggatgtcagccaggaggacccggaggtgcagttcaactggtatgtcgatggagtggaagttcataatgctaagacgaagccccgggaggaacaattcaactctacctaccgcgtggtctccgtgcttacagttctgcaccaggactggctcaatggcaaagagtataagtgcaaagtgagcaacaaggggctgccttcctctatcgagaaaaccattagcaaggccaaaggacagcccagagaacctcaggtctacacactgcccccgtcccaagaggaaatgaccaagaatcaggtgtctctcacgtgtctggtgaagggcttttaccctagcgatatcgcggttgagtgggaatccaacgggcagcccgagaataactataaaacaacccctcccgtccttgacagcgacggatctttctttctgtactcccggctcaccgtggataagagccgctggcaagaaggcaatgtgttctcttgctccgtcatgcatgaggccctgcacaaccactatacacagaaaagcctttctctgagcctcggcaag

SEQ ID NO: 38776 - RNA, 639 nt, synthetic construct
  misc_feature 1..639: note = derived and/or modified sequence opt5 from Metelimumab_LightChain1
  source 1..639: mol_type = other RNA
gagatcgtgctgacccagagcccctcctctctcagcgcctccgtcggcgacagagttacaattacgtgccgggcttctcaagggatcggagatgacctgggctggtaccagcagaagcctgggaaagccccgattcttctgatctatggaaccagcacactccagtccggcgtgccctctcgcttcagcgggtccggaagcggcaccgattttacactgaccattaactctcttcaacctgaagacttcgcgacatactattgtctgcaggattccaattaccccctcacctttggcgggggaacgagactggagatcaagcggaccgtggctgcccctagcgtcttcatctttcccccttctgacgaacagctgaaatccggcacagccagcgtggtttgcctcctgaacaatttctatccgcgcgaggctaaggtgcagtggaaagtcgataacgcccttcaatctgggaatagccaggaaagcgtgaccgagcaggactccaaggattctacatacagcctgtccagcaccctcacgctgtctaaggctgactatgagaaacacaaggtttacgcctgtgaagtgacacatcagggactttcccccgtcaccaaatcctttaacagaggcgagtgc

SEQ ID NO: 38777 - RNA, 1350 nt, synthetic construct
  misc_feature 1..1350: note = derived and/or modified sequence opt5 from Milatuzumab_HeavyChain1
  source 1..1350: mol_type = other RNA
caggtgcaactgcagcagagcggctccgagctcaagaaacccggggcttctgtcaaggttagctgcaaggcttccggatacaccttcacaaactatggcgtgaattggatcaaacaggcccctgggcaaggactgcagtggatgggctggattaacccgaatacgggggaacccacctttgacgatgacttcaaaggaagatttgcgttctctcttgatacaagcgtgtccaccgcttacctgcagatctctagcctcaaggccgacgatacagccgtctatttttgttcccggagccgcggcaagaacgaggcttggttcgcctactggggccaggggaccctggtgacagtttcttccgctagcaccaaaggaccttctgtgtttccccttgccccttccagcaagtctacgtccggcgggaccgcggccctgggatgcctcgtcaaagactatttccccgaacctgtgacagttagctggaactccggcgctctgacctctggggtgcacacatttccggccgtcctgcaaagctccggactctacagcctgtcttccgtggtgaccgtccccagctctagccttggcacgcagacatatatttgtaatgttaatcataagccttccaacaccaaagtggataagagagtggagcccaagtcttgcgacaaaacacacacctgtcctccctgcccggctcctgaactgctcggcgggcccagcgtcttcctgtttcctcccaagcccaaagatacccttatgatctcccggacacctgaggtgacgtgtgttgtggtcgacgtgagccatgaggatccggaagttaagttcaattggtacgtggacggagtcgaggtgcacaacgccaaaaccaagccccgcgaggaacagtacaattctacatatagagtcgtgtccgttctgaccgtgctccatcaggattggctgaacggcaaagagtacaagtgcaaggtcagcaataaagcgctgcctgcccccattgaaaagacaatctctaaagctaaggggcaacctcgggagccccaggtgtataccctcccgccttcccgcgaagagatgacgaaaaaccaggttagcctgacatgtcttgtgaagggattttacccctccgacatcgccgtcgaatgggagtctaatggccaacctgagaacaactataagaccacaccccctgtgctggacagcgatgggtccttcttcctctactctaaactgaccgtggacaagagcagatggcagcagggaaatgtcttttcctgcagcgttatgcacgaagcccttcacaaccattatacccagaaatctctgtccctcagccccggcaag

SEQ ID NO: 38778 - RNA, 657 nt, synthetic construct
  misc_feature 1..657: note = derived and/or modified sequence opt5 from Milatuzumab_LightChain1
  source 1..657: mol_type = other RNA
gacatccagctgacccaaagccccctctccctgcctgtgacacttggccagccggcctctattagctgcagatcctctcagagcctggtccaccggaacgggaatacgtacctccattggttccagcaacgccccggacagtcccctagactgcttatctataccgtttctaaccggtttagcggcgtgcccgatcgcttctccgggagcggatctggcacagactttaccctgaagatttccagagtggaggctgaagatgtcggggtgtacttctgtagccagtcttcccacgttcctcccacatttggagccggcacccggctcgagatcaaacgcacagtggcggctcctagcgtcttcatttttccgccctctgacgaacagctgaagtccggcaccgccagcgtggtttgcctgctcaataacttctatcctagagaggccaaagtgcaatggaaggtcgataatgctctgcagtccgggaactctcaggaaagcgtgacggagcaggactccaaagatagcacctactctctttccagcacactgaccctctctaaggccgactatgagaagcataaagtgtacgcttgtgaagtcacacaccaaggactgagctcccccgttaccaagtcttttaatcggggcgagtgc

SEQ ID NO: 38779 - RNA, 1341 nt, synthetic construct
  misc_feature 1..1341: note = derived and/or modified sequence opt5 from Mirvetuximab_HeavyChain1
  source 1..1341: mol_type = other RNA
caggtgcaactggtccagagcggcgctgaggttgtgaagcccggggcttccgtgaaaatctcttgcaaggccagcggatacaccttcacaggctattttatgaactgggtcaaacagtcccctgggcagtctctcgaatggattggaagaatccacccgtacgacggcgatacgttctataatcaaaagtttcaggggaaagcgaccctgacagtggacaagagctccaacaccgctcatatggagcttctgtctctcacaagcgaagatttcgccgtttactattgtacccggtacgacggatcccgcgccatggattattggggccagggcacaaccgtgacggtcagctctgcttccaccaaggggcccagcgtgtttcctctggccccctcttccaaaagcacatctggaggcaccgctgcccttgggtgcctggttaaggactacttccctgagcccgtgacagtctcctggaatagcggagcgctcacctccggcgtgcacacgtttcctgccgtgctgcagtctagcgggctgtactccctcagctctgtcgttacagtgccgtccagctctctgggaacccaaacatatatttgtaacgtgaatcataaacccagcaacaccaaggtcgataaaaaggtggaacctaagtcctgcgacaaaacccacacatgtcccccttgccccgctccggagcttctgggcggcccttctgttttcctctttccccctaagcccaaagatacgctgatgatcagcagaacccccgaggtgacatgtgtcgtggttgacgtgtcccatgaagatcctgaggtcaagttcaattggtacgtggacggggtcgaagtgcacaacgccaaaaccaagccgcgggaggagcagtataatagcacataccgcgttgtgtctgtccttaccgtgctgcaccaggattggctcaacggaaaagaatataagtgcaaggtttccaataaagctctgcccgcccctattgagaagacgatcagcaaagcgaagggccagcccagagaacctcaagtgtacacactgcccccgtctcgggacgagctcaccaaaaaccaggtctccctgacctgtcttgtgaaggggttttatcctagcgacatcgccgtggaatgggagtccaatggacagcccgagaacaattacaagacaacccctcccgttctggattctgacggcagcttctttctctactccaaactgacagtcgataagtctcgctggcaacaggggaacgtgttcagctgctccgtgatgcatgaagcccttcacaaccattatacgcagaaaagcctgtctctctcccctgga

SEQ ID NO: 38780 - RNA, 654 nt, synthetic construct
  misc_feature 1..654: note = derived and/or modified sequence opt5 from Mirvetuximab_LightChain1
  source 1..654: mol_type = other RNA
gacatcgtgctgacccagagccccctctccctggccgtctctcttggccaacctgctattatcagctgcaaggcctcccagtctgttagcttcgcggggacatccctgatgcactggtaccatcagaaaccgggacagcaacccagactcctgatttatcgggcttctaaccttgaggccggcgtgcctgatcgctttagcgggtccggaagcaagacggacttcaccctgacaatctctcccgtggaagccgaggatgctgccacctactattgtcagcagtccagagaatacccttatacatttggcgggggaaccaaactcgagattaagcggacagtcgctgcccccagcgtgttcatctttcctccgtctgacgaacagctgaaatccggcaccgcgagcgttgtgtgcctgctcaataacttctacccccgcgaggccaaggtccaatggaaggtggataatgctctgcagtctggcaactcccaggagagcgttacggaacaggactccaaagattctacctatagcctttccagcacactgaccctctctaaggccgactacgagaaacacaaggtgtacgcttgtgaagtcacacatcaagggctgtccagccctgtgaccaaatcttttaatagaggagagtgc

SEQ ID NO: 38781 - RNA, 1344 nt, synthetic construct
  misc_feature 1..1344: note = derived and/or modified sequence opt5 from Modotuximab_HeavyChain1
  source 1..1344: mol_type = other RNA
caggtgcaactgcagcagcccggcgccgagctcgtcgaacctgggggaagcgttaagctgtcctgcaaggcttctggctacaccttcacaagccactggatgcattgggtgaaacagagaccggggcaaggacttgagtggatcggcgaaattaacccctcctctgggcggaataactataatgagaaatttaagagcaaagccacgctgaccgtggacaagtcctctagcacagcgtacatgcagttctccagcctcacctctgaagattccgctgtctattactgtgtgcgctattacggatatgacgaggccatggattactggggccagggcacaagcgttaccgtgtcttccgccagcacaaaggggccttctgtctttcccctggctccttccagcaaatccacctctggaggcacggccgctcttgggtgcctggtgaaggactacttccccgagcctgttaccgtgagctggaactccggagccctcacaagcggcgtccacacctttccggcggtgctgcagtcttccgggctgtatagcctctctagcgtggtcacagttccctcctctagcctgggaacccaaacgtacatctgtaatgtgaaccataaaccttccaatacaaaggtggataaaagagtcgaacccaagagctgcgacaagacccacacatgtcctccctgcccggcccctgagcttctgggcggcccctctgtgttcctctttcctcccaaacccaaggataccctgatgatttcccggacccctgaagttacatgtgtggtcgtggacgttagccatgaggatccggaggtgaaattcaactggtatgtcgacggggtggaagtccacaatgctaagacgaaaccccgcgaggaacagtacaactctacctatagagtggtttccgtgcttacagtcctgcaccaggattggctcaatggaaaggagtacaaatgcaaggtgagcaacaaggccctgcctgctcccatcgagaaaaccatttccaaggccaaaggccagcctcgggaaccccaagtttatacactgccgccttctcgcgaggaaatgaccaagaatcaggtgagcctcacgtgtctggtcaaagggttttacccctccgacatcgcggtggagtgggaatctaacggacagcctgagaataactacaagacaacaccccctgtgcttgatagcgacggctccttctttctgtatagcaagctcaccgttgacaaatctagatggcaacaggggaacgtcttctcctgcagcgtgatgcatgaagccctgcacaatcattacacccagaagtctctttccctgagccccgga

SEQ ID NO: 38782 - RNA, 657 nt, synthetic construct
  misc_feature 1..657: note = derived and/or modified sequence opt5 from Modotuximab_LightChain1
  source 1..657: mol_type = other RNA
gacatcgtgatgacccaggccgctttcagcaaccccgtcacactgggcacgtccgcctctattagctgcagatcctctaagagcctcctgcactccaatgggatcacctacctttattggtacctgcaaaaacctggacagtctccgcagctcctgatttatcagatgagcaaccttgcgtccggcgttcccgatcggttttcctcttccgggagcggaacagacttcaccctgcgcatctctagagtggaggctgaagatgtgggcgtctactattgtgcccaaaatctcgagctgccttacacatttgggggaggcaccaagctggaaattaaacggacagtggccgctccctccgttttcatctttcctcccagcgacgagcagctcaagtctggcaccgcctccgtggtctgcctgcttaacaatttctatcctcgcgaagctaaagtgcagtggaaggttgataacgccctgcagagcgggaatagccaagagtctgtgacggagcaggacagcaaggattccacctacagcctctcttccacactgacccttagcaaagcggactacgaaaagcataaagtctatgcctgtgaggtgacacaccagggactgtctagcccggtgaccaagtcctttaacagaggcgaatgc

SEQ ID NO: 38783 - RNA, 1347 nt, synthetic construct
  misc_feature 1..1347: note = derived and/or modified sequence opt5 from Mogamulizumab_HeavyChain1
  source 1..1347: mol_type = other RNA
gaggtgcagctggtcgaaagcggcggggacctcgttcaacccggaagatccctgcggctttcttgcgccgctagcggcttcatcttttccaactacgggatgtcttgggtgcgccaggcccctggaaagggcctggagtgggtggcgaccattagctccgcttctacatatagctactatccggattccgtcaaagggagattcacgatcagccgggacaatgccaagaactctctctacctgcagatgaactcccttcgcgtggaagataccgccctgtattactgtggaagacacagcgacggcaattttgctttcggctattgggggcagggaacactcgttaccgtgtcttccgccagcacaaaaggcccctctgtctttcctctggctccctccagcaagtccacctctgggggaacagccgcgctgggctgcctcgtgaaagattacttccctgagcccgttaccgtgagctggaactccggggccctgacgagcggagtccatacctttcctgctgtgcttcaatcttccggcctgtacagcctctctagcgtggtcacagttccgtcctctagcctgggcacccagacatatatttgtaatgtgaatcacaagccctccaacaccaaggtggacaaaaaggtcgaacctaaaagctgcgataagacgcatacatgtcccccttgccccgccccggagcttctcgggggaccttctgtgttcctgtttccccctaaacccaaggacaccctgatgatctcccggacacccgaggttacctgtgtggtcgtggatgttagccacgaagaccctgaggtgaagttcaattggtacgtcgatggcgtggaagtccataacgctaaaaccaagccgcgcgaggagcagtataattctacatacagagtggtttccgtgctgacggtcctccaccaggactggctgaacgggaaagaatataagtgcaaagtgagcaataaggcccttcccgcgcctattgagaaaaccatctccaaggccaagggacaaccccgggaacctcaggtttacacactgcccccgtctcgcgatgagctcaccaaaaaccaggtgagcctgacatgtcttgtcaagggcttttatccttccgacatcgctgtggaatgggagtctaatgggcagcccgagaacaactacaaaaccacgcctcccgtgctggacagcgatggatccttctttctctacagcaagctgacagttgacaaatctagatggcaacagggcaatgtcttctcctgcagcgtgatgcacgaagccctgcataaccactatacccagaagtctctctccctgagccctggcaag

SEQ ID NO: 38784 - RNA, 657 nt, synthetic construct
  misc_feature 1..657: note = derived and/or modified sequence opt5 from Mogamulizumab_LightChain1
  source 1..657: mol_type = other RNA
gacgtgctgatgacccagagccccctctccctgcctgtcacaccgggcgagcccgcctctatcagctgccggtcctctcggaacattgttcacatcaatggggatacgtaccttgaatggtatctgcaaaagcctggacagagcccccagctcctgatttacaaagtgtccaaccgcttctctggcgtgcctgacagatttagcgggtccggaagcggcaccgatttcacacttaagatctctcgggtcgaggctgaagacgtgggggtttattactgttttcagggatccctgctcccctggaccttcggccaaggcacaaaagtggagattaagcgcaccgtcgccgcgcctagcgtgtttatcttcccgccctctgatgaacagctgaaatccgggacagctagcgttgtgtgcctgctcaataacttttatcctagagaggccaaggtccagtggaaggtggacaatgccctgcagtctggaaactcccaagagagcgtgaccgaacaggattccaaagactctacgtacagcctttccagcaccctgacactctctaaggctgattatgagaaacataaggtctacgcctgtgaagttacccaccagggcctgtccagccccgtgacaaaatctttcaatagaggggagtgc

SEQ ID NO: 38785 - RNA, 1356 nt, synthetic construct
  misc_feature 1..1356: note = derived and/or modified sequence opt5 from Monalizumab_HeavyChain1
  source 1..1356: mol_type = other RNA
caggtgcaactggtccagagcggcgccgaggttaagaaacccggggcttccgtgaaggtgtcttgcaaagccagcggatacaccttcacatcctattggatgaactgggtcagacaggcgcctggccaggggctcgaatggatgggacggatcgacccgtacgattctgagacgcactatgctcaaaagctgcagggccgcgtgaccatgacaaccgacacaagcacctccacagcctacatggaacttagatctctgcggagcgatgacaccgccgtttattactgtgctcgcgggggatatgattttgacgtgggcacgctctactggttctttgatgtctggggccaggggaccacagtgaccgtttccagcgcctctacaaaaggaccctccgtgttccctctggctccctgcagcagatctacctccgagagcacggccgcgcttggctgtctggtcaaggactactttcctgaacccgtgacagtgtcttggaactccggggccctcaccagcggagtccatacattccctgctgttctgcagtcctctggcctgtatagcctctccagcgtggtgaccgtcccgtcttccagcctggggaccaagacatacacgtgcaatgtggatcacaaaccctctaataccaaggttgacaaacgggtggagagcaagtatggacctccctgtcctccctgcccggcccctgagtttcttggcggcccctccgtcttcctgtttcctcccaaacccaaggatacactcatgatttctcgcacccctgaagtgacatgtgttgtggtcgacgtgagccaagaggatccggaagtccagttcaactggtacgtggacggggttgaggtgcataatgctaagaccaaacccagagaggaacagtttaactccacgtatcgggtcgtgagcgttctgacagtgcttcaccaggactggctgaatggaaaggagtacaaatgcaaggtctctaacaaaggcctcccttccagcatcgaaaagaccatttctaaagccaaggggcaaccccgcgagcctcaggtgtataccctgcccccgtcccaggaagagatgacaaagaatcaagtgagcctgacctgtctcgttaaaggattctacccttccgatatcgcggtcgagtgggaatctaacggccagcccgagaataactacaagacaacgcctcccgtgctggacagcgatgggtcctttttcctttattctagactgaccgtggacaaaagccggtggcaggaaggaaatgtcttctcctgcagcgtgatgcatgaggccctccacaaccactacacacagaagtctctgtcccttagcctgggcaaa

SEQ ID NO: 38786 - RNA, 642 nt, synthetic construct
  misc_feature 1..642: note = derived and/or modified sequence opt5 from Monalizumab_LightChain1
  source 1..642: mol_type = other RNA
gacatccagatgacccaaagcccctcctctctgagcgcctccgtgggcgatagagtcacaattacgtgccgggcttctgagaacatctacagctatctcgcctggtaccagcagaagcctgggaaagcgccgaagctgcttatttataatgctaaaaccctggccgaaggagttccctcccgcttctctggcagcgggtccggaacagactttaccctcacaatcagctctctgcagcctgaggatttcgccacctactattgtcaacaccattacggcacacccagaacctttgggggaggcacgaaggtggaaattaaacggaccgtggctgccccttccgtcttcatctttccccctagcgacgagcagcttaagtctggcacagcttccgtggtttgcctgctcaacaatttctatccgcgcgaagccaaggtgcagtggaaagtcgataacgcgctgcagagcggaaattctcaagagtccgtgaccgagcaggacagcaaggattccacatactctctgagctccaccctcacgctgagcaaagccgactacgaaaagcacaaagtttatgcttgtgaggtgacacatcaggggctttcttcccccgtcaccaagagctttaacagaggcgaatgc

SEQ ID NO: 38787 - RNA, 1350 nt, synthetic construct
  misc_feature 1..1350: note = derived and/or modified sequence opt5 from Motavizumab_HeavyChain
  source 1..1350: mol_type = other RNA
caggtgaccctgagagagagcggccccgccctcgtcaagcctacacaaacgctgacccttacatgcaccttctccgggttttctctgagcacagctggaatgtccgttggctggatccggcagccgcccgggaaagccctcgaatggctggcggacatttggtgggatgacaagaaacactacaacccttctcttaaggatcgcctgaccatcagcaaagacacatccaagaatcaggtggtgctcaaggtcaccaacatggatcccgctgacacggccacctattactgtgccagagatatgattttcaatttttatttcgacgtgtggggacagggcacaaccgttacagtgtctagcgcttccaccaaagggcctagcgtctttcccctggccccttcttccaagagcacgtctggaggcacagctgccctgggctgcctcgtgaaagattacttcccggagcccgttaccgtgtcctggaacagcggggcgctgacatctggagtccatacctttcctgccgtgcttcaatccagcggcctgtattccctctctagcgtggtcaccgttccctccagctctctggggacacagacgtacatctgtaatgtgaaccacaagccttccaataccaaagtggacaagcgggtcgaacccaagagctgcgataaaacacatacctgtccgccttgccccgctcctgagcttctgggaggcccctctgtgttcctctttccccctaagccgaaagacacactgatgattagccgcacccccgaagttacgtgtgtggtcgtggatgtttcccacgaggaccctgaggtgaagttcaactggtatgtcgacggggtggaagtccataatgccaaaacaaagcccagagaggaacagtacaactctacctaccgggtggttagcgtgctgaccgtcctccaccaggattggctgaatggaaaagagtataagtgcaaggtgtccaacaaagcccttcctgctcccatcgagaagacaatcagcaaagcgaagggccaaccgcgcgaacctcaggtttacaccctgcccccttctagagaggaaatgacgaaaaatcaggtgtccctcacatgtctggtcaagggcttttatcccagcgacattgccgtggagtgggaatctaacgggcagcctgagaataactacaagaccacacccccggtgcttgattccgacggcagcttctttctgtattccaaactcaccgttgataagtctcggtggcaacagggaaacgtcttcagctgctccgtgatgcacgaggctctgcataatcactacacacagaaatctctgagcctctcccctgggaag

SEQ ID NO: 38788 - RNA, 1350 nt, synthetic construct; identical to SEQ ID NO: 38787
  misc_feature 1..1350: note = derived and/or modified sequence opt5 from Motavizumab_HeavyChain_variant
  source 1..1350: mol_type = other RNA

SEQ ID NO: 38789 - RNA, 639 nt, synthetic construct
  misc_feature 1..639: note = derived and/or modified sequence opt5 from Motavizumab_LightChain
  source 1..639: mol_type = other RNA
gacatccagatgacccaaagcccctccacactgtctgccagcgtgggcgatagagtcacgattacctgctccgcttctagccgggttgggtacatgcactggtatcagcagaagcctggaaaagccccgaagctcctgatctacgacacatccaaacttgcgtctggcgtgcccagccgcttctccgggagcggatctggcaccgagtttacactgaccatttccagcctccagcctgatgacttcgctacatattactgttttcaagggtctggatatcccttcacctttggcggcgggacgaaggtggaaatcaaaagaaccgtcgccgccccttccgtgttcatttttccccctagcgatgagcagctgaagtctggaacagcttccgttgtgtgccttctgaacaatttctacccgcgggaagccaaggtccagtggaaagtggacaacgctctccagagcggcaattcccaagagtctgttaccgaacaggatagcaaggactccacatatagcctgtcttccaccctgacgctcagcaaagccgattacgagaagcataaagtgtacgcgtgtgaggtcacacaccaggggctgtctagccccgtgaccaagtcctttaaccgcggagaatgc

SEQ ID NO: 38790 - RNA, 639 nt, synthetic construct; identical to SEQ ID NO: 38789
  misc_feature 1..639: note = derived and/or modified sequence opt5 from Motavizumab_LightChain_variant
  source 1..639: mol_type = other RNA

SEQ ID NO: 38791 - RNA, 1428 nt, synthetic construct
  misc_feature 1..1428: note = derived and/or modified sequence opt5 from Moxetumomab_pasudotox_HeavyChain1
  source 1..1428: mol_type = other RNA
atggaggtgcagctggtcgaaagcggcgggggactcgttaagcccggcgggtccctgaaactttcttgcgccgctagcggattcgccttttccatctacgacatgtcttgggtgagacaaacccctgagaagtgtctggaatgggtggcgtatattagctccggcgggggaacaacgtactatccggataccgtcaaaggccggttcacaatctctcgcgacaacgctaagaataccctctacctgcagatgagctcccttaaaagcgaggatacagccatgtattactgcgccagacactctggctatgggacccattggggagtgctgtttgcttactggggccaggggacactcgttaccgtgtccgccaaggctagcggaggccccgaagggggatctctggccgcgctgacggcccaccaggcttgtcatctccctctggagaccttcacacggcaccgccaacccagaggctgggagcagcttgaacagtgcggctaccctgtccagcggctggtggccctctatctggctgcccgcctttcctggaaccaagttgaccaggtgattagaaatgcgctggccagccccgggtctggaggcgatctcggggaggctatccgggaacagcctgagcaggcccgcctggctctgaccctcgccgccgctgagtccgaaagatttgtccggcaaggaacaggcaacgacgaggcgggggccgctaatggaccggccgatagcggcgacgccctgcttgaacgcaactaccccaccggcgctgagttcctgggggatggaggcgacgtgtccttttctacgagagggacacagaattggaccgtggaacggctcctgcaggcccatcgccaacttgaggagagaggatatgtcttcgttggctaccacgggacatttctggaagcggctcagagcattgtgttcggcggagtgcgggccagatcccaggatctcgacgccatctggcgcggcttttatatcgctggggatcctgccctggcttacggatatgcccaggaccaagagcccgacgcgcggggccgcattagaaacggggccctgctccgggtctacgtgcctagaagctctctgcccggattctaccgcacctcccttaccctggctgccccggaagctgccggcgaggttgaacggctcatcgggcaccctctgccccttagactggatgcgattacaggccctgaggaggaaggaggccgcctcgagacgatcctggggtggcccctggccgaacggaccgtggtcattcccagcgctatccctacagacccgagaaatgtgggaggcgatctcgacccctctagcattcctgataaggagcaggccatctccgctctgcccgactatgcctctcagcctgggaaacccccgcgcgaagatcttaag

SEQ ID NO: 38792 - RNA, 324 nt, synthetic construct
  misc_feature 1..324: note = derived and/or modified sequence opt5 from Moxetumomab_pasudotox_LightChain1
  source 1..324: mol_type = other RNA
atggacatccagatgacccaaacaacgagctccctgtctgccagcctcggcgatagagtgaccatttcctgccgggcttctcaggacatcagcaactacctgaattggtatcagcagaagcccgatgggacagtcaaacttctgatttactatacctccatcctccactctggagttcctagccgcttctccggcagcgggtctggaacagactactccctgaccattagcaaccttgagcaagaagattttgccacatatttctgtcagcagggcaataccctgccgtggacgtttgggtgcggaaccaagctcgagatcaaa

SEQ ID NO: 38793 - RNA, 1350 nt, synthetic construct
  misc_feature 1..1350: note = derived and/or modified sequence opt5 from Muromonab-CD3_HeavyChain
  source 1..1350: mol_type = other RNA
caggtgcaactgcagcagagcggcgccgagctcgctagacccggggcctccgtcaagatgtcttgcaaagcgagcggatacaccttcacacggtatacgatgcactgggttaagcagcgccctggccaagggctggaatggatcggatacattaacccgtccagaggctataccaattacaaccagaaatttaaggacaaagctacacttaccacagataagtctagctccaccgcctatatgcagctgtctagcctcacatccgaggacagcgccgtgtactattgtgctcggtactacgatgaccattattgcctggattactgggggcagggaaccacgcttaccgtgtcttccgccaagacaaccgctcccagcgtctatcctctggcccccgtgtgtggcggcacaaccgggtcttccgttacgctcggatgcctggtgaaaggctacttccctgaacccgtcacactgacctggaatagcgggtctctctccagcggagtgcacacatttcctgcggttctgcaatccgacctttataccctgtctagctccgtgaccgtcacaagctctacgtggccgtcccagagcatcacctgtaacgtggcccatcccgcttctagcacaaaggtggataaaaagattgagcctcgccccaaatcctgcgacaagacccacacatgtcctccctgcccggcccctgaactcctgggcgggccctctgtcttcctttttcctcccaagcccaaagataccctgatgatcagcagaacgcctgaggttacatgtgtggtggtcgacgtgtcccatgaggatccggaagttaagttcaattggtacgtggacggagtcgaggtgcacaacgctaaaaccaagccccgggaggaacagtataatagcacctaccgcgttgtgtctgtcctcacagtgctgcaccaggattggctgaacggcaaagagtacaagtgcaaagtctccaataaggccctccctgcgcccattgaaaagaccatcagcaaagccaagggccaacctagagagccccaggtgtatacactgccgccttctcgggacgaacttacgaaaaaccaggtttccctgacctgtctcgtgaaggggttttaccccagcgacatcgctgtcgagtgggaatccaatggacaacctgagaacaattataaaacaacaccccctgtgctggattctgacggcagcttctttctttactccaagctgaccgttgataagtctcgctggcagcaggggaacgtgttcagctgctccgtcatgcatgaggccctccacaatcattatacccagaaaagcctgtctctgtcccccggaaag

SEQ ID NO: 38794 - RNA, 639 nt, synthetic construct
  misc_feature 1..639: note = derived and/or modified sequence opt5 from Muromonab-CD3_LightChain
  source 1..639: mol_type = other RNA
cagatcgtgctgacccaaagccccgccattatgtccgcttctcctggcgagaaggtcacaatgacgtgcagcgcctcctctagcgtttcctacatgaactggtatcagcagaaatctgggaccagcccgaagagatggatctacgacacatccaaactcgcgagcggagtgcccgctcacttccggggctctgggtccggaaccagctattctctgacaatttccggcatggaagccgaggatgccgctacctactattgtcagcaatggagctctaatccttttacattcgggtccggaaccaagctggaaatcaaccgcgccgacacggctcccaccgtgagcatttttcctccctcctctgagcagctgacaagcggcggcgcctccgtcgtgtgcttcctcaataacttttaccctaaagatatcaatgttaagtggaagatcgacgggagcgaaagacagaacggagtgcttaattcttggaccgatcaggactccaaagatagcacatattctatgagctccacccttacgctgacaaaggacgagtacgagcggcataactcttacacctgtgaagcgacacacaaaaccagcacctccccgattgtcaagagcttcaatcgcaacgagtgc

SEQ ID NO: 38795 - RNA, 1347 nt, synthetic construct
  misc_feature 1..1347: note = derived and/or modified sequence opt5 from Namilumab_HeavyChain1
  source 1..1347: mol_type = other RNA
caggtgcaactggtccagagcggcgccgaggttaagaaacccggggcttccgtgaaggtgtcttgcaaagccttcggatacccttttaccgactatctcctgcactgggtcagacaggcgccgggccaggggcttgaatgggtgggatggctgaacccctacagcggcgatacaaattatgctcaaaagttccaggggcgggttacgatgacccgcgacacatccatctctaccgcctacatggagctcagcagactgcggtccgatgacacagccgtgtattactgtacccgcacaacccttatttctgtctattttgattactggggacagggcacgatggtgaccgttagctccgctagcacaaaaggcccttctgtgttccccctggccccttccagcaagtctacctccgggggaacagctgccctcggctgcctggtcaaggactactttcccgaacctgtgaccgtgagctggaactctggggcgctgacgtccggagtccatacattcccggccgttctccagagctccggcctgtattctcttagctccgtggtgaccgtcccctctagctccctggggacacaaacctacatctgtaatgtgaaccacaaacctagcaataccaaggttgataaaaaggtggagcccaaatcttgcgacaagacacatacgtgtcctccctgcccggctcctgaactcctgggaggccccagcgtctttcttttccctcccaagcccaaagataccctgatgatttccagaacacctgaggtgacctgtgttgtggtcgacgtgtctcacgaggatccggaagtcaagtttaactggtatgtggacggcgttgaggtgcataatgccaaaacaaagccccgggaggaacagtacaacagcacctatcgcgtcgtgtccgttctcacggtgctgcaccaggattggctgaatgggaaagagtacaagtgcaaagtcagcaacaaggctctccctgcccccatcgaaaagacaatttctaaagcgaagggacagcctagagagccccaagtgtataccctgccgccttcccgggacgaacttaccaaaaatcaggtgagcctgacatgtctcgttaagggcttctacccctctgacatcgccgtcgagtgggaatccaacgggcagcctgagaataactacaaaaccacaccccctgtgctggatagcgacggatcctttttcctttattctaagctgacggtggataagagccgctggcaacagggcaatgtcttttcctgctctgtgatgcacgaggctctccataaccactacacccagaaaagcctgtccctgagccccgggaag

SEQ ID NO: 38796 - RNA, 642 nt, synthetic construct
  misc_feature 1..642: note = derived and/or modified sequence opt5 from Namilumab_LightChain1
  source 1..642: mol_type = other RNA
gacatccagatgacccaaagcccctcctctgtgagcgcctccgtcggcgatagagttacaattgcttgccgggcctctcagaacatccgcaatattctgaactggtaccagcagagacctgggaaagcgccgcaactcctgatctatgctgccagcaatcttcagtccggagtgccctctcggttcagcggctccgggagcggaacggactttaccctgacaattaactctctccagcctgaggatttcgccacctactattgtcagcaatcctacagcatgccccgcacatttggcgggggaaccaaactggaaatcaagagaacagtggctgccccttctgtcttcatctttcccccttccgacgagcagcttaaaagcggcaccgcttctgtggtttgcctgctcaataacttctatccgcgggaagccaaggtgcagtggaaagtcgataatgcgctgcagtccggcaacagccaagagtccgtgacggaacaggactctaaggatagcacctactccctgagctctacactcaccctgtccaaggccgactatgagaaacacaaggtttacgcttgtgaggtgacacatcaggggcttagctctcccgtcaccaagagctttaatcgcggagaatgc

SEQ ID NO: 38797 - RNA, 1374 nt, synthetic construct
  misc_feature 1..1374: note = derived and/or modified sequence opt5 from Naptumomab_estafenatox_HeavyChain
  source 1..1374: mol_type = other RNA
gaggtgcagctgcaacagagcggccccgacctcgtcaagcctggggcctccgttaaaatctcttgcaaggctagcggatactccttcaccggctattacatgcactgggtgaaacagtctccggggaagggactggaatggattggcagaatcaaccccaataacggggtgacactttataatcagaaatttaaggataaggccacgctgaccgtcgacaaaagctccacaaccgcgtacatggagctccggtctctgacaagcgaagattccgctgtgtattactgtgcccgcagcaccatgattacaaactatgttatggactactggggacaaggcacctctgtgacggtctccagcgccaagaccacacctccctctgtgtaccctcttgctcccggctccgccgctcagaccaatagcatggttacactggggtgcctcgtgaaaggatatttccctgagccggtcaccgtgacgtggaactctggctccctgagctccggggtgcatacatttcccgccgtcctgcagtctgatctctacaccctgagctccagcgttacagtgccttcttccacctggcccagcgaaaccgtgacatgtaatgtcgcgcaccctgcctctagcacgaaggtggacaaaaagatcgttcccagagattccggaggcccgtctgaaaagagcgaggagattaacgagaaagaccttcggaagaaatccgaactgcaggggaccgctctcggaaatctgaagcaaatctattactataacagcaaagccatcacatcttccgaaaagagcgctgatcagttccttaccaatacactgctctttaaaggcttctttaccggccatccttggtacaacgacctgctggtggatctcgggtctacggccgcgacatccgagtatgagggaagctccgtcgacctgtacggcgcctactatgggtaccagtgcgctggaggcacccccaataagaccgcctgtatgtatgggggagtgacacttcacgataacaatcgcctgaccgaggaaaagaaagttcctattaacctctggatcgacggcaagcagacaacggtgcccattgacaaagtcaagacctctaaaaaggaggtgacagtccaagaactggatcttcaggctagacattacctgcacggcaagttcgggctctataacagcgactcctttggaggcaaagtgcagcgggggctgatcgttttccactctagcgagggatccaccgtgagctacgatctgtttgacgcccaaggccagtatcccgatacactcctgcgcatttacagagacaataccacgatctcttccaccagcctttctatttccctgtacctctatacaacc

SEQ ID NO: 38798 - RNA, 642 nt, synthetic construct
  misc_feature 1..642: note = derived and/or modified sequence opt5 from Naptumomab_estafenatox_LightChain
  source 1..642: mol_type = other RNA
agcatcgtgatgacccagacacccacgtccctgctcgtctctgccggcgacagagttaccattacatgcaaggctagccaatccgtgtctaacgatgtggcctggtaccagcagaaacctgggcagagcccgaagctgcttatctcctatacctctagccggtacgcgggagtccccgaccgcttctccggcagcgggtatggaacagattttaccctgacaatttcttccgtgcaagctgaggacgccgccgtttacttctgtcagcaggattataatagccctcccacctttggcgggggaacgaaactcgaaatcaagagagctgacgccgctcctaccgtgtctatttttcccccttccagcgagcagctgacatctggcggcgcctccgtcgtgtgcttccttaacaatttctacccgaaagatatcaacgttaagtggaagatcgacgggagcgaacggcaaaatggagtgctgaactcctggaccgatcaggactctaaagatagcacatattccatgagctctaccctcacgctgacaaaggacgagtacgaacgccacaattcctacacctgtgaggcgacacataaaaccagcacctctcccattgtcaagagctttaacagaaatgagtcc

SEQ ID NO: 38799 - RNA, 1356 nt, synthetic construct
  misc_feature 1..1356: note = derived and/or modified sequence opt5 from Narnatumab_HeavyChain1
  source 1..1356: mol_type = other RNA
gaggtgcagctggtcgaaagcggcgggggactcgttcaacccggcgggtccctgagactttcttgcgccgctagcggattcaccttttcctcttacctgatgacatgggtgcggcaggcccctggcaaggggctcgagtgggtggcgaacatcaaacaggacggaagcgaaaagtattacgtcgattccgtgaaaggccgcttcacgatttctagagacaatgctaagaacagcctgaatcttcagatgaactccctgcgggccgaggataccgccgtttattactgtacacgcgacggctatagctctgggagacactacggaatggatgtgtggggccaagggaccacagtcatcgtgtccagcgcttctaccaaaggaccgtccgtttttcccctcgcccctagctctaagtccacaagcggcgggaccgctgccctgggatgcctggtgaaggactatttccccgaacctgtcacggtgtcctggaactctggcgcgctcaccagcggcgtgcatacatttcccgccgtcctgcagtccagcgggctttactctctgtccagcgttgtgaccgtgccttctagctccctcggaacacagacctacatttgtaatgtcaatcacaaaccgtctaacacgaaggtggataaacgggttgagcccaagagctgcgacaaaacacatacctgtcctccctgccctgctcccgagctgcttggcgggccgtccgtgttcctgtttcctcccaagcctaaggatacactcatgatcagccgcacccccgaagtcacctgtgtggttgtggacgtctctcacgaggatcccgaagtgaaattcaattggtatgtcgacggagtggaggttcataacgccaagacaaaacctagagaggaacagtacaattccacgtatcgggtggtcagcgtgctgaccgttctgcaccaagattggctcaacggcaaggagtacaaatgcaaggtgtctaataaagctctgccggcccccattgaaaagacaatctccaaggcgaaagggcagcctcgcgagccccaggtctatacccttcctcccagcagagaagagatgacaaagaaccaggtgtccctgacctgtctcgtgaaaggattttacccgtctgacatcgccgttgagtgggaaagcaatggccaacctgagaacaactataagacgacaccccctgtcctggactccgatggctctttctttctttacagcaaactgaccgtggacaagtcccggtggcagcaggggaatgtgttcagctgctctgtcatgcacgaagctctccataaccactacacccaaaagtccctgagcctgtctcccggaaaa

SEQ ID NO: 38800 - RNA, 642 nt, synthetic construct
  misc_feature 1..642: note = derived and/or modified sequence opt5 from Narnatumab_LightChain1
  source 1..642: mol_type = other RNA
gagatcgtgctgacccagagccccgccacactctccctgtctcctggcgaacgggctacgcttagctgccgggcctcccaatctgtcagccgctacctggcgtggtatcagcagaagccggggcaggctcccagactcctgatttacgacgcctccaaccgggccaccggaatccctgctcgcttctctggcagcgggtccggaacagattttacccttacaattagctctctggagcccgaagacttcgccgtttattactgtcaacagagatccaattggcctcggacctttggccaggggacaaaagtggagatcaagcgcaccgtggctgcccccagcgtcttcatttttcctccgtctgatgaacagctcaaatccggaacggcgagcgtggtttgcctgctgaacaatttctatcccagagaggccaaggtgcaatggaaagtcgacaacgctctccagtctggcaattcccaggagagcgtgaccgaacaggattccaaggactctacatacagcctgtccagcacccttacactgtctaaggccgattatgagaaacacaaggtttacgcttgtgaagtgacccatcaaggcctctccagccctgtcacgaaatcttttaacagaggggagtgc

SEQ ID NO: 38801 - RNA, 1350 nt, synthetic construct
  misc_feature 1..1350: note = derived and/or modified sequence opt5 from Natalizumab_HeavyChain1
  source 1..1350: mol_type = other RNA
caggtgcaactggtccagagcggcgccgaggttaagaaacccggggcttccgtgaaggtgtcttgcaaagccagcggattcaacatcaaggacacctacattcactgggtcagacaggcgcctggccagcggctcgaatggatggggcgcatcgatccggctaatggatatacaaaatacgaccccaagtttcaaggcagagtgacgattaccgccgatacatccgcctctaccgcttatatggagctgagctcccttcggtctgaagacacagccgtttactattgtgctcgcgaggggtactatggaaactacggcgtgtacgccatggattattggggccaggggaccctggtcacagtgagctccgcgagcaccaagggaccttctgttttccccctcgccccttgctccagaagcacgtctgaatccaccgctgccctgggctgtcttgtgaaagactactttcccgagcctgtcacagtgagctggaatagcggggctctgacctccggagtgcatacattcccggccgtcctccagagctccggcctgtattctctgagctccgttgtgaccgtgccctcttcttccctcgggacgaagacatatacctgcaacgtcgatcacaaacctagcaatacaaaggtggacaaacgggttgagtctaagtacggacccccttgtcccagctgcccggcgcctgaatttctgggcggcccctccgtgttcctttttcctcccaagcccaaagataccctgatgatctctcgcacccctgaggtcacatgtgtggttgtggacgtcagccaggaagatccggaggtgcaattcaactggtacgtcgacggggtggaggttcataatgccaagacgaaacccagagaggaacagtttaactccacctatcgggtggtcagcgtgctcacagttctgcaccaggattggcttaatggaaaggaatacaaatgcaaggtgtctaacaaaggcctgccttccagcattgagaagaccatctctaaggctaaagggcagccccgcgaacctcaagtctacacactgcccccgtcccaggaggagatgaccaagaatcaggtgagcctcacgtgtctggtgaaaggattctatccttccgacatcgccgttgaatgggagtctaacggccaacccgaaaataactacaagacaacccctcccgtcctcgacagcgatgggtcctttttcctgtattctagacttaccgtggacaaaagccggtggcaggagggaaatgtgttttcctgcagcgtcatgcatgaagctctgcacaaccactacacacagaagtctctctccctgagccttggcaag

SEQ ID NO: 38802 - RNA, 639 nt, synthetic construct
  misc_feature 1..639: note = derived and/or modified sequence opt5 from Natalizumab_LightChain1
  source 1..639: mol_type = other RNA
gacatccagatgacccaaagcccctcctctctgagcgcctccgtgggcgatagagtcacaattacgtgcaaaacctctcaggacatcaacaaatacatggcttggtatcagcagacacctgggaaggccccgcggctcctgattcactacaccagcgcgcttcaacccggaatcccttcccgcttctctggcagcgggtccggaagagattatacatttaccattagctctctgcagcccgaggacatcgctacatactattgtctccagtacgataatctgtggaccttcggccaggggacgaaagttgaaatcaagcggaccgtggccgccccttccgtgtttatttttccccctagcgacgagcaacttaaatctggaacagcttccgtcgtgtgcctgctcaacaatttctatccgcgcgaagccaaggttcagtggaaggtggataacgctctgcagagcggcaattctcaggagtccgtcaccgaacaagacagcaaagattccacatactctctgagctccaccctcacgctgagcaaggccgactacgagaaacataaggtgtatgcgtgtgaggttacacaccagggcctttcttcccccgtgaccaagagcttcaacagaggggaatgc

SEQ ID NO: 38803 - RNA, 1335 nt, synthetic construct
  misc_feature 1..1335: note = derived and/or modified sequence opt5 from Navicixizumab_HeavyChain1
  source 1..1335: mol_type = other RNA
caggtgcaactggtccagagcggcgccgaggttaagaaacccggggcttccgtgaagatctcttgcaaagccagcggatactccttcaccgcgtattacattcactgggtgaagcaggctcctggccaggggctcgaatggatcggatatatttctaactacaatagagccacaaactataatcaaaaatttaagggccgggtcacgttcaccacagacaccagcacatccaccgcctacatggagctgcgctctcttagaagcgatgacacagctgtgtattactgtgcccgggattacgactatgatgttgggatggactactggggacagggcaccctggtgacggtctccagcgcttctaccaagggcccgtccgtgtttcccctcgccccttgcagccgctctacatccgaaagcaccgcggccctggggtgtcttgttaaagattatttccccgagcctgtgacagtctcttggaactccggagctctgaccagcggcgtgcatacgtttcccgccgtgctccagtcctctgggctgtacagcctgtccagcgtcgttacagtgccttcttccaatttcggaacccagacatatacctgcaacgtggaccacaagccgagcaataccaaagtcgataagacagtggaaagaaaatgttgcgttgagtgtcccccttgccccgctcctcccgtggccggcccgtctgtctttctcttccctcccaagcctaaggacacgctgatgatcagccggacccccgaggtgacatgtgttgtggtcgatgtgtcccatgaagaccccgaggtccaatttaactggtacgtggatggggttgaagtgcacaatgcgaaaaccaagcctcgcgaggagcagttcaactctacatttagagtcgtgagcgttcttaccgtggtccatcaggactggctgaatggaaaagaatataagtgcaaagtgtccaacaagggcctcccggcccccattgagaaaacgatcagcaagacaaagggccagcctcgggaaccccaagtgtacaccctgcctccctctcgcgaggaaatgaccaaaaatcaggtttcccttacatgtctggtcgaggggttctacccgagcgacatcgctgtggagtgggaatctaacggacagcctgagaataactataagaccacaccccctatgctcgattccgacggcagctttttcctgtactccgaactgacggtggataaatctagatggcaacaggggaacgtcttcagctgctccgtgatgcacgaggccctccacaatcattatacccagaagtctctgagcctttcccccggaaaa

SEQ ID NO: 38804 - RNA, 1341 nt, synthetic construct
  misc_feature 1..1341: note = derived and/or modified sequence opt5 from Navicixizumab_HeavyChain2
  source 1..1341: mol_type = other RNA
caggtgcaactggtccagagcggcgccgaggttaagaaacccggggcttccgtgaaggtgtcttgcaaagccagcggatacaccttcacaaactattggatgcactgggtcagacaggcgcctggccaggggctcgaatggatgggagacatcaatccgtccaacggccggacgtcttacaaggagaaatttaagcgcagagtgaccctgagcgttgataagtcctctagcacagcttatatggaactttccagcctgcggtctgaggacaccgccgtgtacttctgtacaattcattatgatgacaaatactatcccctcatggattactgggggcaaggaaccctggtcacagtgtccagcgcctctaccaagggcccttccgtttttccccttgctccttgcagccgctctacgtccgaaagcaccgccgctctgggctgtctcgtgaaagactacttccccgagcctgtcacagtgtcctggaactctggggccctgaccagcggagtgcacacatttccggcggtcctgcagtccagcggcctctattctctgtccagcgttgtgaccgtgccctctagcaatttcgggacgcagacatatacctgcaatgtcgatcataagccttccaacacaaaagtggacaagaccgttgagagaaagtgttgcgtggaatgtcccccttgccccgccccgcctgtcgctggaccctctgtgtttcttttccctcccaaacccaaggataccctgatgatcagccggacacctgaggttacgtgtgtggtcgtggacgtctcccacgaagatccggaggtgcagtttaattggtacgttgacggcgtggaggtccataacgccaaaaccaagccccgcgaggaacaattcaatagcacatttagagtggtttctgtgctcaccgtcgtgcaccaggattggctgaacgggaaagaatacaagtgcaaagtgtccaataagggacttcctgctcccattgagaagacaatcagcaaaaccaagggccagcctcgggaaccccaggtttatacgctgccgccttctcgcgagaaaatgacaaagaaccaagtctccctcacctgtctggtgaaaggcttctaccccagcgacattgccgtggagtgggaatccaatgggcagcctgagaacaattataagaccacaccccctatgctgaagtctgacggcagctttttcctctactccaaactgaccgtcgataagtctagatggcagcaaggaaacgtgttcagctgctccgttatgcacgaagcgcttcataaccactacacacagaaaagcctgtctctctcccccgggaag

SEQ ID NO: 38805 - RNA, 654 nt, synthetic construct; identical to SEQ ID NO: 38409
  misc_feature 1..654: note = derived and/or modified sequence opt5 from Navicixizumab_LightChain1
  source 1..654: mol_type = other RNA

SEQ ID NO: 38806 - RNA, 1368 nt, synthetic construct
  misc_feature 1..1368: note = derived and/or modified sequence opt5 from Navivumab_HeavyChain1
  source 1..1368: mol_type = other RNA
caggtgcaactggtccagagcggcgccgaggttaagaaacccggggcttccgtgaaggtgtcttgcaaaaccagcggatactccttctctacatatggcgtcagctgggtgagacaggcccctgggcagggaccggaatgggttggctggatctccgcgtacacggggattaccgactatgctcaaaagtttcagggacgggtgacactcaccacagatgccaccacagccaccgctttcctggaccttcgctctctgagacccgatgacacggccacctacttttgtgctcgggataaagtccagggccgcgtggaggttggcagcgggggaagacacgactattggggccaggggacactcgtgatcgtctccagcgcctctaccaagggaccttccgtgttccccctggcgcctagctctaagtccacaagcggcgggaccgccgctcttggatgcctggtgaaagattactttcccgaacctgtcacggtttcttggaactccggcgccctcacaagcggcgtgcataccttcccggctgtgctgcaatcctctgggctgtatagcctctccagcgtcgtgacagttccctcttccagcctgggaacccagacctacatttgtaatgtgaaccacaagccttctaatacaaaagtcgacaagaaagtggagcccaagagctgcgataagacgcatacctgtcctccctgcccggcccctgaacttctgggcgggccctccgtttttctcttccctcccaaacccaaggacacactgatgatctctcggacccctgaggtgacatgtgtcgtggtcgatgtgagccacgaggacccggaagttaaatttaactggtacgtggatggagtcgaggtgcataatgcgaagaccaaaccccgcgaagaacagtataactccacgtacagagttgtgagcgtccttacagtgctgcaccaggactggctcaatggcaaggagtataaatgcaaggtgtctaacaaggccctgcctgctcccattgagaaaaccatctccaaggccaaagggcaacctcgggagccccaggtttacaccctgccgcctagccgcgacgaactcacaaagaatcaggtctctctgacctgtcttgtgaaaggattctatccctccgatatcgctgtggagtgggaaagcaacggccaacctgagaataactacaagacaacgccccctgtcctggactccgatggcagctttttcctctattctaagctgaccgtggacaaatccagatggcagcaggggaatgtgttttcttgcagcgttatgcacgagggacttcataaccactacacacagaagtccctgagcctctctcccggcaaa

SEQ ID NO: 38807 - RNA, 645 nt, synthetic construct
  misc_feature 1..645: note = derived and/or modified sequence opt5 from Navivumab_LightChain1
  source 1..645: mol_type = other RNA
gaggtggtcctgacccagagccccggcacactcgccctgcctccgggggaaagagctacgctttcctgccgggcctctcaccgcgttggaagcacctacatcgcgtggtatcaacagaagtccggccaggctcccagacggctgatttacggggcctctaaccgcgccacagacatccctgatagattcagcggatccggctctgggaccgactttacactcaccattcggcgcctggagcccgaagatagcgctgtgtattactgtcagcaattctccgtgagcccttggacatttggacagggcaccagagtcgagatcaaacggacggtggccgctccctctgttttcatttttcctccgtccgacgaacagcttaagagcggcaccgcctctgtggtctgcctgctcaataacttctatccccgcgaggcgaaagtgcagtggaaggttgataatgccctgcaatccgggaacagccaggagtctgtgacagaacaggactccaaagatagcacctactccctgtctagcacactcaccctgtccaaggctgactatgagaagcataaagtctacgcctgtgaagtgacgcaccagggacttagctctcctgtgacaaagtcctttaatagaggcgagtgc

SEQ ID NO: 38808 - RNA, 2172 nt, synthetic construct
  misc_feature 1..2172: note = derived and/or modified sequence opt5 from Ndimab-varB_HeavyChain
  source 1..2172: mol_type = other RNA
caggtgcaactggtcgagagcggcgggggagttgtgcagcccggcagatccctccggctgtcttgcgccgctagcgggttcatcttttcctcttacgccatgcactgggtgcgccaggcgcctggaaacggccttgaatgggtcgctttcatgagctatgacgggtccaataagaaatacgccgattctgtgaagggaagatttaccattagccgggacaactccaaaaatacactgtatctccagatgaacagcctgcgcgccgaggatacggctgtttactattgtgccagagaccggggcatctctgctggcgggaattactattactacggaatggatgtgtggggccaagggaccacagtcaccgtgtccagcgcctctacaaagggaccgtccgttttcccccttgcgcctagctctaaatccaccagcggcgggacagccgctctgggatgcctcgtgaaggactattttcccgaacctgtcaccgtgtcctggaactctggcgccctgacgagcggcgtgcataccttccccgctgtcctgcagtccagcgggctctactctctgtccagcgttgtgacagtgccttctagctcccttggaacccagacatatatttgtaatgtcaaccacaagccgtctaataccaaagtggataagcgcgttgagcccaaaagctgcgacaagacgcatacatgtcctccctgccctgcccccgaactgctcggcgggccgtccgtgtttctgttccctcccaaacctaaggatacccttatgatcagcagaacacccgaggtcacctgtgtggttgtggacgtctctcacgaggatcccgaagtgaagtttaactggtacgtcgacggagtggaggttcataatgcgaaaaccaagcctcgggaggaacagtataactccacataccgcgtggtcagcgtgctgacggttctccaccaagattggctgaatggcaaagagtataagtgcaaagtgtctaacaaggccctgccggctcccattgaaaagaccatctccaaggccaaggggcagcctagagagccccaggtctacacactccctcccagccgggaagagatgaccaaaaatcaggtgtccctgacatgtcttgtgaagggattctacccgtctgacatcgctgttgaatgggagagcaacggccaacctgagaacaattataaaaccacgccccctgtcctggactccgatggcagctttttcctctactctaagctgacagtggacaaatcccgctggcagcaggggaacgtgtttagctgctctgtcatgcacgaagcccttcataatcactatacccaaaagtccctgagcctctctcccggaaagggcgggggaggctccgggggcggaggcagccaggtgcagctggttcagtctggggccgaggtgaaaaagcctggaagctccgtcaaagtgagctgtaaggcttctggcgggaccttctccacatacggaattagctgggttagacaagcgcccggccagtgcctggaatggatgggcgggatcattccgatcttcgataccggaaactccgcccagtcttttcagggccgggtgacaattacggctgacgagagcacctccacagcctatatggaactctctagcctgcgctccgaggataccgccgtctactattgcgctagatctagccggatctacgaccttaatccttccctgacagcctactatgatatggacgtgtgggggcaaggaaccatggttacggtgagctctggcgggggaggctccgggggcggaggcagcgggggaggcgggtctggaggcgggggctcccagagcgtcctcacccagcctccctctgtgtccgcggctcccggacagaaagtgacaattagctgttccggcagctctagcaacatcgggaataactacgtctcctggtatcaacagctgccgggaaccgcccccaaacttctgatctacgataataacaagagaccttctggcattcccgaccgcttcagcgggtccaaatctggaacaagcgccaccctcggcatcacgggcctgcagacaggggatgaggctgactattactgcggaacctgggactcctctctgagcgcctgggtttttggctgtgggacaaagctcaccgtgctg

SEQ ID NO: 38809 - RNA, 645 nt, synthetic construct
  misc_feature 1..645: note = derived and/or modified sequence opt5 from Ndimab-varB_LightChain
  source 1..645: mol_type = other RNA
gagatcgtgctgacccagagccccgccacactctccctgtctcctggcgaaagagctacgcttagctgccgggcctcccaatctgtctacagctatctggcgtggtaccagcagaagccggggcaggctccccgcctcctgatttatgacgcctccaacagagccatcggcattcctgctcggttctctggaagcgggtccggaaccgattttacacttaccatcagctctctggagcccgaagacttcgccgtttactattgtcaacagcgctccaattggcctccctttacattcggccctgggaccaaagtggatattaagagaacagtggctgccccgagcgtctttatctttcccccttctgacgagcagctcaaatccggaaccgcgagcgtggtttgcctgctgaacaatttctacccccgggaagccaaggtgcagtggaaagtcgataacgctctccaatctggcaattcccaggagagcgtgacggagcaggactccaaggattctacctatagcctgtccagcacacttaccctgtctaaggccgactacgaaaaacacaaggtttacgcttgtgaggtgacacatcagggcctctccagccctgtcaccaaatctttcaaccgcggggaatgc

SEQ ID NO: 38810 - RNA, 1353 nt, synthetic construct
  misc_feature 1..1353: note = derived and/or modified sequence opt5 from Necitumumab_HeavyChain1
  source 1..1353: mol_type = other RNA
caggtgcaactgcaggagagcggccccgggctcgtcaagccttcccagaccctgtctcttacatgcacggttagcggaggctccatctctagcggggactactattggtcctggattagacagccgcccggaaaaggcctggaatggatcgggtacatttattactctggaagcaccgattataacccttccctcaagagccgggtgacaatgtctgtggacacctccaaaaatcaattcagcctgaaggtcaactctgtgacagccgctgataccgccgtttactattgtgcgcgcgtgtccatctttggcgtcggcacattcgactactgggggcagggaacccttgtgacggttagctctgcttccaccaaaggccccagcgtgctgcctctcgccccctcctctaagagcacatccgggggaaccgccgctctgggctgcctggtcaaggattactttcctgagccggtgacagtgagctggaatagcggggccctcacctccggagtccacacgttccccgctgttctgcagagctctggcctttatagcctgtcctctgtggtgacagtccctagctccagcctcggcacccagacatacatttgtaacgtgaatcataaaccctctaacaccaaggttgacaaaagagtggaacctaagtcctgcgataaaacccacacatgtcccccgtgccctgcccccgagctgcttgggggacctagcgtctttctgttcccgcccaagcctaaggacacgctcatgatctctcggaccccggaagtgacatgtgttgtggtcgatgtgtcccatgaggaccccgaggtcaaatttaattggtatgtggatggcgttgaagtgcacaacgcgaagaccaaacctcgcgaggaacaatacaatagcacatatagagtcgtgtccgttctgaccgtgctgcatcaggactggctcaacgggaaggagtacaaatgcaaggtctctaataaagccctgcccgctcctatcgagaagacgattagcaaggccaaaggacagccccgggaaccccaggtgtatacacttcctccctcccgcgaggaaatgaccaagaaccaagtgtctctgacctgtctcgttaaaggcttctaccctagcgatatcgctgtcgagtgggaatccaatgggcagcccgagaacaattacaagacaacccctcccgtgctggacagcgacggatcctttttcctttattctaaactgacagtggataagagcagatggcagcaaggcaacgtcttttcttgctccgtgatgcacgaggccctccacaaccattacacgcagaagtctctgtctctgagcccgggcaaa

SEQ ID NO: 38811 - RNA, 642 nt, synthetic construct
  misc_feature 1..642: note = derived and/or modified sequence opt5 from Necitumumab_LightChain1
  source 1..642: mol_type = other RNA
gagatcgtgatgacccagagccccgccacactgtccctctctcctggcgaaagagctacgctgagctgccgggcctcccaatctgtcagctcctaccttgcgtggtatcagcagaaaccggggcaggctccccgcctgctcatttacgacgcctctaacagagccaccggaatccctgctcggttcagcggctccgggagcggaacagattttaccctgacaatttcttcccttgagcccgaagacttcgccgtttattactgtcaccaatatggcagcacccctctgacatttgggggaggcaccaaagctgagatcaagcgcacggtggccgcgccctctgtgttcatttttcctccgtccgatgaacagctcaaaagcggcaccgcctctgtcgtgtgcctgctgaataacttctaccccagagaggctaaggttcagtggaaagtggacaatgccctccagtccgggaacagccaagagtccgtcacagaacaggattctaaggacagcacctattccctgagctctacacttaccctgtccaaggctgattacgagaaacataaggtgtacgcctgtgaagttacgcaccagggactcagctctcctgtgacaaagagctttaatcggggcgagtgc

SEQ ID NO: 38812 - RNA, 396 nt, synthetic construct
  misc_feature 1..396: note = derived and/or modified sequence opt5 from Neliximab_HeavyChain_VH-Region
  source 1..396: mol_type = other RNA
gaggtgcagctgcaacagagcggccccgaactcgtcaagcctggggcctccgttaagatgtcttgcaaggctagcggatacaccttcacaacgtatgtgatgcactgggtgaaacagaagccgggccaggggctggagtggatcggatacattaacccctataatgacggcaccaactacaatgaaaaatttaaggggaaggccacacttacctccgataaatctagctccacagcgtatatggagctgtctaccctcacaagcgaagactccgctgtctactattgtgccgagttcatcaccaagacggtgggaggcagcaactggtacctggatgtttggggcgccgggaccacagtgaccgtctcttccgctaaaacaacccctcccaaactt

SEQ ID NO: 38813 - RNA, 372 nt, synthetic construct
  misc_feature 1..372: note = derived and/or modified sequence opt5 from Neliximab_HeavyChain_VH-Region_variant1
  source 1..372: mol_type = other RNA
caggtgcaactgaagcagagcggccccgaactcgtcaaacctggggcctccgttaagatgtcttgcaaagctagcggatacaccttcacaacgtatgtgatgcactgggtgaagcagaaaccgggccaggggctggaatggatcggatacattaacccctataatgacggcaccaactacaatgagaagtttaaggggaaagccacacttacctccgataagtctagctccacagcgtatatggaactgtctaccctcacaagcgaggactccgctgtctactattgtgccgagttcatcaccaaaacggtgggaggcagcaactggtacctggatgtttggggcgccgggaccacagtgaccgtctcttcc

SEQ ID NO: 38814 - RNA, 318 nt, synthetic construct
  misc_feature 1..318: note = derived and/or modified sequence opt5 from Neliximab_LightChain_VL-Region
  source 1..318: mol_type = other RNA
gacatcgtgctgacccagagccccgccattatgtccgcttctcctggcgagaaggtcacaatgacgtgcagcgcctcctctagcatctcctacattcactggttccaacagaaaccggggacctctcccaagcgctggatctatgatacaagcaaactcccttccggagttcccgcgcggtttagcggctctgggtccggaaccagctactctctgacaatttccagcatggaagctgaggacgccgccacctattactgtcatcagagatcttcctatacatggaccttcggcgggggaacgaaacttgaaatcaag

SEQ ID NO: 38815 - RNA, 354 nt, synthetic construct
  misc_feature 1..354: note = derived and/or modified sequence opt5 from Neliximab_LightChain_VL-Region_variant1
  source 1..354: mol_type = other RNA
cagatcgtgctgacccaaagccccgccattatgtccgcttctcctggcgagaaggtcacaatgacgtgcagcgcctcctctagcatctcctacattcactggttccagcagaaaccggggacctctcccaagagatggatctatgacacaagcaaactcccttccggagttcccgcgcggtttagcggctctgggtccggaaccagctactctctgacaatttccagcatggaagctgaggatgccgccacctattactgtcatcagagatcttcctatacatggaccttcggcgggggaacgaaacttgaaatcaagcgcgctgacgccgctcctaccgtgagcgccgcggcc

SEQ ID NO: 38816 - RNA, 1335 nt, synthetic construct
  misc_feature 1..1335: note = derived and/or modified sequence opt5 from Nemolizumab_HeavyChain1
  source 1..1335: mol_type = other RNA
caggtgcaactggtccagagcggcgctgaggttaagaaacccggggcttccgtgaaggtgtcttgcaaagccagcggatacaccttcacaggctatatcatgaactgggtcagacaggcgcctgggcagggactcgaatggatgggcctgattaatccgtacaacgggggaacggactataatccccaatttcaggatcgggtgaccatcacagctgacaagtccacctctacagcctacatggagcttagctccctgcgctctgaagataccgccgtttattactgtgctagagacggctatgatgacggcccttacacactcgagacctgggggcagggaacgctggtgaccgtcagctccgccagcacaaaaggcccctctgtgttccctcttgctccctccagcaagtctacctccgggggaacagccgcgctgggctgcctcgttaaggattactttcctgaaccggtgaccgtcagctggaactctggggccctgacgtccggagtgcacacattccccgctgtgctgcagagctccggcctctattctctgagctccgtcgttaccgtgcctagctctaattttggcacacaaacctacacctgtaacgtggaccataaaccctccaatacaaaggtcgataaaacggtggagcgcaagagctgcgttgagtgtcctccctgcccggcccctcccgtggctgggccttctgtcttcctttttccgcccaaacctaaggacaccctgatgattagccggacaccggaagtgacctgtgttgtggtcgatgtgtcccaggaggaccccgaagtccagttcaactggtatgtggatggagttgaggtgcacaatgccaagacaaaacctagagaggaacagtttaactctaccttccgggtcgtgagcgttctcacggtggtccatcaagactggctgaatggcaaggagtacaaatgcaaggtgtccaacaaagggcttcccgcgcctatcgaaaagacaattagcaaaaccaagggacagccccgcgagccccaggtgtataccctgcctccctctcaagaagagatgacaaagaatcaggtttccctcacctgtctggtcaaaggcttttaccctagcgacatcgccgtggagtgggaatctaacgggcagcccgagaataactataagacaacgcctcccatgctggattccgacggcagcttctttctctactccaaactgaccgtggataagtctagatggcaggaaggaaacgtcttcagctgctccgtgatgcacgaggcccttcataatcactacacacaaaaatctctgagcctctccccg

SEQ ID NO: 38817 - RNA, 642 nt, synthetic construct
  misc_feature 1..642: note = derived and/or modified sequence opt5 from Nemolizumab_LightChain1
  source 1..642: mol_type = other RNA
gacatccagatgacccaaagcccctcctctctgagcgcctccgtgggcgatagagtcacaattacgtgccaggcttctgaggacatctacagcttcgttgcctggtatcagcagaagcctgggaaagcgccgaagctcctgatttacaacgctcaaaccgaagcccagggagtgccctcccggttttctggcagcgggtccggaacagatttcacccttacaatcagctctctgcagcctgaggactttgccacctattactgtcagcaccattatgatagccccctcacattcggcgggggaaccaaagtggaaattaagcgcacggtcgctgccccttccgtgtttatctttcccccttctgacgagcaactgaaatccggcaccgctagcgttgtgtgccttctgaataacttctacccgagagaagccaaggtccagtggaaggtggataatgcgctccagtctggcaactcccaggagagcgttacagagcaagactccaaagattctacctatagcctgtccagcacactgaccctctctaaggccgactacgaaaaacacaaggtgtacgcttgtgaggtcacgcatcaggggctgtccagccccgtgacaaaatctttcaatcggggagaatgc

SEQ ID NO: 38818 - RNA, 1356 nt, synthetic construct
  misc_feature 1..1356: note = derived and/or modified sequence opt5 from Nesvacumab_HeavyChain1
  source 1..1356: mol_type = other RNA
gaggtgcagctggtcgaaagcggcgggggactcgttcagcccggcgggtccctgagactttcttgcgccgctagcggattcaccttttcctcttacgacatccactgggtgcggcaggccacaggcaaggggctggagtgggtgagcgcgattggacctgctggcgatacgtattacccgggctccgtcaaagggcgcttcaccatctctagagaaaacgccaagaatagcctctatctgcagatgaactcccttcgggccggagacacagctgtgtactattgtgcccgcggcctgattacctttgggggactcatcgctcccttcgattactggggccaggggacactggttaccgtgagctctgcctccacaaaaggacctagcgtctttcccctggcgccttcttccaagagcacctctggcggcacggccgctctcgggtgcctggtgaaagactatttccccgagcctgttaccgtgtcctggaatagcggagcccttacatccggcgtccatacctttccggctgtgctgcaatctagcgggctctactccctgagctctgtggtcacagttccctccagctctcttggaacccagacgtacatttgtaacgtgaatcacaagcctagcaacacaaaggtggataaaaaggtcgaacccaaatcctgcgacaagacccatacatgtcctccctgcccggcccctgagctgctcggcgggccctctgtgttcctgtttcctcccaaacccaaggataccctgatgatcagcagaacccctgaggttacatgtgtggtcgtggacgtttcccacgaagatccggaggtgaagttcaattggtatgtcgacggagtggaagtccataacgcgaaaacgaagccccgggaggagcagtacaatagcacctatcgcgtggtttctgtgctcacagtcctgcaccaggattggcttaacggcaaagaatacaagtgcaaagtgtccaataaggccctgcctgctcccatcgagaaaaccattagcaaggccaagggccaacctagagaaccccaggtttatacactcccgccttctcgggacgagctgaccaaaaaccaggtgtcccttacgtgtctggtcaaggggttttaccccagcgatatcgctgtggaatgggagtccaatggacagcctgagaacaattataaaacaacaccccctgtgctcgactctgacggcagcttctttctgtactccaagctgaccgttgataaatctcgctggcaacaggggaacgtcttcagctgctccgtgatgcacgaagccctccataaccactacacccaaaagagcctgtctctttcccccggaaag

SEQ ID NO: 38819 - RNA, 642 nt, synthetic construct
  misc_feature 1..642: note = derived and/or modified sequence opt5 from Nesvacumab_LightChain1
  source 1..642: mol_type = other RNA
gagatcgtgctgacccagagccccggcacactctccctgtctcctggggaaagagccacgcttagctgccgggcttcccaatctgtcagctccacctacctggcctggtatcagcagaaaccgggacaggcgccccgcctcctgatttacggcgcttctagcagagccacagggatccctgaccggttctccggaagcggctctgggaccgattttacacttaccatttcccgcctggagcccgaagacttcgccgtttattactgtcaacactatgataacagccagacatttggacagggcaccaaagtggagatcaagagaacggtggctgccccttctgtcttcatttttcccccttccgacgaacagctcaaaagcggcaccgcttctgtggtttgcctgctgaataacttctacccgcgggaggccaaggtgcaatggaaagtcgataatgcgctccagtccgggaacagccaggagtccgtgacagaacaggactctaaggatagcacctattccctgagctctacacttaccctgtccaaggccgactacgagaaacataaggtttacgcttgtgaagtgacgcaccaaggactcagctctcccgtcacaaagagctttaatcgcggcgagtgc

SEQ ID NO: 38820 - RNA, 1362 nt, synthetic construct
  misc_feature 1..1362: note = derived and/or modified sequence opt5 from Neuradiab_HeavyChain1
  source 1..1362: mol_type = other RNA
gaggtgcagctgcaacagagcggccccgaactcgtcaagcctggggcctccgttaaaatgtcttgcaaggctagcggatacaccttcacatcctatgtggtgcactgggtcaaacagaacccgggccaggggctggagtggatcggatacattaatccctttaacgacggcacgaagtataatgaaaacttcaaatgtaaggccacccttacatctgatagaagctcctctaccgcgtacatggagctgagctccctcacaagcgaagagtctgctgtgtatttttgcgcccgggacatggggcgcgagggattcgcctactggggccaaggcaccctggttacagtgtccgctgccaagaccacgcctcccagcgtctatcctcttgctcccgggtgtggagataccacagggtcttccgtgaccctgggctgcctcgttaaaggatactttcctgaaagcgtgacagtcacctggaactctggctccctgagctcctctgtgcatacgttcccggccctgctccagagcgggctgtacacaatgtccagctctgtgaccgtcccctccagcacatggccttctcagatcgttatttgtagcgtggcgcaccccgcctcctctaccaccgtggacaagaaacttgagcctagcggacccatctccacaattaatccgtgccctccctgtaaggaatgccataaatgtcctgctcccaatctggagggcggccccagcgtctttatcttccctccgaacatcaaggatgtgctcatgatttctctgacgcccaaggttacctgcgtggtcgtggacgtttccgaggatgaccctgatgtgcagatcagctggtttgtcaataacgtggaagtccacacagcccaaacccagacacatagagaggactataattctaccattcgggtggtttccacgcttcccatccagcaccaggattggatgagcgggaaagagttcaagtgtaaagtgaacaataaggacctgccttcccccattgaacgcacaatctctaaaattaagggactcgtcagagctccgcaagtgtacatcctgcctccccctgccgaacagctgagccggaaagatgtttccctgacctgcctcgtggtcggctttaaccccggggacatctctgtggagtggaccagcaatggacacacagaggaaaactataaggacaccgcgcctgtgcttgattccgacggcagctacttcatttattctaagctgaacatgaaaacatccaagtgggagaaaacggatagcttttcttgcaatgttcgccatgaagggctcaagaactactatctgaaaaagaccatctccagaagccccggaaag

SEQ ID NO: 38821 - RNA, 657 nt, synthetic construct
  misc_feature 1..657: note = derived and/or modified sequence opt5 from Neuradiab_LightChain1
  source 1..657: mol_type = other RNA
gacatcgtgatgacccaggccgctttcagcaaccccgtcacactgggcacgtccgcctctattagctgcagatcctctaagagcctcctgcactccaatgggatcacctacctttattggtacctgcaaaaacctggacagtctccgcagctcctgatttatcagatgagcaaccttgcgtccggcgttcccgatcggttttctagctccgggagcggaacagacttcaccctgcgcatctctagagtggaggctgaagatgtgggcgtctactattgtgcccaaaatctcgagctgcctcggacatttgggggaggcaccaagctggaaattaaacgcgccgacgctgcccccacagtgtccatcttccctcccagctctgagcagctcacctccggcggggctagcgttgtgtgctttctgaacaatttctaccctaaggatatcaacgtcaaatggaagattgacggatccgaaagacagaatggcgtgcttaactcttggacggatcaggacagcaaggattccacctatagcatgtcttccacactgaccctcacaaaagacgagtacgagcggcataatagctacacctgtgaagccacgcacaagacatctaccagcccgatcgttaaatcctttaaccgcaatgagtgc

SEQ ID NO: 38822 - RNA, 369 nt, synthetic construct
  misc_feature 1..369: note = derived and/or modified sequence opt5 from Nimotuzumab_HeavyChain1
  source 1..369: mol_type = other RNA
caggtgcaactgcagcagagcggcgccgaggtcaagaaacccgggtcctctgttaaggtgagctgcaaggcttccggatacaccttcacaaactattacatctattgggtgagacaggcccctggccaagggctcgaatggattggaggcatcaatccgacgtctgggggaagcaactttaatgagaaattcaaaacccgggtcacaattaccgtggacgaatccacaaacaccgcgtacatggagctgtctagccttcgctccgaagatacagctttttatttctgtgccagacagggcctgtggtttgacagcgatggccgggggttcgacttttggggacagggctctaccgttacggtgtccagc

SEQ ID NO: 38823 - RNA, 342 nt, synthetic construct
  misc_feature 1..342: note = derived and/or modified sequence opt5 from Nimotuzumab_LightChain1
  source 1..342: mol_type = other RNA
gacatccagatgacccaaagcccctcctctctgagcgcctccgtgggcgatagagtcacaattacgtgccggtctagccagaacatcgttcactccaatgggaacacctacctcgactggtatcagcagacacctggaaaggctccgaaactgcttatttacaaggtgtctaatcgcttcagcggcgtgccctccagatttagcgggtctggatccggcaccgatttcacatttaccatcagctctctgcaacctgaggacattgccacatattactgtttccagtattcccatgtcccctggacctttgggcagggaacgaaactccagatcacccgggaa

SEQ ID NO: 38824 - RNA, 1320 nt, synthetic construct
  misc_feature 1..1320: note = derived and/or modified sequence opt5 from Nivolumab_HeavyChain1
  source 1..1320: mol_type = other RNA
caggtgcaactggtcgagagcggcgggggagttgtgcagcccggcagatccctccggctggactgcaaggcctctgggatcaccttcagcaactccggaatgcactgggtgcgccaggctcctggcaaagggcttgaatgggtcgccgtgatttggtacgatggatctaagagatattacgcggacagcgttaaaggccggtttacaatctcccgcgataattctaagaacacgctgttcctccagatgaatagcctgagagctgaggacaccgccgtgtattactgtgccacaaacgatgactattggggccaagggacccttgtcacagtgtccagcgcttctaccaaaggaccgtccgtttttcccctggccccttgcagccggtctacatccgaaagcaccgctgccctcggctgtctggtgaaggattacttccccgagcctgtcacggtgtcttggaactccggggcgctgaccagcggagtgcatacatttcccgccgtcctccagtcctctggcctgtatagcctttccagcgttgtgaccgtgccttcttccagcctggggacaaagacctacacgtgcaatgtcgaccacaaaccgtctaatacaaaggtggataaacgcgttgaaagcaagtacggacccccttgtcccccttgccccgctccggagttcctcggcggcccttccgtgtttctgtttccccctaaacccaaggacacccttatgatttctagaacacccgaggtcacctgtgtggttgtggatgtcagccaggaagaccctgaggtgcagttcaactggtatgtcgatggggtggaagttcataatgccaagaccaaaccgcgggaggagcaattcaactccacataccgcgtggtcagcgtgctgacggttctccaccaggactggctgaatggaaaggaatataaatgcaaggtgtctaacaaaggcctgccctccagcatcgagaagaccatttctaaagctaaggggcagcctagagaaccccaggtctacacactccctccctcccaagaggaaatgaccaagaatcaggtgagcctgacatgtcttgtgaaaggattttatccgtccgacatcgccgttgagtgggagtctaacggccagcctgaaaataactacaagaccacgccccctgtcctggatagcgacgggtccttctttctctattctcggctgacagtggataaaagccgctggcaagagggaaacgtgttctcctgcagcgtcatgcatgaagcgcttcacaatcactacacccagaagtctctgtccctcagcctgggcaaa

SEQ ID NO: 38825 - RNA, 642 nt, synthetic construct
  misc_feature 1..642: note = derived and/or modified sequence opt5 from Nivolumab_LightChain1
  source 1..642: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagagctctaattggcctcgcacctttggccaggggacaaaagtggagatcaagagaaccgtggctgccccctccgtcttcatttttcctccgagcgatgaacagctcaaatctggaacggcgtccgtggtttgcctgctgaacaatttctatccccgggaggccaaggtgcaatggaaagtcgacaacgctctccagagcggcaattcccaggagtctgtgaccgaacaggatagcaaggactccacatacagcctgtcttccacccttacactgagcaaggccgattatgagaaacacaaggtttacgcttgtgaagtgacccatcaaggcctctctagccctgtcacgaaatcctttaaccgcggggagtgc

SEQ ID NO: 38826 - RNA, 1347 nt, synthetic construct
  misc_feature 1..1347: note = derived and/or modified sequence opt5 from Obiltoxaximab_HeavyChain1
  source 1..1347: mol_type = other RNA
caggtgcagctgcagcagagcggccccgagctcaagaaacctggggcctccgtcaaggtttcttgcaaagacagcggatacgctttctcctctagctggatgaactgggtgagacaggccccgggccaagggctggaatggatcggacggatttatcccggcgatggggacaccaattacaacggaaagtttcagggccgcgtgacaatcacggcggataaatcctctagcaccgcttatatggagctttccagcctgagatctgaagacacagccgtctacttctgtgcccggtccggcctcctgcgctatgctatggattactgggggcagggaacccttgtgacagttagctctgcctccaccaagggccctagcgtgtttcccctggctccttcttccaagagcacatccgggggaaccgccgcgctcggctgcctggtcaaagactatttccccgagcctgtgacggtttcttggaatagcggggccctgacctccggagtgcacacatttccggctgtcctccagagctctggcctgtactcccttagctctgtggtgaccgtccccagctcctctctgggcacacaaacctacatttgtaacgttaatcataagcctagcaacacgaaagtggataagaaagtggaacccaagtcctgcgacaagacacacacctgtcctccctgcccggcccctgagctcctgggaggacccagcgtcttcctttttcctcccaaacccaaggatacactgatgatctctagaacccctgaggtgacctgtgttgtggtcgacgtgtcccatgaagatccggaggttaaattcaattggtatgtggacggcgtcgaagtgcacaacgctaagacaaaaccccgggaggagcagtacaatagcacgtatcgcgtcgtgtctgttctcaccgtgctgcatcaggattggctgaacgggaaggaatacaaatgcaaggtctccaataaggccctccctgcgcccattgagaaaacaatcagcaaggccaaaggacagcctagagaaccccaagtgtataccctgccgccttcccgggacgagcttacaaagaaccaggtttctctgacctgtctcgtgaaaggcttttaccccagcgacatcgctgtcgaatgggagtccaatgggcagcctgagaacaattataagacgacaccccctgtgctggattctgacgggagcttctttctttactccaagctgaccgtggataaaagccgctggcaacagggcaacgttttctcttgctccgtcatgcacgaagccctccacaaccattacacccaaaagagcctgtctctgtcccccggcaaa

SEQ ID NO: 38827 - RNA, 642 nt, synthetic construct
  misc_feature 1..642: note = derived and/or modified sequence opt5 from Obiltoxaximab_LightChain1
  source 1..642: mol_type = other RNA
gacatccagatgacccaaagcccctcctctctgagcgcctccgtgggcgatagagtcacaattacgtgccgggcttctcaggacatccgcaactacctcaattggtatcagcagaagcctgggaaagccgttaagctgcttatttactataccagcagactgctcccgggagtgccctcccggttctctggcagcgggtccggaacagattacagcctgaccatctcttcccaagagcaggaagacattggcacatatttttgtcagcaggggaacacccttccttggacattcggacaaggcaccaaagtggagatccgcagaacggtcgcggctcccagcgtgtttatcttccctccctctgatgaacagctgaagtccggcaccgccagcgttgtgtgcctcctgaataacttttaccctcgggaggccaaagtccagtggaaggtggacaatgctctgcagtctgggaactcccaagaaagcgttacagagcaggattccaaggactctacctatagcctctccagcacactgaccctttctaaagccgattacgagaagcacaaagtgtacgcttgtgaagtcacgcatcagggactgtccagcccggtgacaaagtctttcaatcgcggcgagtgc

SEQ ID NO: 38828 - RNA, 1347 nt, synthetic construct; identical to SEQ ID NO: 38232
  misc_feature 1..1347: note = derived and/or modified sequence opt5 from Obinutuzumab_HeavyChain1
  source 1..1347: mol_type = other RNA

SEQ ID NO: 38829 - RNA, 657 nt, synthetic construct; identical to SEQ ID NO: 38233
  misc_feature 1..657: note = derived and/or modified sequence opt5 from Obinutuzumab_LightChain1
  source 1..657: mol_type = other RNA

SEQ ID NO: 38830 - RNA, 1350 nt, synthetic construct
  misc_feature 1..1350: note = derived and/or modified sequence opt5 from Ocaratuzumab_HeavyChain1
  source 1..1350: mol_type = other RNA
gaggtgcagctggtccagagcggcgccgaagttaagaaacccggggagtccctcaagatctcttgcaaaggaagcggcagaaccttcacatcctacaacatgcactgggtgcggcagatgcctgggaagggactggaatggatgggcgctatttatccgcttacgggggacacctcttacaatcagaaaagcaagctccaggtgacaatctccgccgataagtctattagcaccgcgtatctgcaatggtccagcctgaaggcttctgacacagccatgtactattgtgcccgctccacctacgtcggaggcgattggcagtttgacgtgtggggcaaggggacaaccgttacggtgagctctgcttccaccaaaggacccagcgtcttccctcttgccccctcttccaagagcacatccggcgggaccgctgccctgggatgcctcgtgaaagattattttcctgagcccgttacagtgtcttggaacagcggcgcgctgacctccggggtccatacgttccctgccgtgctgcagagctctggactctactccctgagctctgtggtcacagttccgagctcctctcttggcacccagacatacatctgtaatgtgaaccacaagcccagcaataccaaggtggacaaaaaggtcgaacctaaatcctgcgataagacccatacatgtcccccttgccccgctccggagctgctcggcgggcctagcgtgtttctgtttccccctaaaattaaggacacgcttatgatctctagaacccccgaggttacatgtgtggtcgtggatgtttcccacgaagaccccgaggtgaaattcaactggtatgtcgatggagtggaagtccataatgccaagaccaagcctcgggaggagcaatacaacagcacatatcgcgtggtttctgtgctgaccgtcctccaccaggactggctgaatggcaaagaatacaagtgcaaagtgtccaacaaggctctgccggcccccatcgagaaaacgattagcaagcagaaggggcagcctagagaaccccaagtttatacactccctccctcccgggatgagctgaccaaaaatcaggtgtctcttacctgtctggtcaagggattctacccgagcgacatcgcggtggaatgggagtccaacggccagcctgagaataactataaaacaacaccccctgtgctcgactctgatgggagctttttcctgtactccaaacttaccgttgacaaaagccgctggcaacagggaaatgtcttttcttgctccgtgatgcacgaagccctgcataaccactacacgcaaaagagcctctctctgtcccccggc

SEQ ID NO: 38831 - RNA, 639 nt, synthetic construct
  misc_feature 1..639: note = derived and/or modified sequence opt5 from Ocaratuzumab_LightChain1
  source 1..639: mol_type = other RNA
gagatcgtgctgacccagagccccggcacactctccctgtctcctggggaaagagccacgcttagctgccgggcttcctctagcgtcccgtacattcactggtatcaacagaagcccggacaggcccctcgcctgctcatctacgcgacctccgctctggcctctggcattcccgacagattcagcgggtccggaagcggcacagattttacccttacaatctctcggctggagcctgaagacttcgccgtttattactgtcagcaatggctctccaatccccctacctttgggcagggaacaaaactggagattaagcgcaccgtggctgccccgagcgtgttcatctttcccccttctgatgaacagctgaaatccggcacggctagcgtcgtgtgcctcctgaacaacttctatcccagagaggccaaggttcagtggaaagtggacaatgcgcttcaatctggcaactcccaggagagcgtcaccgaacaggattccaaggactctacatacagcctgtccagcaccctcacactgtctaaggccgattatgagaaacataaggtgtacgcttgtgaagttacccaccaggggctttccagccctgtgacgaaatcttttaatcggggagagtgc

SEQ ID NO: 38832 - RNA, 1356 nt, synthetic construct
  misc_feature 1..1356: note = derived and/or modified sequence opt5 from Ocrelizumab_HeavyChain1
  source 1..1356: mol_type = other RNA
gaggtgcaactggtcgaaagcggcgggggactcgttcaacccggcgggtccctgagactttcttgcgccgctagcggatacaccttcacatcctataacatgcactgggtgcggcaggcccctggcaaggggctggagtgggtgggagcgatctacccgggcaatggcgacacgtcttataaccagaaatttaaggggcgcttcaccattagcgtcgataaatccaagaatacactctacctgcagatgaactctcttagagctgaagacaccgccgtgtattactgtgcccgggttgtgtattacagcaattcctactggtattttgatgtctggggacaaggcacactggtgaccgttagctctgcttccacaaaagggcccagcgtgttccctctcgccccctcttccaagagcacctctggaggcacggctgccctggggtgcctggtcaaggactactttcctgagcccgtgaccgtgtcctggaacagcggagcgctcacatccggcgtccataccttccctgccgttctgcagtctagcggcctttattccctgagctctgtggtgacagtcccgtccagctctctcgggacccagacgtacatctgtaatgtgaaccacaaacccagcaatacaaaggttgataaaaaggtggaacctaaatcctgcgacaagacccatacatgtcccccttgccccgctccggagctgcttggaggcccttctgtctttctgtttccccctaagcccaaagataccctcatgattagccgcacccccgaggtgacatgtgttgtggtcgacgtgtcccacgaagatcctgaggtcaagttcaactggtatgtggacggggttgaagtgcataatgccaaaacgaagccgagagaggagcagtacaacagcacctatcgggtcgtgtctgttctgacagtgctgcaccaagattggctcaatggaaaagaatacaagtgcaaagtctccaacaaggctctgcccgcccctatcgagaagaccattagcaaagcgaagggccagccccgcgaacctcaggtgtacacacttcccccgtctagagaggaaatgaccaaaaatcaggtgtccctgacgtgtctcgttaaggggttctatcctagcgacatcgccgtcgagtgggagtccaacggacaacccgaaaacaattacaaaacaacccctcccgtgctggattctgacggcagctttttcctttattccaagctgaccgtggacaagtctcggtggcagcagggcaacgtctttagctgctccgtgatgcacgaggctctccataatcactacacacagaaaagcctgtctctgtcccctgggaag

SEQ ID NO: 38833 - RNA, 639 nt, synthetic construct
  misc_feature 1..639: note = derived and/or modified sequence opt5 from Ocrelizumab_LightChain1
  source 1..639: mol_type = other RNA
gacatccagatgacccaaagccccagctctctgagcgcctccgtgggcgatagagtcacaattacgtgccgggcttctagctccgtttcttacatgcactggtatcagcagaagcctgggaaagccccgaagcccctcatctacgcgcctagcaacctggcttccggagtgcccagccgcttctctggctccgggagcggaaccgactttacacttaccatttcttccctgcagcctgaggatttcgccacatattactgtcaacagtggagctttaatccccctaccttcggccaggggacaaaagtggaaatcaagagaaccgtcgccgctccgtctgtgtttatttttcccccttccgacgagcagctcaaaagcggaacggcctccgttgtgtgcctgcttaacaatttctatccccgggaagctaaggtccaatggaaggtggataacgccctgcagtctggcaatagccaggagtccgttaccgaacaggacagcaaagattctacatactccctcagctctaccctgacactgagcaaggcggactatgagaaacataaggtgtacgcctgtgaggtcacccaccaaggcctctcctctcctgtgacgaaatccttcaaccgcggggaatgc

SEQ ID NO: 38834 - RNA, 1356 nt, synthetic construct
  misc_feature 1..1356: note = derived and/or modified sequence opt5 from Ofatumumab_HeavyChain1
  source 1..1356: mol_type = other RNA
gaggtgcagctggtcgaaagcggcgggggactcgttcaacccggcagatccctgcggctttcttgcgccgctagcgggttcacctttaacgactacgccatgcactgggtgcgccaggcgcctggaaagggcctggagtgggtgtccacaatctcttggaatagcgggtccattggatatgctgattctgtcaaaggcagattcacgatcagccgggacaacgccaagaaatccctctacctgcagatgaatagccttcgcgccgaagataccgctctgtattactgtgccaaggacattcagtatggcaactactattacgggatggatgtgtggggacaaggcacaaccgttacagtgtcttccgctagcaccaaagggccgtctgtctttcccctcgccccttccagcaagtctacatccggaggcaccgcggccctggggtgcctggtgaaggactacttccccgagcctgttacggtgagctggaactccggagctctcacctctggcgtccatacatttcccgccgtgctgcagagctccggcctttatagcctgtcttccgtggtcaccgttcctagctctagcctcgggacacagacctacatctgtaatgtgaatcacaaaccgtccaacacgaaggtggataaaagagtcgaacccaagtcttgcgacaaaacacatacctgtcctccctgccctgctcccgagctgcttggaggcccgagcgtgttcctgtttcctcccaagcctaaggatacactcatgatttcccggacccccgaggttacctgtgtggtcgtggacgttagccacgaagatcccgaggtgaaattcaattggtatgtcgacggggtggaagtccataacgccaagacaaaacctcgcgaggagcagtacaattctacgtatagagtggtttccgtgctgaccgtcctgcaccaagattggctcaacggaaaggaatacaaatgcaaggtgagcaataaagcgctgccggcccccatcgagaagacaatctctaaggctaaaggccagcctcgggaaccccaggtttatacccttcctccctcccgcgaggaaatgacaaagaaccaggtgagcctgacctgtctcgtcaaagggttttacccgtccgacattgccgtggagtgggagtctaatggacaacctgaaaacaactacaagacgacaccccctgtgctggacagcgatggctccttctttctttattctaaactgaccgttgacaagagcagatggcagcagggcaatgtcttctcctgcagcgtgatgcacgaggctctccataaccactacacccaaaagtctctgtccctgagccccgggaaa

SEQ ID NO: 38835 - RNA, 642 nt, synthetic construct
  misc_feature 1..642: note = derived and/or modified sequence opt5 from Ofatumumab_LightChain1
  source 1..642: mol_type = other RNA
gagatcgtgctgacgcagagccccgccacactctccctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctatcacctttggccaggggacaagactcgagattaaacggaccgtggctgccccctctgtgttcatctttcctccgtccgatgaacagctcaagagcggaacggcgtctgtcgtgtgcctgctgaacaatttctatccccgcgaggccaaagttcaatggaaggtggacaacgctctgcagtccggcaatagccaggagtccgtcaccgaacaggattctaaagacagcacatactcccttagctctaccctgacactctccaaggccgattatgagaagcacaaagtgtacgcttgtgaagttacccatcaaggcctgagctctcctgtgaccaagagctttaacagaggggagtgc

SEQ ID NO: 38836 - RNA, 1371 nt, synthetic construct
  misc_feature 1..1371: note = derived and/or modified sequence opt5 from Olaratumab_HeavyChain1
  source 1..1371: mol_type = other RNA
cagctgcaactccaggagagcggccccgggctggtgaagccttccgaaaccctttctctgacatgcacggtcagcggaggctccatcaactctagctcctactattgggggtggctcagacagtctccgggaaaaggcctggagtggattgggagcttcttttacaccggatccacatattacaatcccagccttcggtctcgcctgaccatctccgttgacacaagcaagaaccagttctctctcatgctgtccagcgtgaccgccgctgatacagccgtgtattactgtgcgagacaatctacctattactacggctccggcaattattacgggtggtttgaccggtgggatcagggaacgctggtcaccgtgagctccgcttctacaaaaggccctagcgttttccccctcgccccttccagcaagtctacctccgggggaacagccgctctgggctgccttgtgaaagactattttcccgaacctgtcaccgtgagctggaactctggggccctgacgagcggagttcacacattcccggctgtgctccagtcctctggcctgtacagcctttccagcgtcgtgaccgtgccctcttccagcctgggcacacagacctatatttgtaatgtcaaccataagccttctaataccaaggttgataaacgcgtggagcccaagtcctgcgacaaaacacacacgtgtcctccctgcccggcccctgaactcctcgggggacccagcgtgtttctgttccctcccaagcccaaagataccctgatgatctccagaacacctgaggtcacctgtgtggttgtggacgtctctcatgaggatccggaagtgaagtttaactggtacgttgacggcgtggaggtccacaatgcgaagacaaaaccccgggaggaacaatataacagcacctaccgcgtggtctccgtgctgacggttcttcatcaggattggctgaatgggaaggagtacaaatgcaaggtgtctaacaaagccctccctgctcccattgaaaagacaatcagcaaagccaagggacagcctagagagccccaggtctataccctgccgccttcccgggaagagatgaccaagaatcaagtgagccttacatgtctggttaaaggcttctacccctctgacatcgctgtggaatgggagtccaacgggcagcctgagaataactataagaccacaccccctgtcctcgatagcgacggatcctttttcctgtactctaaactgacggtggacaagagccgctggcagcaaggcaacgtgttttcttgcagcgttatgcacgaagccctccacaatcattatacccagaaatccctgagcctttctcccggcaag

SEQ ID NO: 38837 - RNA, 642 nt, synthetic construct
  misc_feature 1..642: note = derived and/or modified sequence opt5 from Olaratumab_LightChain1
  source 1..642: mol_type = other RNA
gagatcgtgctgacccagagccccgccacactctccctgtctcctggcgaaagagctacgcttagctgccgggcctcccaatctgtcagctcctacctggcgtggtatcagcagaaaccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctcccgcttttggccaggggaccaaagtggagatcaagagaacagtggccgcgccttctgtcttcatttttccgccctccgatgaacagctcaaaagcggaaccgcctctgtggtttgcctgctgaacaatttctatcctcgggaggctaaggtgcaatggaaagtcgacaacgccctccagtccggcaatagccaggagtccgtgacggaacaggattctaaggacagcacctactccctgagctctacacttaccctgtccaaggctgattatgagaaacacaaggtttacgcctgtgaagtgacacatcaaggcctcagctctcccgtcaccaagagctttaaccgcggggagtgc

SEQ ID NO: 38838 - RNA, 1341 nt, synthetic construct
  misc_feature 1..1341: note = derived and/or modified sequence opt5 from Olizuab_HeavyChain1
  source 1..1341: mol_type = other RNA
gaggtgcagctggtcgaaagcggcgggggactcgttcagcccggcgggtccctgagactttcttgcgccgtgagcggatactccatcacctctggctatagctggaactggattcggcaggctcctgggaagggactggagtgggtggcctccatcacatacgacggctctacgaattataacccgagcgtcaaaggccgcattaccatctccagagatgacagcaagaatacattctacctccagaactctctgcgggcggaagataccgctgtgtattactgtgcccgcgggtcccactattttggacattggcacttcgccgtttggggccaggggacacttgtgaccgtcagctctgcttccacaaaaggacccagcgtgtttcctctggccccctcttccaagagcacctccggcgggacggctgccctcggatgcctggttaaagactacttccctgagcccgtgaccgtctcttggaatagcggcgcgctgacatccggcgtgcatacctttcctgccgtgctccaaagctctgggctgtactcccttagctctgtcgttacagtgccgagctcctctctgggaacccagacgtatatttgtaacgtgaatcacaagcccagcaacacaaaggtcgataaaaaggtggaacctaaatcctgcgacaagacccatacatgtcccccttgccccgctccggagctcctgggcgggcctagcgttttcctttttccccctaaacccaaggataccctgatctctagaacccccgaggtgacatgtgtcgtggttgacgtgtcccacgaagatcctgaggtcaagttcaattggtacgtggacggagtcgaagtgcacaacgccaaaacgaagccgcgggaggagcagtataatagcacctaccgcgttgtgtctgtcctcacagtgctgcatcaggattggctgaacggcaaagaatataagtgcaaagtttccaataaggctctccccgcccctatcgagaaaaccattagcaaggcgaaggggcaacccagagaacctcaggtgtacacactgcccccgtcccgggaggaaaccaaaaaccaggtctctcttacgtgtctggtgaagggattttatcctagcgacatcgccgtggagtgggagtccaatggccagcccgaaaacaactacaaaacaacccctcccgttctcgattctgacggcagcttctttctgtactccaaacttaccgtcgacaagagccgctggcaacaggggaatgtgttctcttgctccgtgcacgaggctctgcataaccactatacacaaaagagcctctctctgtcccctggaaag

SEQ ID NO: 38839 - RNA, 651 nt, synthetic construct
  misc_feature 1..651: note = derived and/or modified sequence opt5 from Olizuab_LightChain1
  source 1..651: mol_type = other RNA
gacatccagctgacccaaagcccctcctctctcagcgcctccgtgggcgatagagtcacaattacgtgccgggcttctcagagcgttgactacgatggggactcctataactggtaccagcagaagcctggaaaagccccgaagctgcttatctatgcggcttcttacctggagagcggcgtgccctcccgcttcagcgggtctggatccggcaccgattttacactcaccattagctctctgcaacctgaagacttcgccacatattactgtcagcagtcccacgaggatccctatacctttgggcagggaacaaaagtggaaatcaagagaaccgtcgccgctcctagcgtgttcatttttcccccttctgacgagcaacttaaatccggcacggccagcgttgtgtgcctgctcaataacttctacccgcgggaagctaaggtccagtggaaggtggataatgccctgcagtccggcaactctcaggagagcgttaccgagcaagactccaaagatagcacatactctctgtccagcaccctcacactgtctaaggcggactatgaaaaacataaggtgtacgcctgtgaggtcacccaccaggggcttagctcccccgtgacgaaatcttttaatcgcggagaatgc

SEQ ID NO: 38840 - RNA, 1341 nt, synthetic construct
  misc_feature 1..1341: note = derived and/or modified sequence opt5 from Olokizumab_HeavyChain1
  source 1..1341: mol_type = other RNA
gaggtgcagctggtcgaaagcggcgggggactcgttcaacccggcgggtccctgagactttcttgcgccgctagcggattcaactttaatgactacttcatgaactgggtgcggcaggcccctggcaaggggctggagtgggtggcgcagatgcgcaataaaaactatcagtacggaacctattacgctgaatccctcgagggcagatttacaatctctcgggatgacagcaaaaattccctgtatcttcaaatgaactctctgaagacggaagataccgccgtctactattgtgcccgcgagagctactacggcttcacatcctattgggggcagggaaccctcgtgacagttagctctgcttccaccaagggcccgagcgtgtttcccctggccccttgctctagatccacaagcgagtctaccgctgccctggggtgtctcgtcaaagactacttccccgaacctgtgacggtttcctggaatagcggagcgctgacctccggcgtgcacacatttcccgccgtccttcagtctagcgggctgtattccctcagctctgtggtgaccgtcccttccagctctctgggaacaaagacctacacgtgcaacgttgatcataagccgagcaatacaaaagtggacaagcgggtggagtccaaatatgggcccccttgtcccccttgccccgctccggagttccttggcggcccttctgtctttctgtttccccctaagcccaaagataccctcatgattagccgcacacccgaggtgacctgtgttgtggtcgacgtgtcccaggaggatcctgaagttcaattcaactggtacgtggacggagtcgaggtgcacaatgccaagaccaagccgagagaagaacagttcaacagcacatatcgggtcgtgtctgttctgacggtgctgcatcaggattggctcaatggcaaagaatacaagtgcaaagtctccaacaaggggctgcccagctctatcgagaaaaccatttccaaggctaaaggacagcctcgcgagccccaagtgtacacacttcctcccagccaggaagagatgaccaagaatcaggtttccctgacatgtctcgtgaagggcttttatccgtctgacatcgccgtcgaatgggagagcaacgggcaacctgaaaacaattacaaaaccacgccccctgtgctggattccgacggatctttcttcctttatagcagactgacagtggacaagtcccggtggcaggagggcaacgtttttagctgctctgtcatgcacgaggcgctccataatcactacacccagaaatccctgagcctgtctctcggcaag

SEQ ID NO: 38841 - RNA, 642 nt, synthetic construct
  misc_feature 1..642: note = derived and/or modified sequence opt5 from Olokizumab_LightChain1
  source 1..642: mol_type = other RNA
gacatccagatgacccaaagccccagctctctgagcgcctccgtgggcgatagagtcacaattacgtgccaggcttctcaggacatcgggattagcctctcctggtaccagcaaaagcctggaaaagccccgaagctgcttatctataacgcgaataacctggctgatggcgttccctctcggttcagcgggtccggaagcggcaccgactttacactcaccatttcttccctgcagcctgaggatttcgccacatactattgtcttcagcacaatagcgccccctacacctttgggcagggaacaaaactggaaatcaagcgcaccgtggctgccccttctgtgttcatctttcccccttccgacgagcaactcaaaagcggcacggcttctgtcgtgtgcctgctgaacaatttctatccgagagaagccaaggttcagtggaaggtggataacgcgctccagtccggcaatagccaggagtccgtcaccgaacaagactctaaagatagcacatactccctgagctctacccttacactgtccaaggccgactatgagaaacataaggtgtacgcttgtgaggttacccaccaggggctcagctctcccgtgacgaaatcctttaaccggggagaatgc

SEQ ID NO: 38842 - RNA, 1341 nt, synthetic construct
  misc_feature 1..1341: note = derived and/or modified sequence opt5 from Omalizumab_HeavyChain
  source 1..1341: mol_type = other RNA
gaggtgcagctggtcgaaagcggcgggggactcgttcaacccggcgggtccctgagactttcttgcgccgtgagcggatactccatcacctctggctatagctggaactggattcggcaggctcctgggaagggactggagtgggtggcctccatcacatacgacggctctacgaattatgcggatagcgtcaaaggccgcttcaccatttccagagacgatagcaagaacacattttacctccagatgaactctctgcgggctgaagacaccgccgtgtattactgtgcccgcgggtcccactatttcggacattggcactttgctgtttggggccaggggacacttgtgaccgtcagctctggaccgtccgtgttccccctggcccctagctctaaatccacaagcggcgggaccgctgccctcggatgcctggttaaggattactttcccgagcctgtgacggtctcctggaactctggcgcgctgaccagcggcgtgcatacattccccgccgtgctccaatccagcgggctgtactctctttccagcgtcgttaccgtgccttctagctccctgggaacacagacctatatctgtaatgtgaatcacaaaccgtctaatacgaaggtcgacaagaaagctgaacccaagagctgcgataaaacacatacctgtcctccctgccctgcccccgagctcctgggcgggccgtccgtgtttcttttccctcccaagcctaaagacacactgatgattagcagaacccccgaggttacctgtgtggtcgtggatgtttctcacgaagaccccgaggtgaagtttaactggtacgtcgatggagtggaagtccacaatgctaagacaaaacctcgggaggagcagtataactccacgtaccgcgtggttagcgtgctcaccgtcctgcatcaggactggctgaatggcaaggaatataaatgcaaggtgtctaacaaagccctcccggcgcccatcgagaagacaatctccaaagccaaggggcaacctagagaaccccaggtttacaccctgcctcccagccgggatgagcttacaaagaatcaggtgtccctgacctgtctcgtcaaaggattctatccgtctgacattgctgtggaatgggagagcaacggccagcctgagaataactacaagacgacaccccctgtgctggactccgatggcagctttttcctttactctaaactgaccgttgacaagtcccgctggcaacaggggaacgtctttagctgctctgtgatgcacgaagccctccataatcactatacccagaaatccctgagcctgtctcccggaaag

SEQ ID NO: 38843 - RNA, 645 nt, synthetic construct
  misc_feature 1..645: note = derived and/or modified sequence opt5 from Omalizumab_LightChain
  source 1..645: mol_type = other RNA
gacatccagctgacccaaagcccctcctctctcagcgcctccgtgggcgatagagtcacaattacgtgccgggcttctcagagcgttgactacgatggggactcctatatgaactggtaccagcagaagcctggaaaagccccgaagctgcttatctatgcggcttcttacctggagagcggcgtgccctcccgcttcagcgggtctggatccggcaccgattttacactcaccattagctctctgcaacctgaagacttcgccacatattactgtcagcagtcccacgaggatccctatacctttgggcagggaacaaaagtggaaatcaagagaaccgtcgccgctcctagcgtgttcatttttcccccttctgacgagcaacttaaatccggcacggccagcgttgtgtgcctgctcaataacttctacccgcgggaagctaaggtccagtggaaggtggataatgccctgcagtccggcaactctcaggagagcgttaccgagcaagactccaaagatagcacatactctctgtccagcaccctcacactgtctaaggcggactatgaaaaacataaggtgtacgcctgtgaggtcacccaccaggggcttagctcccccgtgacgaaatcttttaatcgc

SEQ ID NO: 38844 - RNA, 1347 nt, synthetic construct
  misc_feature 1..1347: note = derived and/or modified sequence opt5 from Onartuzumab_HeavyChain1
  source 1..1347: mol_type = other RNA
gaggtgcagctggtcgaaagcggcgggggactcgttcaacccggcgggtccctgagactttcttgcgccgctagcggatacaccttcacatcctattggctgcactgggtgcggcaggcccctggcaaggggctcgagtgggtgggaatgatcgacccgtctaacagcgatacgcgctttaatcccaacttcaaagacagatttaccatttccgcggatacatctaagaataccgcttacctgcagatgaacagccttcgggccgaagacacagccgtctattactgtgctacctatcgctcctacgtgacacctctggattattggggccagggcaccctcgttacggtgagctctgcctccaccaaagggcccagcgtcttccctctggctccctcttccaagagcacatctggaggcaccgccgcgctggggtgcctcgtgaaagactactttcctgagccggttacagtgtcctggaatagcggagccctgacctccggcgtccatacgttccccgctgtgcttcaatctagcgggctgtactccctcagctctgtggtcacagttccttccagctctctgggaacccagacatatatctgtaacgtgaatcacaagcccagcaacaccaaggtggataaaaaggtcgaacctaaatcctgcgacaagacccatacatgtcccccgtgccctgcccccgagcttctgggcggcccttctgtgtttctcttccctcccaaacccaaggatacgctgatgattagcagaaccccggaggttacatgtgtggtcgtggacgtttcccacgaagatcccgaggtgaagtttaattggtacgtcgacggggtggaagtccataacgctaaaaccaagcctcgggaggagcagtataatagcacataccgcgtggtttctgtgctgaccgtcctccaccaggattggctgaacggaaaagaatataagtgcaaagtgtccaataaggcccttcccgcgcctatcgagaaaacgattagcaaggccaagggccaacccagagaaccgcaggtttacacactgcctccctctcgggaggaaatgaccaaaaaccaggtgtccctcagctgtgctgtcaaggggttctatccttccgacatcgccgtggagtgggagtctaatggacagcccgaaaacaactacaaaaccacacctcccgtgctggacagcgatggctcctttttccttgtttctaagctgaccgtcgacaaaagccgctggcaacaggggaatgtgttttcctgcagcgtgatgcacgaggctctccataaccactacacacagaagtctctgtccctgagcccgggaaag

SEQ ID NO: 38845 - RNA, 681 nt, synthetic construct
  misc_feature 1..681: note = derived and/or modified sequence opt5 from Onartuzumab_HeavyChain2
  source 1..681: mol_type = other RNA
gacaagacccacacatgtcccccttgcccggcccccgagctgctcggcgggcctagcgtgttcctgtttccccctaaacccaaggatacgcttatgatctccagaacccctgaagtcacatgcgttgtggtggacgtctctcatgaggatccggaagtgaaattcaactggtacgttgacggagtggaggtccacaatgctaagaccaaaccccgggaagaacagtataacagcacataccgcgtggtttccgtgctgaccgtcctccatcaggattggctgaatggcaaggagtataagtgtaaagtgtctaacaaggcccttcctgcgcccattgagaaaacaatcagcaaggctaaagggcagcctagagagccccaggtgtacaccctgccgccttcccgggaagagatgacgaagaatcaggtctctctctggtgcctggttaagggattttatcccagcgacattgccgtggagtgggaatccaacggccaacctgagaataactacaaaaccacacctcccgtgctggatagcgacgggtctttctttctctattccaagctgaccgtcgataaaagccgctggcagcagggaaatgtgttctcttgttccgttatgcacgaagcccttcataaccactacacacaaaagagcctgtctctctcccccggcaaa

SEQ ID NO: 38846 - RNA, 660 nt, synthetic construct
  misc_feature 1..660: note = derived and/or modified sequence opt5 from Onartuzumab_LightChain1
  source 1..660: mol_type = other RNA
gacatccagatgacccaaagcccctcctctctgagcgcctccgtgggcgatagagtcacaattacgtgcaagtctagccagtccctcctgtacacctctagccagaaaaactatcttgcttggtaccagcaaaagcctgggaaagccccgaagctgctcatctattgggcgtccacacgggagagcggagttccctctcgcttctccggcagcgggtctggaaccgactttacactgaccatttccagccttcagcctgaagatttcgctacatactattgtcagcagtactatgcctacccctggacctttggccaagggacgaaagtggagatcaagagaaccgtggccgctccttctgtcttcatttttcccccttccgacgaacagctcaagagcggaacagcctccgtggtttgcctgctgaataacttctacccgcgggaggctaaagtgcagtggaaggtcgataatgccctgcagtctggcaacagccaagaatccgtgaccgagcaggacagcaaagattctacatattccctcagctctaccctgacgcttagcaaggcggactacgagaaacacaaggtttatgcctgtgaagtgacacatcagggcctgtcctctcccgtcaccaagagctttaatcgcggggagtgc

SEQ ID NO: 38847 - RNA, 1362 nt, synthetic construct
  misc_feature 1..1362: note = derived and/or modified sequence opt5 from Ontuxizumab_HeavyChain1
  source 1..1362: mol_type = other RNA
caggtgcaactgcaggagagcggccccgggctcgtcagaccttcccagaccctgtctcttacatgcacggccagcggatacaccttcacagactatgttatccactgggtgaagcagccgcccggccgggggctggaatggattggatacatcaacccttatgatgacgataccacatacaatcaaaaatttaagggccgcgtgaccatgctcgtcgacacatcctctaacaccgcttatctgagacttagctccgtgacggccgaggataccgcggtttactattgtgctcggcgcggaaattcttacgacgggtacttcgattatagcatggactactggggctccggcacacccgtgaccgtcagctctgcctccacaaaagggcctagcgtgtttcccctggccccttcttccaagagcacctctggaggcacggctgccctcgggtgcctggttaaagattatttcccggaacccgtgacagtctcctggaacagcggagctctgacctccggcgtgcatacatttcctgccgtgctccagtctagcgggctgtactcccttagctctgtcgttaccgtgccctccagctctctgggaacccagacatatatttgtaatgtgaaccacaagcctagcaatacgaaggtcgacaaaaaggtggagcccaaatcctgcgataagacccatacatgtccgccttgccccgcgcctgaactcctgggcggcccctctgttttcctttttccccctaaaccgaaggacaccctgatgatcagcagaacacccgaggtgacctgtgtcgtggttgatgtgtcccacgaggaccctgaagtcaagttcaactggtacgtggacggggtcgaggtgcataatgccaaaacgaagccccgggaagaacagtataacagcacataccgcgttgtgtctgtcctcaccgtgctgcaccaagattggctgaatggaaaagagtacaagtgcaaagtttccaacaaggctctccctgcccccattgagaaaaccatcagcaaggctaagggccagccgagagagcctcaggtgtatacactgcccccttctcgggacgaacttaccaaaaatcaggtctccctgacatgtctcgtgaaggggttttaccccagcgatatcgccgtggagtgggaatccaacggacaacctgagaataactataaaacgacacccccggttctggactctgatggcttctttttcctttacagcaagctgaccgtcgacaaatcccgctggcagcaggggaacgtgttttcttgcagcgtgatgcacgaggcgctccataatcactatacccaaaagtccctgagcctgtctcctggaaag

SEQ ID NO: 38848 - RNA, 645 nt, synthetic construct
  misc_feature 1..645: note = derived and/or modified sequence opt5 from Ontuxizumab_LightChain1
  source 1..645: mol_type = other RNA
gacatccagatgacccaaagcccctcctctctgagcgcctccgtgggcgatagagtcacaattacgtgccgggcttctcagaacgttgggaccgccgtggcgtggctccagcagacacctggaaaggctccgaaactgcttatctacagcgcctccaatcgctataccggcgtgccctctagattcagcgggtccggaagcggcacagactacacctttacaatttcttccctgcaacctgaggatatcgccacctattactgtcagcagtatacgaactaccccatgtataccttcgggcagggaacaaaggtccaaattaaacggaccgtggctgcccctagcgtttttatctttcccccttctgacgaacagctcaagtccggcacagctagcgtggtctgcctgcttaataacttctacccgcgcgaggccaaagtgcagtggaaggttgataatgcgctgcagtctggcaactcccaagaaagcgtgaccgagcaggactccaaggattctacgtacagcctctccagcacactgaccctgtctaaagccgactatgaaaagcacaaagtctacgcttgtgaggtgacacatcaggggctctccagccccgtgaccaagtctttcaatagaggagagtgc

SEQ ID NO: 38849 - RNA, 1341 nt, synthetic construct
  misc_feature 1..1341: note = derived and/or modified sequence opt5 from Opicinumab_HeavyChain1
  source 1..1341: mol_type = other RNA
gaggtgcagctgctcgaaagcggcgggggactggtccagcccggcgggtcccttagactgtcttgcgccgctagcggattcaccttttccgcctacgagatgaagtgggttcggcaggcgcctggcaaagggctcgaatgggtgtctgtgatcggaccgagcggcggcttcacattttatgctgactccgtcaaggggcgcttcacgatttctagagataacagcaaaaataccctgtaccttcagatgaactccctgcgggccgaggacacagccgtgtattactgtgctaccgaaggagataatgacgcctttgatatctggggccaggggacaaccgttacagtgagctctgcttccaccaagggacccagcgtcttccctctcgccccctcttccaaaagcacgtctggcgggaccgcggccctgggatgcctggtgaaggactattttcctgagcccgttacagtgtcctggaacagcggcgctctcacctccggcgtccacacattccctgccgtgctgcaatctagcgggctttactccctgagctctgtggtcaccgttccgtccagctctctcggaacgcagacatatatttgtaatgtgaaccataagcccagcaataccaaagtggataagaaagtcgagcctaagtcctgcgacaaaacacacacctgtcccccttgccccgctccggaactgcttggcgggccttctgtgtttctgtttccccctaagcccaaggataccctcatgatcagccgcacacccgaggttacgtgtgtggtcgtggacgtttcccatgaagatcctgaggtgaaattcaactggtacgtcgacggagtggaggtccacaatgccaagaccaaaccgagagaggaacagtacaacagcgcgtatcgggtggtttctgtgctgacagtcctgcatcaggattggctcaatggcaaggaatacaaatgcaaggtgtccaacaaagccctgcccgctcctattgagaagaccatcagcaaggccaaagggcaaccccgcgaacctcaggtttatacacttcccccgtctagagacgagctgaccaagaatcaggtgtccctcacgtgtctggtcaaaggattctaccctagcgacatcgctgtggagtgggaatccaacggccagcccgagaataactataagacaacccctcccgtgcttgattctgacggcagctttttcctgtactccaaactcaccgttgataagtctcggtggcaacaggggaacgtcttcagctgctccgtgatgcacgaagccctgcacaatcattatacacaaaagagcctgtctctctcccctgga

SEQ ID NO: 38850 - RNA, 645 nt, synthetic construct
  misc_feature 1..645: note = derived and/or modified sequence opt5 from Opicinumab_LightChain1
  source 1..645: mol_type = other RNA
gacatccagatgacccaaagccccgccacactgagcctctctcctggcgagagagctacgctgagctgccgggcctcccagtctgtgagctcctaccttgcgtggtatcagcagaagccggggcaagctccccgcctgctcatttacgatgcctctaacagagccaccggaatccctgctcggttcagcggctccgggagcggaacagactttaccctgacaatttcttcccttgaacccgaggatttcgccgtctattactgtcagcagcgcagcaattggcctatgtatacctttggccaggggacaaaactggaaatcaagagaaccgttgctgccccctctgtgttcatttttcctccgtccgacgagcaactcaaaagcggaacggcgtctgtggtctgcctgctgaacaatttctacccccgggaagccaaggtgcagtggaaagttgataacgctctccagtccggcaatagccaggagtccgtgaccgagcaagactctaaggatagcacatattccctgagctctacccttacactgtccaaggccgactacgaaaaacacaaggtctacgcttgtgaggtgacccatcagggcctcagctctcctgttacgaaatcctttaaccgcggggaatgc

SEQ ID NO: 38851 - RNA, 1941 nt, synthetic construct
  misc_feature 1..1941: note = derived and/or modified sequence opt5 from Oportuzumab_monatox_HeavyChain1
  source 1..1941: mol_type = other RNA
caccatcaccatcaccatgacatccagatgacccaaagcccctcctctctgagcgcctccgtgggcgatagagtgacaattacgtgccggtctaccaagagcctcctgcactccaacgggatcacatacctttattggtaccagcagaaacctggaaaggctccgaaactgctcatttatcagatgtctaatctggccagcggcgttccctcccgcttctctagctccgggagcggaaccgactttacacttaccatctcttccctgcaacctgaggatttcgcgacatactattgtgctcagaacctcgaaattcccagaacctttggccaggggacgaaggtggagctgaaacgggccacccctagccacaattctcatcaggtgccctccgccggaggccctacagctaacagcggcacctccgggtctgaagtccaactggtgcagagcggaccgggcctcgttcagcccgggggatccgtgcgcatcagctgcgccgcttctggctacacattcaccaattatgggatgaactgggtcaagcaggcccctggaaagggcctggagtggatgggctggatcaatacgtacacaggggaatccacctacgcggacagctttaaaggaagattcacattttctcttgataccagcgcctccgctgcctatctgcaaattaactctctccgggctgaggacaccgccgtgtactattgtgcgcgcttcgccatcaagggcgattactgggggcagggaacactgcttacggttagctccgagtttggcggggctcccgagttccctaaacccagcaccccgcctggatcttccggcctggagggcgggagcctcgccgctctgacagcccaccaggcctgccatctgcccctcgaaacctttacaagacaccggcaacctcgcggatgggagcagctggagcagtgtggctatcccgtgcagagacttgtcgctctgtacctcgcggcccggctgtcttggaatcaagtggaccaggtgattcgcaacgctcttgcctcccccgggagcggaggcgatctgggggaagccatcagagagcagcctgaacaggctcggctcgccctgaccctggcggctgccgagtccgaacgcttcgtcagacaaggcacgggaaatgacgaggccggcgctgcctctgctgatgttgtgagcctcacatgcccggtggccgcgggggagtgtgccggacccgctgactccggcgatgccctgcttgaacggaactatcctaccggggctgagtttctgggagacggcggggacgtctctttcagcaccagaggcacacagaattggaccgtggaacgcctcctgcaggcccaccggcagcttgaggaaagaggatacgttttcgtgggctaccatgggacatttctggaggcggcccaatccattgtcttcggaggcgtgcgcgctcggagccaggatctcgacgccatctggagagggttttatattgctggagatcccgccctggcctacggctatgctcaggaccaggagcctgatgcgcgcgggcggatcagaaacggcgccctgctccgcgtttacgtgccccggtcttccctgccgggattctatagaacgggccttaccctggctgcccctgaagccgctggggaggtcgaacgcctcatcggacaccccctgcctctgcggcttgacgccattacaggccccgaggaagaagggggaagactcgagaccatcctgggctggcctctggcggaacggacagtggtcattcccagcgctatcccgaccgatcctcgcaatgtcgggggcgacctcgatccctcttccattcccgacaaggagcaagccatcagcgccctgcctgattacgcttctcagccgggaaaaccccctcatcaccatcaccaccataaggacgaactt

SEQ ID NO: 38852 - RNA, 1941 nt, synthetic construct; identical to SEQ ID NO: 38851
  misc_feature 1..1941: note = derived and/or modified sequence opt5 from Oportuzumab_monatox_SingleChain_variable_fragment
  source 1..1941: mol_type = other RNA

SEQ ID NO: 38853 - RNA, 762 nt, synthetic construct
  misc_feature 1..762: note = derived and/or modified sequence opt5 from Oreptacog_alfa_HeavyChain1
  source 1..762: mol_type = other RNA
atcgtgggcgggaaggtctgccccaagggagagtgtccttggcaggttctgctcctggtgaacggcgcccaactttgcgggggaaccctgattaatacaatctgggtggtcagcgctgcccactgtttcgacaagattaaaaactggagaaatctcatcgcggtgctgggcgaacatgatctttccgagcacgacggggatgaacagtctcggcgcgttgctcaggtgattatcccgagcacgtacgtccccggaaccacaaaccatgacatcgccctgctcagactgcaccagcctgtgaatctgaccgatcatgttgtgcccctctgcctgcctgagcggacattttccgaacgcacccttgccttcgtcagattttctctggtgagcggctggggccaactcctggaccgcggggctacagcccttgagctgatggtgctcaacgtcccccggctgatgacccaggattgtctgcagcagtccagaaaggttggagactctcctaatattacggagtatatgttctgcgctggctacagcgatgggtccaaagacagctgtaagggagattctggcgggccgcacgccacccactatcggggaacatggtacctcaccggcatcgtgtcctggggccaagggtgcgcgacagtgggacattttggcgtctatacccgcgtgagccagtacattgaatggctgcagaaacttatgagatctgagccccggcctggggttctgctccgcgcccccttccct

SEQ ID NO: 38854 - RNA, 456 nt, synthetic construct
  misc_feature 1..456: note = derived and/or modified sequence opt5 from Oreptacog_alfa_LightChain1
  source 1..456: mol_type = other RNA
gccaacgctttcctggaggaactcagacagggcagcctggagcgggaatgcaaggaggaacaatgttcctttgaggaggcccgcgaaatcttcgaggacgaagaggagaccaaactgttttggatttcttacagcgatggggaccagtgcgcgtcctctccctgtcagaatggaggcagctgcaaggatcagcttcaatcctatatctgtttctgcctccctgcttttgaagggagaaactgtgagacacacaaagacgatcagctgatttgcgtgaatgaaaacggaggctgtgagcagtactgctctgaccataatgggacgaagcggagctgtcgctgccacgaaggatattcccttctggccgatggcgtcagctgcaccccgacagttgagtacccctgtggcaaaatccctattctcgagaagagaaacgcctctaagccccaggggcgg

SEQ ID NO: 38855 - RNA, 1353 nt, synthetic construct
  misc_feature 1..1353: note = derived and/or modified sequence opt5 from Orticumab_HeavyChain1
  source 1..1353: mol_type = other RNA
gaggtgcagctgctcgaaagcggcgggggactggtccaacccggcgggtcccttagactgtcttgcgccgctagcggattcaccttttccaacgcctggatgtcttgggttcggcaggcgcctggcaaggggctcgagtgggtgagctccatctctgtgggaggccaccgcacatactatgctgacagcgtcaaaggcagatccacgattagccgggataattctaagaacaccctgtaccttcagatgaatagcctgcgcgccgaagacacagccgtgtattactgtgctagaatccgggttgggccgtccggaggcgccttcgattattgggggcagggaaccctcgtgacagtctcttccgctagcaccaaaggcccctctgtgtttcctctggccccctccagcaagtccacatctgggggaaccgcggccctgggctgcctcgttaaagactacttccctgagcccgtgacggtcagctggaactccggcgctctgaccagcggggtgcatacatttcctgccgtgcttcaatcttccggactgtatagcctctctagcgtcgttaccgtgccgtcctctagcctgggcacacagacctacatttgtaatgtgaaccacaagccctccaatacgaaggtcgataaaaaggtggaacctaaaagctgcgacaagacacatacctgtcccccttgccccgctccggagcttctcgggggaccttctgttttcctgtttccccctaaacccaaggatacactgatgatctcccgcacccccgaggtgacctgtgtcgtggttgacgtgagccacgaagatcctgaggtcaagttcaactggtacgtggacggcgtcgaagtgcataatgccaaaacaaagccgagagaggagcagtataactctacgtaccgggttgtgtccgtcctgaccgtgctccaccaggattggctgaatgggaaagaatataagtgcaaagttagcaacaaggcgcttcccgcccctattgagaaaacaatctccaaggctaagggacaaccccgcgaacctcaggtgtacaccctgcccccgtctagagacgagctcaccaaaaatcaggtcagcctgacatgtcttgtgaagggcttttatccttccgatatcgccgtggaatgggagtctaacggccagcccgagaataactacaaaacgacacctcccgttctggacagcgacgggtccttctttctctatagcaagctgaccgtcgataaatctcggtggcaacagggaaacgtgttctcctgcagcgtgatgcacgaagctctgcataatcactacacccagaagtctctctccctgagccctggcaag

SEQ ID NO: 38856 - RNA, 648 nt, synthetic construct
  misc_feature 1..648: note = derived and/or modified sequence opt5 from Orticumab_LightChain1
  source 1..648: mol_type = other RNA
cagagcgtgctgacccaacccccttccgcctctggcacaccggggcagagagtcacgatcagctgctccggatctaacaccaatattggcaagaactacgttagctggtatcagcagctccccgggacagctcctaaactgcttatctacgccaattccaaccggccctctggagtgcctgaccgcttcagcggctccaagagcgggacctctgcgtccctggctattagcggactcagatctgaggatgaagccgactattactgtgcctcctgggatgctagcctgaatggctgggtgtttggcgggggaacaaaacttaccgtcctgggccaacccaaggccgctccttctgtgacactcttcccgccctccagcgaggaactgcaggccaacaaagcgaccctggtttgcctcatctccgacttttatcctggggccgtgacggtcgcttggaaggccgattctagccccgtgaaggctggagttgagaccacaaccccttccaaacagagcaataacaagtacgccgcgtcttcctatctgagccttacacccgaacagtggaaatctcaccggagctactcctgtcaagtgacccatgagggctctacggtcgagaagacagtggccccgaccgaatgcagc

SEQ ID NO: 38857 - RNA, 1347 nt, synthetic construct
  misc_feature 1..1347: note = derived and/or modified sequence opt5 from Otelixizumab_HeavyChain1
  source 1..1347: mol_type = other RNA
gaggtgcagctgctcgaaagcggcgggggactggtccaacccggcgggtcccttagactgtcttgcgccgctagcggattcaccttttcctctttccctatggcctgggttcggcaggcgccgggcaaggggctcgagtgggtgagcacaatctccacgtctggaggccgcacctactatagagacagcgtgaaaggccggtttacaatttcccgcgataacagcaagaataccctgtaccttcagatgaactctctgagagctgaagacacagccgtctattactgtgccaaattccggcagtattccgggggatttgattactggggccaagggaccctcgtgacagttagctctgcttccaccaagggacccagcgtgttccctctggccccctcttccaaaagcacgtccggcgggaccgctgccctgggatgcctcgtcaaggactattttcctgagcccgtgacagtttcttggaatagcggcgcgctgacctccggcgtgcacacattccctgccgtccttcagagctctgggctgtactccctcagctctgtggtgaccgtcccgagctcctctctgggaacgcagacatacatctgtaacgttaatcataagcccagcaacaccaaagtggataagaaagtggaacctaagtcctgcgacaaaacacacacctgtcccccttgccccgctccggagcttctgggcgggcctagcgtctttctctttccccctaagcccaaggataccctgatgatttctcgcacacccgaggtgacgtgtgttgtggtcgacgtgtcccatgaagatcctgaggttaaattcaattggtatgtggacggagtcgaagtgcacaacgccaagaccaaaccgagagaggagcagtacgctagcacatatcgggtcgtgtctgttctgaccgtgctccatcaagattggctgaatggcaaggaatacaaatgcaaggtctccaacaaagcccttcccgcgcctatcgagaagacaattagcaaggccaaagggcagccccgcgaacctcaggtgtataccctgcccccgtccagagacgagctcacgaagaatcaggtttctctgacatgtcttgtgaaaggattctaccctagcgatatcgctgtcgaatgggagtccaacggccaacccgagaataactataagaccacccctcccgtgctggactctgacggcagctttttcctctactccaaactgacagtggataagagccggtggcagcaggggaatgttttctcttgctccgtcatgcacgaagccctgcacaaccattacacccaaaagagcctctctctgtcccctggaaaa

SEQ ID NO: 38858 - RNA, 648 nt, synthetic construct
  misc_feature 1..648: note = derived and/or modified sequence opt5 from Otelixizumab_LightChain1
  source 1..648: mol_type = other RNA
gacatccagctgacccaacccaacagcgtgtccacatctctcggcagcacggtcaagctgtcctgcaccctttctagcgggaatattgagaacaattacgttcactggtatcagctgtacgaaggaagatcccctacaaccatgatctatgatgacgataaacggccggacggcgtgcccgatcgcttctctgggagcattgacagatccagcaactctgcctttctcacaatccataatgtggctattgaggatgaagccatctacttctgtcactcctatgtcagctcttttaacgtgttcggaggcgggaccaagctgacagttcttcggcagcctaaagcggctccctccgtgaccctgtttcctcccagctctgaggaactccaggccaataaggccacgctggtctgcctgatctccgacttctaccctggagctgtgaccgttgcctggaaagctgatagctccccggtgaaggccggcgtcgagacaaccacaccctctaagcaaagcaacaataaatatgcggcctccagctacctctctctgacccctgagcagtggaagtcccatcgcagctactcttgtcaggtgacgcacgaaggcagcacagtggagaaaaccgtcgctcccacagaatgctcc

SEQ ID NO: 38859 - RNA, 1449 nt, synthetic construct
  misc_feature 1..1449: note = derived and/or modified sequence opt5 from Otlertuzumab_HeavyChain1
  source 1..1449: mol_type = other RNA
gaggtgcagctggtccagagcggcgccgaagttaagaaacccggggagtccctcaagatctcttgcaaaggaagcggctactccttcaccgggtataacatgaattgggtgagacagatgcctggaaagggcctggaatggatggggaacattgacccgtactatggaggcacaacgtacaatcggaaatttaagggccaggtgaccatctctgctgataagagcatttccacagcctatcttcagtggtctagcctgaaagcgtccgacaccgctatgtactattgtgcccgcagcgtcgggcccttcgattcttggggacaaggcacactcgtgaccgtttccagcgggggaggcgggtctggaggcggcgggtccggaggcgggggaagcggcgggggaggctctggcgggggaggctccgagatcgtgctgacacagagccctgccaccctttccctgtctcccggggaaagagctacgctcagctgccgggcctccgagaacgtctacagctacctggcttggtatcagcagaagcctggacaagcgccccgcctgctcatttactttgccaaaaccctggccgagggcatccctgctagattctctgggtccggcagcggaacagactttacccttacaatctctagcctggaaccggaggatttcgccgtgtattactgtcagcaccattccgacaatccctggacctttggccaggggacgaaggttgaaattaaaggagatcaggagcctaagtctagcgacaagacacacacctcccctccctgccccgctccggagctcctgggcgggcctagcgtgttcctttttccccctaaacccaaggatacactgatgatctctcggacccccgaagtcacctgtgtggtggtcgacgtttcccatgaggatcctgaagtgaaattcaactggtatgtggacggagtcgaggtgcacaatgccaagacaaaaccgcgcgaagaacaatacaacagcacgtatagagttgtgtctgtcctcaccgtgctgcatcaggattggctgaatggcaaggagtacaaatgcaaggtttccaacaaggcgctccccgcccctattgagaaaacaatcagcaaggctaaagggcagccccgggagcctcaagtgtacaccctgcccccgtcccgcgacgaacttacaaagaatcaggtctctctgacctgtctcgtgaaaggcttttatcctagcgacattgccgtcgagtgggaatccaacggacagcccgagaataactacaagacgacacctcccgtgctggattctgacggcagcttctttctttattccaagctgaccgttgataaaagcagatggcagcaagggaatgtgttctcttgctccgtcatgcacgaggctctccacaaccattacacccaaaagagcctgtctctgtcccctggaaaa

SEQ ID NO: 38860 - RNA, 1347 nt, synthetic construct
  misc_feature 1..1347: note = derived and/or modified sequence opt5 from Oxelumab_HeavyChain1
  source 1..1347: mol_type = other RNA
gaggtgcagctgctcgaaagcggcgggggactggtccaacccggcgggtcccttagactgtcttgcgccgctagcggattcacctttaactcctacgccatgtcttgggttcggcaggcgcctggcaaggggctcgagtgggtgagcatcatttccggatctggcggcttcacatattacgctgacagcgtgaaagggcgctttacgatctccagagataatagccggaccacactgtatcttcagatgaactctctgcgcgccgaagacaccgccgtctactattgtgctaaggatagactcgtggccccgggaacattcgactactggggccagggggctctggttaccgtgtccagcgcctctacaaaaggaccctccgtctttcctctggcgcccagctctaagtccaccagcggcgggacggccgctctcggatgcctggtgaaagattatttccctgagcccgttaccgtgtcctggaactctggcgcccttacaagcggcgtccacacctttcctgctgtgctgcaatccagcgggctctactctctgtccagcgtggtcacagttccgtctagctcccttggaacccagacgtacatttgtaatgtgaatcataagccctctaacacaaaggtggacaaaaaggtcgaacctaaaagctgcgataagacccacacatgtcccccttgccccgccccggagctgctcggcgggccttccgtgttcctgtttccccctaaacccaaggacaccctgatgatcagccggacccccgaggttacatgtgtggtcgtggatgtttctcatgaagaccctgaggtgaagttcaattggtatgtcgatggagtggaagtccacaacgcgaaaacgaagccgcgcgaggagcagtacaattccacctatagagtggttagcgtgctcacagtcctgcatcaggactggcttaacggcaaagaatacaagtgcaaagtgtctaataaggccctgcccgctcctattgagaaaaccatctccaaggccaaggggcaaccccgggaacctcaggtttatacactgcccccgagccgcgatgagctcaccaaaaaccaggtgtcccttacgtgtctggtcaagggattttacccttctgacatcgctgtggaatgggagagcaatggccagcccgagaacaattataaaacaacccctcccgtgctcgactccgatggctctttctttctgtacagcaagctgaccgttgacaaatccagatggcaacaggggaacgtcttcagctgctctgtgatgcacgaagccctccacaaccattacacacagaagtccctgagcctttctcctgga

SEQ ID NO: 38861 - RNA, 642 nt, synthetic construct
  misc_feature 1..642: note = derived and/or modified sequence opt5 from Oxelumab_LightChain1
  source 1..642: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaactcttatccctacacctttggccaagggacaaaactggagattaagagaaccgtggctgccccttccgtgttcatctttccccctagcgacgaacagcttaaatccggaacggcttctgtcgtgtgcctgctcaataacttctatccgcgggaggccaaggttcagtggaaggtggataatgcgctgcagagcggcaactcccaagaaagcgtcaccgagcaggactctaaagattccacatacagcctgtctagcaccctcacactgtccaaggccgactacgagaaacacaaggtgtatgcttgtgaagttacccatcagggcctttctagccccgtgacgaaatcctttaatcgcggggagtgc

SEQ ID NO: 38862 - RNA, 1329 nt, synthetic construct
  misc_feature 1..1329: note = derived and/or modified sequence opt5 from Ozanezumab_HeavyChain1
  source 1..1329: mol_type = other RNA
caggtgcaactggtccagagcggcgccgaggttaagaaacccggggcttccgtgaaggtgtcttgcaaagccagcggatacaccttcacatcctattggatgcactgggtcagacaggcgcctggccaggggctcgaatggatcggaaacattaatccgtctaacggcgggacgaattacaacgagaagtttaaaagcaaggctaccatgacacgggacacctccacatctaccgcctatatggaactgagctcccttcgcagcgaggatacagccgtgtactattgtgaactgatgcaaggatactggggccagggcaccctcgttacggtgtcttccgctagcaccaaggggccctctgtcttccctctggccccctccagcaaatctacatccggaggcaccgctgcccttgggtgcctggtgaaggactattttcctgagcccgttacagtgagctggaactccggagcgctcacctctggcgtccatacgttccctgccgtgctgcagagctccgggctgtacagcctctcttccgtggtcacagttccgagctctagcctgggaacccagacatacatctgtaatgtgaatcacaaaccctccaacaccaaggtggataaaaaggtcgagcctaagtcttgcgacaaaacccatacatgtcccccttgccccgctccggaacttgccggcgctcctagcgtgtttctgtttccccctaagcccaaagatacgctcatgatttccagaacccccgaggttacatgtgtggtcgtggacgttagccacgaagatcctgaggtgaagttcaattggtatgtcgacggcgtggaggtccataacgccaaaaccaagccgcgggaggaacaatacaattctacatatcgcgtggtttccgtgctgaccgtccttcaccaggattggctgaacgggaaagaatacaagtgcaaggtgagcaataaagcgctccccgcccctatcgagaagacgatttctaaagctaagggacagcccagagaacctcaggtttatacactgcccccgtcccgggacgagctgaccaaaaaccaagtgagcctcacctgtctggtcaagggcttctacccttccgatatcgccgtggagtgggaatctaatgggcagcccgagaacaactataagacaacccctcccgtgcttgacagcgatggatcctttttcctgtactctaaactcacagttgacaagagccgctggcagcaaggcaatgtcttttcctgcagcgtgatgcacgaagctctgcataaccactacacgcagaaatctctttccctgagccctgggaag

SEQ ID NO: 38863 - RNA, 657 nt, synthetic construct
  misc_feature 1..657: note = derived and/or modified sequence opt5 from Ozanezumab_LightChain1
  source 1..657: mol_type = other RNA
gacatcgtgatgacccagagccccctgtccaaccctgtcacactcggccaaccggtttctattagctgccggtcctctaagagcctgctttacaaagatgggaagacgtatctgaattggttcctccagcggcccggacagtcccctcagctgcttatctacctgatgtctacccgcgccagcggcgtgcccgacagattttccgggggaggcagcgggacagatttcaccctcaaaatttctcgggtggaggctgaagacgtcggagtgtattactgtcaacagctggttgagtatcctctgacatttggccagggcaccaagctcgaaatcaaacgcacagtggccgcgccctccgtcttcatttttcctccgagcgatgagcagctgaagtctgggaccgcttccgtggtttgccttctgaacaatttctaccccagagaagccaaggtgcaatggaaagtcgacaacgccctccagagcggaaattctcaggagtccgtgacggagcaggatagcaaggactccacctattctctgagctccacacttaccctgagcaaagctgattacgaaaagcacaaagtgtacgcctgtgaggtcacacatcaaggcctctcttcccctgttaccaagagctttaacagaggggaatgc

SEQ ID NO: 38864 - RNA, 1089 nt, synthetic construct
  misc_feature 1..1089: note = derived and/or modified sequence opt5 from Ozoralizumab_HeavyChain1
  source 1..1089: mol_type = other RNA
gaggtgcagctggtcgaaagcggcgggggactcgttcaacccggcgggtccctgagactttcttgcgccgctagcggattcaccttttccgactactggatgtattgggtgcggcaggcccctggcaaggggctggagtgggtgtctgaaatcaacacaaatggactcattacgaaatacccggatagcgtcaagggccgcttcaccatctccagagacaacgcgaaaaatacactgtatcttcagatgaactctctgcggcccgaggataccgctgtgtactattgtgcccgcagcccttccggctttaatagagggcagggaacactcgttaccgtgagctctggcgggggaggctccgggggaggcagcgaagtccaactggtggagtctggcgggggactggttcagcccggcaactccctccggctgagctgcgccgcttctgggttcacattttccagcttcggaatgtcctgggtgcgccaggcccctggcaaggggcttgagtgggtctctagcatttccggaagcggctctgacaccctgtacgctgattccgtgaaaggcagatttacgatcagccgggacaatgccaagaccacactctatctgcagatgaactctcttcgccccgaagataccgcggtgtactactgtacaattgggggaagcctgtccagatctagccaaggcaccctcgtcacggtttccagcgggggaggcgggtctggcggaggctccgaggtgcagctggtggaaagcgggggaggcctggtccagcctgggggatctctccggctgtcctgcgccgctagcggcttcacattttccgactattggatgtactgggtgcgccaggccccggggaagggccttgagtgggtttctgagatcaataccaacggactgatcacaaaatatcccgatagcgtgaagggcagattcaccatttcccgggacaatgctaaaaacaccctctacctgcaaatgaactctcttcgccctgaagatacagccgtctattactgtgcgagaagcccctccgggtttaatcggggacagggcacgctggtgaccgttagctct

SEQ ID NO: 38865 - RNA, 1350 nt, synthetic construct
  misc_feature 1..1350: note = derived and/or modified sequence opt5 from Palivizumab_HeavyChain
  source 1..1350: mol_type = other RNA
caggtgaccctgagagagagcggccccgccctcgtcaagcctacacaaacgctgacccttacatgcaccttctccgggttttctctgagcacatccggaatgtctgttggctggatccggcagccgcccgggaaagctctcgaatggctggccgacatttggtgggatgacaagaaagattacaaccctagccttaagtcccgcctgaccatctctaaagacacaagcaagaatcaggtggtgctcaaggtcaccaacatggatcccgcggacacggctacctattactgtgccagatccatgattacaaattggtatttcgatgtgtggggagccggcaccacagttaccgtgagctctgcttccacgaaagggcctagcgtctttcccctggccccttcttccaagagcacatctggaggcaccgctgccctgggctgcctcgtgaaagactacttcccggagcccgttacagtgtcctggaacagcggggcgctgacctccggagtccacacctttcctgccgtgcttcagtctagcggcctgtattccctcagctctgtggtcacagttccctccagctctctggggacgcaaacctacatctgtaatgtgaaccataagcctagcaatacaaaagtggataagcgggtcgaacccaagtcctgcgacaaaacccacacatgtccgccttgccccgctcctgagcttctgggaggcccctctgtgttcctctttccccctaagccgaaagataccctgatgattagccgcacgcccgaagttacatgtgtggtcgtggacgtttcccatgaggatcctgaggtgaagttcaactggtatgtcgacggggtggaagtccacaatgccaaaaccaagcccagagaggaacagtacaacagcacctaccgggtggtttctgtgctgacagtcctccatcaggactggctgaatggaaaagagtataagtgcaaggtgtccaacaaagcccttcctgctcccatcgagaagaccatcagcaaagcgaagggccagccgcgcgaacctcaagtttacacactgcccccttctagagaggaaatgacgaaaaatcaggtgtccctcacctgtctggtcaagggcttttatcccagcgatattgccgtggagtgggaatccaacgggcagcctgagaataactacaagacaacacccccggtgcttgactctgatggcagcttctttctgtattccaaactcaccgttgacaagtctcggtggcagcaaggaaacgtcttcagctgctccgtgatgcacgaggctctgcacaatcattacacccagaaaagcctgtctctctcccctgggaag

SEQ ID NO: 38866 - RNA, 639 nt, synthetic construct
  misc_feature 1..639: note = derived and/or modified sequence opt5 from Palivizumab_LightChain
  source 1..639: mol_type = other RNA
gacatccagatgacccaaagcccctccacactgtctgccagcgtgggcgatagagtcacgattacctgcaagtgtcagctctccgttgggtacatgcactggtatcagcagaaacctggaaaggctccgaaactgcttatctacgacacatctaagctggccagcggcgtgccctcccggttctctgggagcggatccggcaccgagtttacactcaccattagctctctgcaacctgatgacttcgcgacatattactgctttcaggggtccggatatcccttcacctttggcggcgggacgaaacttgaaatcaagcgcaccgtggctgcccctagcgtcttcatttttcccccttctgatgagcagctgaagtccggaacagccagcgtggtttgtctcctgaacaatttctacccgagagaagctaaagtgcagtggaaggtcgacaacgccctgcaatctggcaattcccaggagagcgtgaccgaacaggattccaaagactctacatatagcctctccagcaccctgacgctttctaaggctgattacgagaaacataaggtttacgcctgcgaggtgacacaccaggggctgtccagccccgtcaccaagtcttttaaccggggagaatgt

SEQ ID NO: 38867 - RNA, 360 nt, synthetic construct
  misc_feature 1..360: note = derived and/or modified sequence opt5 from Palivizumab_VH-Region
  source 1..360: mol_type = other RNA
caggtgaccctgagagagagcggccccgccctcgtcaagcctacacaaacgctgacccttacatgcaccttctccgggttttctctgagcacatccggaatgtctgttggctggatccggcagccgcccgggaaagctctcgaatggctggccgacatttggtgggatgacaagaaagattacaaccctagccttaagtcccgcctgaccatctctaaagacacaagcaagaatcaggtggtgctcaaggtcaccaacatggatcccgcggacacggctacctattactgtgccagatccatgattacaaattggtatttcgatgtgtggggagccggcaccacagttaccgtgagctct

SEQ ID NO: 38868 - RNA, 1347 nt, synthetic construct; identical to SEQ ID NO: 38504
  misc_feature 1..1347: note = derived and/or modified sequence opt5 from Pamrevlumab_HeavyChain1
  source 1..1347: mol_type = other RNA

SEQ ID NO: 38869 - RNA, 642 nt, synthetic construct; identical to SEQ ID NO: 38505
  misc_feature 1..642: note = derived and/or modified sequence opt5 from Pamrevlumab_LightChain1
  source 1..642: mol_type = other RNA

SEQ ID NO: 38870 - RNA, 1305 nt, synthetic construct
  misc_feature 1..1305: note = derived and/or modified sequence opt5 from Panitumumab_HeavyChain1
  source 1..1305: mol_type = other RNA
caggtgcaactgcaggagagcggccccgggctcgtcaagccttccgaaaccctgtctcttacatgcacggttagcggaggctccgtgtctagcggggactactattggacctggatcagacagtccccgggaaaaggcctggagtggattgggcacatctactattctggaaacacaaattacaaccccagcctcaagtcccggctgaccattagcatcgatacatctaaaacccagttctcccttaagctgagctctgtgacagccgctgacaccgccatttattactgtgtccgcgatagagtgacgggcgcgtttgacatctggggccaagggaccatggttacagtgtccagcgcttctaccaaaggaccttccgtcttccccctcgccccttgcagccggtccacatctgaaagcaccgccgctctgggctgtctggtgaaggattattttcccgagcctgttacggtgtcctggaatagcggggccctcacatctggagtccataccttcccggctgtgctgcagtccagcggcctttactctctgagctccgtggtcacagttccctctagcaactttgggacccagacctacacatgcaatgtggaccacaagccttccaacacgaaagtggatgaacgcaagtgttgcgtcgagtgtcccgccggacctagcgtgttcctctttcccccgaaacctaaggacaccctgatgatctctagaacacccgaggttacctgcgtggtcgtggatgtttcccatgaagaccctgaggtgcagttcaattggtatgtcgatggcgtggaagtccacaacgcgaaaacaaagccccgggaggagcaatttaatagcaccttccgcgtggtttctgtgcttacggtcgtgcatcaggactggctgaacggcaaggaatacaaatgtaaggtttccaataaagggctccccgcccctattgagaagacaatcagcaaaaccaagggacagccgagagaaccccaggtgtataccctgcctccctcccgggaggaaatgaccaaaaaccaagtctctctgacatgcctcgtgaagggcttttaccctagcgatattgctgtggagtgggagtccaatgggcagcccgaaaacaattataagacaacgccgcctatgctggactctgacggcagcttctttctttactccaaactgaccgttgataagagccgctggcagcaaggaaacgtcttctcttgttccgtgatgcacgaggccctccacaaccattatacacagaaaagcctgtctctttcccccgggaag

SEQ ID NO: 38871 - RNA, 642 nt, synthetic construct
  misc_feature 1..642: note = derived and/or modified sequence opt5 from Panitumumab_LightChain1
  source 1..642: mol_type = other RNA
gacatccagatgacccaaagcccctcctctctgagcgcctccgtgggcgatagagtcacaattacgtgccaggcttctcaggacatcagcaactacctcaattggtatcagcaaaagcctgggaaagccccgaagctgcttatttacgatgcgtccaacctggagaccggagttccctctcggttcagcggctccgggagcggaacagactttaccttcacaatctcttccctccagcctgaagatattgctacctatttttgtcagcacttcgaccatctgccccttgcctttggcgggggaacaaaagtggagatcaagcgcaccgtggccgctcctagcgtcttcatctttcccccttctgatgaacagctgaaatccggcacggccagcgtggtttgcctcctgaataacttctacccgagagaggctaaggtgcaatggaaggtcgacaatgccctgcagtctggcaactcccaggaaagcgtgaccgagcaggattccaaagactctacatatagcctctccagcaccctgacactttctaaggcggattacgagaaacacaaggtttatgcctgtgaagtgacccatcaagggctgtccagccccgtcacgaaatcttttaatcggggagagtgc

SEQ ID NO: 38872 - RNA, 1326 nt, synthetic construct
  misc_feature 1..1326: note = derived and/or modified sequence opt5 from Pankoab_HeavyChain1
  source 1..1326: mol_type = other RNA
gaggtgcagctggtcgaaagcggcgggggactcgttcaacccggcgggtccagactgtcttgcgtggccagcggattccctttttccaactactggaattgggtgcggcaggctccgggcaaggggcttgagtgggtcggagaaatccgcctgaaatctaacaattataccacacactacgccgagagcgtgaagggcagattcacgatttcccgggacgattctaaaaacagcctctatctgcaaaattcccttaagaccgaagacacagcggtttactattgtacccgccattactattttgattactggggccaggggacactggtgaccgtcagctctgcttccacaaaaggacccagcgtgttccctctcgccccctcttccaagagcacctctggcgggacggccgctctgggatgcctggttaaggactactttcctgagcccgtgaccgtctcctggaacagcggcgccctcacatccggggtgcacaccttccctgctgtgctgcagtctagcggactttattccctgagctctgtcgttacagtgccgtccagctctctcggcacccagacgtacatctgtaatgtgaaccataaacccagcaatacaaaggtcgataaaaaggtggagcctaaatcctgcgacaagacccacacatgtcccccttgccccgccccggaactgcttggcgggccttctgtttttctgtttccccctaagcccaaagataccctcattagcagaacccccgaggtgacatgtgtcgtggttgacgtgtcccatgaagatcctgaggtcaagttcaactggtatgtggacggagtcgaggtgcacaatgcgaaaacgaagccgcgggaggaacagtacaacagcacctatcgcgttgtgtctgtcctgacagtgctgcaccaggattggctcaatggcaaagaatacaagtgcaaagtttccaacaaggccctgcccgctcctatcgagaagaccattagcaaagccaaggggcaacccagagaacctcaggtgtatacacttcccccgtctcgggacgagctgaccaaaaatcaggtctccctcacgtgtctggtgaagggattctaccctagcgatatcgctgtggagtgggaatccaacggccagcccgagaacaattacaaaacaacccctcccgttcttgactctgacgggagctttttcctgtattccaagctcaccgtcgataagtctcgctggcaacagggaaacgtgtttagctgctccgtgcatgaaggcctgcacaatcattacacacagaaaagcctgtctctctcccctggcaag

SEQ ID NO: 38873 - RNA, 651 nt, synthetic construct
  misc_feature 1..651: note = derived and/or modified sequence opt5 from Pankoab_LightChain1
  source 1..651: mol_type = other RNA
gacatcgtgacccagagccccctgtccaaccctgtcacaccgggcgagcccgcctctattagctgcagatcctctaagagcctcctgcactccaatgggatcacgtacttcttttggtatcttcaaaaacctggacagtctccccagctgctcatttaccagagcaacctggcttccggcgttcctgatcggttcagcgggtctggatccggcaccgactttacacttcgcatcagcagagtggaagccgaggatgtgggggtctattactgtgcgcaaaatctggaactgccccctaccttcggacagggcacaaaggtggagattaaacggaccgttgctgccccgtctgtgtttatctttcccccttccgacgaacagctcaagagcggcacagcctctgtcgtgtgcctgctcaacaatttctatccccgcgaggctaaagttcagtggaaggtggataacgccctgcaatccgggaatagccaggagtccgtcaccgaacaggactctaaggatagcacgtactcccttagctctaccctgacactctccaaagctgactatgagaagcataaagtgtacgcctgtgaagtgacccaccagggactgagctctcctgtcacaaagagcttcaacagaggcgagtgc

SEQ ID NO: 38874 - RNA, 651 nt, synthetic construct
  misc_feature 1..651: note = derived and/or modified sequence opt5 from Pankoab_LightChain2
  source 1..651: mol_type = other RNA
gacatcgtgacccagagccccctgtccaaccctgtcacaccgggcgagcccgcctctattagctgcagatcctctaagagcctcctgcactccaatgggatcacgtacttcttttggtatcttcaaaaacctggacagtctccccagctgctcatttaccagagcaacctggcttccggcgttcctgatcggttcagcgggtctggatccggcaccgactttacacttcgcatcagcagagtggaagccgaggatgtgggggtctattactgtgcgggaaatctggaactgccccctaccttcggccaaggcacaaaggtggagattaaacggaccgttgctgccccgtctgtgtttatctttcccccttccgacgaacagctcaagagcgggacagcctctgtcgtgtgcctgctcaacaatttctatccccgcgaggctaaagttcagtggaaggtggataacgccctgcagtccggaaatagccaagagtccgtcaccgaacaggactctaaggatagcacgtactcccttagctctaccctgacactctccaaagctgactatgagaagcataaagtgtacgcctgtgaagtgacccaccagggcctgagctctcctgtcacaaagagcttcaacagaggggagtgc

SEQ ID NO: 38875 - RNA, 351 nt, synthetic construct
  misc_feature 1..351: note = derived and/or modified sequence opt5 from PankoMab_HeavyChain_VDJ-Region
  source 1..351: mol_type = other RNA
gaggtgaagctggtcgaaagcggcgggggactcgttcagcccggcgggtccatgaaactgtcttgcgtggccagcggattcaccttttccaactactggatgaattgggtgagacaatctcctgagaagggccttgaatgggtcgctgagatccggctgaaaagcaacaattatacaacgcactacgccgaatccgtgaaggggcgcttcaccatttctagagacgatagcaaatccagcgtttctctccagatgaacaatctgcgggtggaggacacaggaatctattactgtacccgccattattactttgattattggggccagggcacaacccttacagtctccagc

SEQ ID NO: 38876 - RNA, 339 nt, synthetic construct
  misc_feature 1..339: note = derived and/or modified sequence opt5 from PankoMab_LightChain_VJ-Region
  source 1..339: mol_type = other RNA
gacatcgtgatgacccaggccgctttcagcaaccccgtcacactgggcacgtccgcctctattagctgcagatcctctaagagcctcctgcactccaatgggatcacctactttttctggtatcttcaaaaacctggactgtctccgcagctcctgatttaccagatgagcaaccttgcgtccggcgttcccgatcggttttctagctccgggagcggaacagacttcaccctgcgcatctctagagtggaggctgaagatgtgggcgtctattactgtgcccagaatctcgagctgcctcccacatttgggggaggcaccaagctggaaattaaacgg

SEQ ID NO: 38877 - RNA, 1707 nt, synthetic construct
  misc_feature 1..1707: note = derived and/or modified sequence opt5 from Panobacumab_HeavyChain1
  source 1..1707: mol_type = other RNA
gaggaacaggtggtcgagagcggcgggggattcgttcaacccggcgggtccctgagactctcttgcgccgctagcggatttaccttctccccttactggatgcactgggtgcggcaggccccgggcaaggggctggtgtgggtctctcgcatcaacagcgacggatccacatattacgcggattctgtgaaaggcagatttacgattagccgggacaatgctcgcaacaccctttatctgcagatgaactccctcagagccgaagatacagccgtttactattgtgctcgggaccgctactatggccccgagatgtgggggcagggaaccatggtgacagtcagctctggctccgccagcgctcctaccctgttcccccttgtgtcttgcgaaaattcccctagcgatacatcttccgttgccgtggggtgtctggcgcaagactttctccccgatagcatcaccttctcctggaagtacaaaaataactctgacattagctccacgagaggatttcctagcgtcctgcggggcgggaagtacgccgctacctctcaggtgctgctcccgtccaaagatgtgatgcagggaacagacgagcatgtcgtttgcaaggtgcagcaccccaatggcaacaaggagaaaaatgtgcctctgcccgtcatcgccgaacttcctcccaaggtgagcgttttcgtgccgcctcgcgatggctttttcgggaaccccagaaaatctaagctgatttgtcaagctaccggatttagccctcggcagatccaggtctcctggctccgcgagggcaaacaggtggggtctggagttacaaccgaccaagtgcaggccgaagcgaaggagagcggccccacgacatataaggtcacctccacactgaccatcaaagagagcgattggctttctcagtccatgtttacctgcagagtggaccatcgggggctgacattccaacagaatgccagctctatgtgtgtccccgaccaggatacggctattcgcgtgttcgccatccctccgtccttcgctagcatttttctcaccaagtccacaaaactgacctgcctggttacagacctcaccacgtacgattctgtgacaatcagctggaccagacagaacggagaagccgtcaagacccacacaaatatttccgagtctcatcccaacgccaccttcagcgctgtgggcgaagcgtccatctgtgaggacgattggaatagcggcgaacggtttacatgcacggttacccacacagacctgccttctccccttaaacaaaccatttccagacctaagggggtggccctgcaccgccccgatgtctatctcctgccgcctgctcgggagcagcttaacctgagagagagcgccacaatcacctgtctcgtgacgggattctctcccgccgacgtgtttgttcagtggatgcagcgcggccaacctctgtcccccgaaaaatacgtcaccagcgctcctatgcccgagccgcaggcccctgggcggtatttcgcgcattctatcctgacagtgagcgaagaggaatggaacaccggagagacatatacctgcgtggtcgctcacgaggccctccccaatagagtgacggaacgcacagttgataagtccaccggcaagcccacactgtacaacgtgagccttgtcatgtctgacaccgccgggacctgctac

SEQ ID NO: 38878 - RNA, 657 nt, synthetic construct
  misc_feature 1..657: note = derived and/or modified sequence opt5 from Panobacumab_LightChain1
  source 1..657: mol_type = other RNA
gacgtggtcatgacccagagccccctgtccctccctgttacactgggccaaccggcctctatcagctgcagatcctctcagagccttgtgtactccgatgggaacacgtatctgaattggttccagcagcggcccggacaatctcctcgcagactcatttacaaggtgagcaaccgggactccggcgtccccgatcgctttagcgggtctggatccggcaccgacttcacactgaaaatcagcagagtggaggctgaagatgttggggtgtattactgtatgcagggaacccactggcctcttacatttggcggcgggaccaaggtcgagattaaacggacagtggccgcgccctctgttttcatctttcctccgtccgacgaacagctcaagagcggaaccgcttctgtggtctgcctgctgaataacttctatccccgcgaggccaaagtgcagtggaaggtggataatgccctgcaatccggcaacagccaggaatccgtcacggagcaggactctaaggatagcacctactccctcagctctacactgaccctttccaaagctgactatgagaagcataaagtttacgcctgtgaagtgacacaccaggggctgagctctcctgtgaccaagagctttaatagaggagagtgc

SEQ ID NO: 38879 - RNA, 414 nt, synthetic construct
  misc_feature 1..414: note = derived and/or modified sequence opt5 from Panobacumab_LightChain2
  source 1..414: mol_type = other RNA
ggcgacgatgaggccaccatcctggctgacaacaagtgcatgtgtacaagagtgacgagccggattatcccctccaccgaagatcctaatgaggacattgtcgaacgcaacatcagaattgttgtgccgctcaataaccgggagaatatctctgatcccacaagccctctgcgcagaaacttcgtgtaccacctttccgacgtctgcaaaaagtgtgatcccgtggaagttgagctggaggaccaggtggtcaccgccacacaatctaatatctgcaacgaagatgacggggtgcctgagacctgttatatgtacgatcggaataaatgctatacaaccatggttcccctccgctaccatggagaaacgaagatggtgcaggcggctctgacccctgacagctgttatccggat

SEQ ID NO: 38880 - RNA, 1359 nt, synthetic construct
  misc_feature 1..1359: note = derived and/or modified sequence opt5 from Parsatuzumab_HeavyChain1
  source 1..1359: mol_type = other RNA
gaggtgcagctggtcgaaagcggcgggggactcgttcaacccggcgggtccctgagactttcttgcgccgctagcggatacaccttcatcgactattacatgaactgggtgcggcaggcccctggcaaggggctggagtgggtgggagatattaatctcgacaactccggcacacactataatcagaaatttaagggccgcttcacgatctctagagataaaagcaagaacaccgcgtacctgcagatgaactcccttcgggctgaagacacagccgtctattactgtgcccgcgagggggtgtatcatgattacgacgattacgctatggactattggggacaaggcaccctggttacagtgtctagcgcctccaccaaagggccgagcgtctttcccctcgctccttcttccaagagcacatctggaggcaccgccgcgctggggtgcctggtgaaggattacttccccgaacctgttacggtgtcctggaatagcggagccctcacctctggcgtccacacatttcccgctgtgctgcagtccagcggcctttattccctgtctagcgtggtcaccgttccttccagctctctcgggacacagacctacatttgtaatgtgaaccataaaccgtccaatacgaaggtggacaaaaaggtcgagcccaaaagctgcgataagacacacacctgtcctccctgccctgcccccgagctgcttggaggcccgtctgtgttcctgtttcctcccaagcctaaagacacactcatgatcagcagaacccccgaagttacctgtgtggtcgtggatgtttcccatgaggaccccgaagtgaagttcaactggtatgtcgacggggtggaggtccacaatgctaaaacaaagcctcgggaggaacagtacaactctacgtatcgcgtggttagcgtgctgaccgtcctgcaccaagattggctcaatggaaaagagtacaagtgcaaagtgtccaacaaggccctgccggcgcccattgaaaagacaatcagcaaagccaagggccagcctagagagccccaggtttacacccttcctccctctcgggaagagatgaccaaaaatcaggtgtccctgacatgtctcgtcaaggggttttatccgagcgacatcgctgtggagtgggaatctaacggacaacctgagaacaattacaaaacgacaccccctgtgctggattccgacggcagcttctttctttattccaagctgaccgttgataagtctcgctggcagcagggcaacgtcttcagctgctccgtgatgcatgaagccctccacaatcattacacccaaaaatctctgagcctgtcccccgggaag

SEQ ID NO: 38881 - RNA, 657 nt, synthetic construct
  misc_feature 1..657: note = derived and/or modified sequence opt5 from Parsatuzumab_LightChain1
  source 1..657: mol_type = other RNA
gacatccagatgacccaaagcccctcctctctgagcgcctccgtgggcgatagagtcacaattacgtgccggacctctcagagcctcgttcacatcaacgctattacatacctgcattggtatcagcagaagcctgggaaagccccgaaacttctgatctaccgcgtgtccaatagattctctggagtgcccagccggttttccggcagcgggtctggaaccgacttcacactcaccatttccagcctgcaacctgaggattttgcgacatattactgtggccagtctacccacgtcccccttacgttcgggcagggaaccaaggtggaaatcaagcgcacagttgctgccccttccgtgtttatctttccccctagcgacgagcagctgaaatctggcaccgcctccgtcgtgtgcctcctgaacaatttctatccgagagaagctaaggttcaatggaaggtggataacgccctgcagagcggcaattcccaggagtctgtcacagaacaggacagcaaagattccacctacagcctctcttccacgctgacacttagcaaggctgactatgagaaacataaggtgtacgcctgtgaggtgacccaccaagggctgtctagccccgtcacaaaatccttcaaccggggagaatgc

SEQ ID NO: 38882 - RNA, 1353 nt, synthetic construct
  misc_feature 1..1353: note = derived and/or modified sequence opt5 from Pascolizumab_HeavyChain1
  source 1..1353: mol_type = other RNA
caggtgaccctgagagagagcggccccgccctcgtcaagcctacacaaacgctgacccttacatgcaccttctccgggttttctctgagcacatccggaatgggcgtttcttggatccggcagccgcccgggaaaggactcgaatggctggctcacatttactgggacgatgacaagcgctataaccctagccttaaatccagactgaccatctctaaggatacaagccggaatcaggtggtgctcaccatgacgaacatggaccccgtcgataccgccacatactattgtgcgcgcagagagaccgtgttctactggtattttgacgtttggggccgggggacacctgtgaccgtctccagcgcttctacgaaaggaccctccgtgttccctctggccccgagctctaagtccacaagcggcggcaccgccgctctggggtgcctcgttaaggattactttcccgaacctgtgacagtctcttggaactccggagccctgaccagcggcgtgcataccttccccgctgtgcttcagtcctctgggctgtatagcctctccagcgtcgttacagtgccttcttccagcctgggaacgcaaacctacatttgtaatgtgaatcacaaaccctctaacacaaaggtcgacaaacgcgtggagccgaagtcttgcgataaaacccatacatgtcctccctgccctgcccccgaacttctgggcgggccctccgtttttctcttccctccgaagcccaaggacaccctgatgatctctagaacgcctgaggtgacatgtgtcgtggttgatgtgagccacgaggaccccgaagtcaaatttaattggtacgtggatggagtcgaggtgcataacgcgaagaccaaacctcgggaggaacagtataattccacctaccgcgttgtgagcgtcctgacagtgctccaccaggactggctgaacggcaaggagtataaatgcaaggtttctaataaagcccttcccgctccgattgaaaagaccatctccaaggccaaaggccagcctagagagccccaagtgtacacactgcctcccagccgggaagagatgacgaagaaccaggtctctctcacctgtctggtgaaagggttctatccttccgacatcgctgtggaatgggagagcaatggacagcccgagaacaattacaagacaaccccgcctgttcttgattccgacggcagctttttcctgtatagcaaactcacagtcgataagtcccgctggcagcaagggaacgtgttttcttgcagcgtgatgcacgaagccctgcataaccactacacccagaagtccctgagcctctctcccggaaaa

SEQ ID NO: 38883 - RNA, 654 nt, synthetic construct
  misc_feature 1..654: note = derived and/or modified sequence opt5 from Pascolizumab_LightChain1
  source 1..654: mol_type = other RNA
gacatcgtgctgacccagagcccctcctctctcagcgcctccgtcggcgatagagttacaattacgtgcaaggcttctcaaagcgtggactacgatggggactcctatatgaactggtaccagcagaaacctggaaaggccccgaaactgcttatctatgcggcttctaatctggagagcggcattccctcccggttcagcgggtctggatccggcaccgattttacattcaccatcagctctctccagcctgaagacattgccacatactattgtcaacagtccaacgaggatccccctacctttgggcagggaacaaaggtggaaatcaaacgcaccgtcgccgctcccagcgtgttcatctttcctccgtctgacgagcagctgaagtccggcacggccagcgttgtgtgccttctgaataacttctaccccagagaagctaaggtccaatggaaagtggataatgccctccagtccggcaactctcaggagagcgttaccgagcaggactccaaggatagcacatattctctgtccagcaccctgacactctctaaagcggactacgaaaagcacaaagtgtacgcctgtgaggtcacccatcaagggctgagctcccctgtgacgaagtcttttaatcggggagaatgc

SEQ ID NO: 38884 - RNA, 1512 nt, synthetic construct
  misc_feature 1..1512: note = derived and/or modified sequence opt5 from Pasotuxizumab_HeavyChain1
  source 1..1512: mol_type = other RNA
caggtgcaactggtcgagagcggcgggggactcgttaagcccggcgaatccctgagactttcttgcgccgctagcgggttcaccttttccgactactatatgtactgggtgcggcaggcccctggaaaaggcctggagtgggtggcgatcatttctgatgggggatattacacatattacagcgacatcattaagggccgcttcacgatctccagagataacgctaaaaattctctctatctgcagatgaacagccttaaggccgaagacaccgccgtctactactgtgctcggggctttccgctgctccgccacggggccatggattattggggacagggcacactggtgaccgtttccagcgggggaggcgggtctggaggcggcgggtccggaggcgggggaagcgacattcaaatgacacagtctccctccagcctgtctgcttccgtgggcgatagagtcaccatcacatgcaaagccagccagaatgtggacaccaacgttgcgtggtaccagcaaaagcctgggcaggcccccaagtccctcatctattctgctagctaccggtattccgatgtgcctagccgcttctctggatccgccagcggcacggactttaccctgacaatttctagcgtccagtccgaggatttcgctacctactattgtcagcaatacgactcttacccctatacatttggcgggggaaccaaacttgaaatcaagagcggcgggggaggctccgaggtgcagctggtggagagcgggggcggactcgtccagcctggcgggtctctgaaactttcctgcgccgcgagcggattcacgtttaataagtacgccatgaactgggttagacaagctccgggcaaagggctggaatgggtggcccggattcgctctaagtataataactacgctacatattacgccgattccgtgaaggacagattcaccatcagccgggacgattccaaaaatacagcctatctccagatgaacaatctgaagaccgaggacaccgctgtctactactgtgtgcgccatggaaactttggcaattcttatattagctactgggcgtattgggggcagggcacactggttacggtgtcctctggaggcgggggaagcggcgggggaggctccgggggcggaggcagccagaccgtcgtgacacaagaaccctctctcaccgtttcccctgggggaacagtgaccctgacgtgcggcagctctacaggggccgtcacctccggaaactaccccaattgggtgcagcagaaacctggccaggctcccagagggcttatcggcggaaccaagttcctggccccgggcacccctgcccggtttagcgggtctctcctgggaggcaaagctgcccttacactgagcggggtccaacccgaggatgaggcggaatattactgtgtgctctggtattccaaccgctgggttttcggaggcggcacaaagctgacggtgctgcaccatcaccatcaccac

SEQ ID NO: 38885 - RNA, 1512 nt, synthetic construct
  misc_feature 1..1512: note = derived and/or modified sequence opt5 from Pasotuxizumab_SingleChain
  source 1..1512: mol_type = other RNA
caggtgcaactggtccagagcggcgggggactcgttaagcccggcgagtccctgagactttcttgcgccgctagcgggttcaccttttccgactactatatgtactgggtgcggcaggcccctggaaaaggcctggaatgggtggcgatcatttctgatgggggatattacacatattacagcgacatcattaagggccgcttcacgatctccagagataacgctaaaaattctctctatctgcagatgaacagccttaaggccgaggacaccgccgtctactactgtgctcggggctttccgctgctccgccacggggccatggattattggggacaaggcacactggtgaccgtttccagcgggggaggcgggtctggaggcggcgggtccggaggcgggggaagcgacattcagatgacacagtctccctccagcctgtctgcttccgtgggcgatagagtcaccatcacatgcaaagccagccagaatgtggacaccaacgttgcgtggtaccaacagaagcctgggcaggcccccaagtccctcatctattctgctagctaccggtattccgatgtgcctagccgcttctctggatccgccagcggcacggactttaccctgacaatttctagcgtccagtccgaagatttcgctacctactattgtcaacagtacgactcttacccctatacatttggcgggggaaccaaacttgagatcaagagcggcgggggaggctccgaagtgcagctggtggagagcgggggcggactcgtccaacctggcgggtctctgaaactttcctgcgccgcgagcggattcacgtttaataagtacgccatgaactgggttagacaggctccgggcaaagggctggagtgggtggcccggattcgctctaagtataataactacgctacatattacgccgattccgtgaaggacagattcaccatcagccgggacgattccaaaaatacagcctatctccagatgaacaatctgaagaccgaagacaccgctgtctactactgtgtgcgccatggaaactttggcaattcttatattagctactgggcgtattgggggcagggcacactggttacggtgtcctctggaggcgggggaagcggcgggggaggctccgggggcggaggcagccaaaccgtcgtgacacaggagccctctctcaccgtttcccctgggggaacagtgaccctgacgtgcggcagctctacaggggccgtcacctccggaaactaccccaattgggtgcagcagaaacctggccaagctcccagagggcttatcggcggaaccaagttcctggccccgggcacccctgcccggtttagcgggtctctcctgggaggcaaagctgcccttacactgagcggggtccagcccgaagatgaggcggagtattactgtgtgctctggtattccaaccgctgggttttcggaggcggcacaaagctgacggtgctgcaccatcaccatcaccac

SEQ ID NO: 38886 - RNA, 1341 nt, synthetic construct
  misc_feature 1..1341: note = derived and/or modified sequence opt5 from Pateclizumab_HeavyChain1
  source 1..1341: mol_type = other RNA
gaggtgcagctggtcgaaagcggcgggggactcgttcaacccggcgggtccctgagactttcttgcgccgctagcggatacaccttcacatcctatgtgatccactgggtgcggcaggcccctggcaaggggctggagtgggtcggatacaacaatccgtataacgcgggcacgaattacaacgaaaaatttaagggccgcttcaccatttctagcgacaaatccaagaatacagcttatctccagatgaactctctgagagccgaggataccgccgtgtactattgtagccggcccacaatgcttccttggtttgcttactgggggcagggaaccctggttacagtgtccagcgcctctaccaaaggcccctccgtcttccctctcgctcccagctctaagtccacgagcgggggaaccgccgcgctgggctgcctggtgaaggactactttcctgaaccggttacagtgtcttggaactccggggccctcaccagcggagtccatacattccccgctgtgctgcaatcctctggcctttatagcctgtccagcgtggtcaccgttccttcttccagcctcggcacgcagacatacatctgtaatgtgaatcacaaaccctctaacaccaaggtggataaaaaggtcgagcctaaaagctgcgacaagacacatacctgtcccccgtgccctgcccccgagctgcttgggggaccttccgtgtttctgttccctcccaagcccaaagataccctcatgatttctcgcacaccggaagttacgtgtgtggtcgtggacgttagccacgaggatcccgaagtgaagtttaattggtatgtcgacggcgtggaggtccataacgctaaaaccaagcctagagaggaacagtacaattccacatatcgggtggttagcgtgctgaccgtcctgcaccaggattggctcaacgggaaagagtacaagtgcaaagtgtctaataaggccctgcccgcgcctatcgaaaagacaatttccaaagccaagggacaaccccgcgagccgcaggtttatacccttcctcccagcagagaagagatgacgaaaaaccaggtgtctctgacatgtctcgtcaagggcttctacccttccgacatcgctgtggagtgggaaagcaacgggcagcccgagaataactacaaaaccacccctcccgtgctggattccgacggatctttctttctttatagcaagctgacagttgataagtcccggtggcaacagggcaatgtcttttcttgcagcgtgatgcacgaagccctccataaccactacacccagaaatccctgagcctgtctccgggc

SEQ ID NO: 38887 - RNA, 642 nt, synthetic construct
  misc_feature 1..642: note = derived and/or modified sequence opt5 from Pateclizumab_LightChain1
  source 1..642: mol_type = other RNA
gacatccagatgacccaaagcccctcctctctgagcgcctccgtgggcgatagagtcacaattacgtgccgggcttctcaggccgttagctccgcggtggcttggtaccagcagaaacctgggaaagccccgaagctcctgatctattctgccagccaccgctacaccggagtgccctccagattcagcggctctgggtccggaacagactttacccttacaattagctctctgcaacctgaggatttcgctacctattactgtcaggaatcctatagcacaccctggacctttggccaggggacgaaagtcgagatcaagcggaccgtggccgctccttctgttttcatttttcccccttccgacgaacagctcaaaagcggaacagcctccgtggtctgcctgcttaacaatttctacccgcgcgaggcgaaggtgcaatggaaggttgataacgccctgcagtctggcaatagccaggaatccgtgaccgagcaggacagcaaagattctacatattccctcagctctaccctgacgctgagcaaggctgactacgagaaacataaggtctacgcctgtgaagtgacacaccaaggcctctcctctcccgtgaccaagagctttaacagaggggagtgc

SEQ ID NO: 38888 - RNA, 1341 nt, synthetic construct
  misc_feature 1..1341: note = derived and/or modified sequence opt5 from Patritumab_HeavyChain1
  source 1..1341: mol_type = other RNA
caagtgcaactgcagcagtggggcgccgggctcctgaagcccagcgagaccctttccctgacatgcgctgtctacggaggctctttcagcgggtattactggtcctggatcagacagcctccgggaaaaggcctcgaatggattggggagatcaaccactctggaagcacgaattataacccctccctgaagtctcgggttaccattagcgtggaaacatccaaaaatcaatttagccttaagctgtcttccgtgaccgccgcggacacagctgtctactattgtgcccgcgataaatggacctggtacttcgacctctggggcagaggcacactggtgaccgttagctctgcctccacgaaggggcctagcgtgtttcccctggctccttcttccaagagcacctccggaggcacagccgctctcgggtgcctggtcaaagattatttccccgagcctgtgaccgtttcttggaacagcggagcccttacatccggcgtgcatacctttccggcggtcctgcagagctctgggctctactccctgagctctgtggtgacggtccccagctcctctcttggaacacagacctacatctgtaatgttaaccacaagcctagcaatacaaaagtggacaagcgggtggaacccaaatcctgcgataagacccatacctgtcctccctgcccggcccctgagctgctcggcggccccagcgtcttcctgtttcctcccaagcccaaagacacactgatgatttctcgcacgcctgaggtgacctgtgttgtggtcgatgtgtcccacgaagacccggaggttaagttcaactggtatgtggatggggtcgaagtgcataatgctaaaacaaagcccagagaggagcagtacaacagcacctatcgggtcgtgtctgttctcacagtgctgcaccaagactggcttaatggaaaagaatacaagtgcaaagtctccaacaaggccctgcctgctcccatcgagaagaccatcagcaaagccaagggccagcctcgcgaaccccaggtgtatacgctcccgccttccagagaggaaatgaccaaaaatcaggtttctctgacatgtcttgtgaaggggttttaccccagcgatattgcggtcgagtgggagtccaacggacaacctgaaaataactataaaaccacaccccctgtgctggactctgatggcagcttctttctctactccaagctgaccgtggacaagagccggtggcagcaggggaacgttttctcttgctccgtcatgcacgaggccctgcataatcactacacacagaaaagcctctctctgtcccccggaaag

SEQ ID NO: 38889 - RNA, 681 nt, synthetic construct; identical to SEQ ID NO: 38845
  misc_feature 1..681: note = derived and/or modified sequence opt5 from Patritumab_hinge-CH2-CH3
  source 1..681: mol_type = other RNA

SEQ ID NO: 38890 - RNA, 660 nt, synthetic construct
  misc_feature 1..660: note = derived and/or modified sequence opt5 from Patritumab_LightChain1
  source 1..660: mol_type = other RNA
gacatcgagatgacccagagccccgattccctggccgtgtctctcggcgaaagagctacaattaactgccggagctcccaatctgtcctgtacagctcctctaatcgcaactatcttgcctggtaccagcagaatcctgggcagccgcccaagctgctcatctattgggcgagcacgagagagtccggagttcctgaccggttcagcggctctgggtccggaaccgattttacactgaccattagctctcttcaagctgaagacgtggccgtgtactattgtcagcagtactattccacaccccgcaccttcggccaggggacaaaagtcgagatcaagagaaccgtggccgctcctagcgtttttatttttcccccttctgatgaacaactgaaatccggaacggccagcgtggtctgcctcctgaacaatttctacccgcgggaggctaaggtgcagtggaaagttgacaacgccctgcagtccggcaattctcaggagagcgtgaccgaacaagattccaaggacagcacatactctctctccagcaccctgacactttctaaggcggattatgagaaacacaaggtctacgcctgtgaagtgacccatcagggcctgagctcccccgtgacgaaatctttcaaccgcggggagtgc

SEQ ID NO: 38891 - RNA, 1341 nt, synthetic construct; identical to SEQ ID NO: 38706
  misc_feature 1..1341: note = derived and/or modified sequence opt5 from Pembrolizumab_HeavyChain1
  source 1..1341: mol_type = other RNA

SEQ ID NO: 38892 - RNA, 654 nt, synthetic construct; identical to SEQ ID NO: 38707
  misc_feature 1..654: note = derived and/or modified sequence opt5 from Pembrolizumab_LightChain1
  source 1..654: mol_type = other RNA

SEQ ID NO: 38893 - RNA, 1356 nt, synthetic construct
  misc_feature 1..1356: note = derived and/or modified sequence opt5 from Perakizumab_HeavyChain1
  source 1..1356: mol_type = other RNA
gaggtgcagctggtcgaaagcggcgggggactcgttcagcccggcgggtccctgagactttcttgcgccgctagcggattcaccttttccgactacacaatgctgtgggtgcggcaggcccctggcaaggggctcgagtgggtggcgatcattaaatctggaggcagctattcctactatccggattctgtcaagggccgcttcacgatcagcagagacaacgctaaaaattccctgtaccttcagatgaacagcctgcgggccgaagataccgccgtgtattactgtgctcgcgacggggattatggatcttcctacggcgccatggactactgggggcagggaacactcgttaccgtgagctctgcttccacaaagggccccagcgtctttcctctggccccctcttccaaaagcacctccgggggaacagcggccctgggctgcctcgtgaaggattatttccctgagcccgttaccgtgtcttggaatagcggcgctctgacgtccggggtccacacctttcctgccgtgcttcaaagctctggactgtactccctcagctctgtggtcacagttccgagctcctctctgggcacccagacatatatttgtaacgtgaatcataagcccagcaacaccaaagtggacaagaaagtcgaacctaagtcctgcgataaaacgcacacatgtcccccttgccccgctccggaggccgccgggggacctagcgtgttcctttttccccctaagcccaaggacaccctgatgatctctagaacacccgaggttacctgtgtggtcgtggatgtttcccatgaagaccctgaggtgaaattcaattggtacgtcgatggcgtggaagtccacaacgcgaagaccaaaccgcgggaggagcagtataatagcacataccgcgtggtttctgtgctcacggtcctgcatcaggactggctgaacgggaaggaatataaatgcaaggtgtccaataaagctctccccgcccctattgagaagaccatcagcaaggctaaaggacaacccagagaacctcaggtttacacactgcccccgtcccgggacgagcttaccaagaaccaggtgtctctgacatgtctcgtcaaaggcttttaccctagcgatatcgccgtggaatgggagtccaatggccagcccgagaacaattataagaccacgcctcccgtgctggactctgatgggagcttctttctttactccaaactgacagttgacaagagccgctggcaacagggaaacgtcttctcttgctccgtgatgcacgaagccctccacaaccattatacccaaaagagcctgtctctgtcccctggcaaa

SEQ ID NO: 38894 - RNA, 645 nt, synthetic construct
  misc_feature 1..645: note = derived and/or modified sequence opt5 from Perakizumab_LightChain1
  source 1..645: mol_type = other RNA
gacatccagatgacccaaagcccctcctctctgagcgcctccgtgggcgatcgggtcacaattacgtgccgggcttctcaggacatcaacagctacctctcctggttccagcagaagcctgggaaagccccgaagtctctgattgttcgcgcgaatagacttgtggatggagtgcccagccggttttccggcagcgggtctggacaagactattccctgaccatcagctctctccagcctgaggatttcgctacatactattgtctgcagtacgacgcctttcccccttataccttcggccaggggacaaaacttgaaattaagcgcaccgtcgccgctccctccgtgtttatcttccctccgagcgatgagcaactgaaatctggaacagcctccgttgtgtgcctcctgaacaatttttaccccagagaagctaaggtccagtggaaggtggacaacgccctgcagagcggcaattcccaggagtctgttaccgaacaagatagcaaagactccacgtatagcctctcttccaccctgacacttagcaaggcggattacgagaaacacaaggtgtacgcctgtgaggtcacccatcagggcctgtctagccctgtgacaaaatccttcaacagaggggaatgc

SEQ ID NO: 38895 - RNA, 1332 nt, synthetic construct
  misc_feature 1..1332: note = derived and/or modified sequence opt5 from Pertuzuab_HeavyChain1
  source 1..1332: mol_type = other RNA
gaggtgcagctggtcgaaagcggcgggggactcgttcaacccggcgggtccctgagactttcttgcgccgctagcggattcacctttacagactacacggattgggtgcggcaggcccctggcaaggggctggagtgggtggcggacgtcaaccccaattccggaggctctatctataaccagcgcttcaaaggcagatttaccctcagcgtggatcggtccaagaatacactgtaccttcagaactctctgcgcgctgaagacaccgccgtttattactgtgccagaaatctcgggcccagcttctattttgattactggggacaaggcacactggtgaccgtctccagcgcttctacaaaagggccttccgtgttccccctggcccctagctctaagtccaccagcggaggcacggctgccctcgggtgcctggttaaagactattttcccgagcctgtgaccgtctcttggaactccggagcgcttacaagcggcgtgcacaccttcccggccgtgctgcagtcctctggcctctacagcctgtccagcgtcgttacagtgccctcttccagccttgggacccagacgtacatttgtaatgtgaaccataagccttctaatacaaaggtcgataaaaaggtggaacccaaaagctgcgacaagacccacacatgtcctccctgcccggctcctgagctgctcggaggcccctccgtttttctgttccctcccaaacccaaggataccctgatctctcggacccctgaggtgacatgtgtcgtggttgacgtgagccatgaagatccggaggtcaagtttaactggtatgtggacggggtcgaagtgcacaatgccaaaacgaagccccgcgaggagcagtacaactccacctatagagttgtgagcgtcctcacagtgctgcatcaagattggcttaatggaaaagaatacaagtgcaaagtttctaacaaggctctgcctgcccccattgagaaaaccatctccaaggcgaagggccagcctcgggaaccccaggtgtatacactcccgcctagccgcgaggaaaccaaaaatcaggtctctctgacgtgtcttgtgaaggggttctacccctccgacattgccgtggagtgggagagcaacggacaacctgaaaacaattataaaacaaccccgcctgttctggactccgatggcagctttttcctctactctaagctgaccgtcgacaaatccagatggcagcagggcaacgtgttctcttgcagcgtgcacgaggctctgcacaatcattacacacaaaagtccctcagcctgtctcccgggaag

SEQ ID NO: 38896 - RNA, 639 nt, synthetic construct
  misc_feature 1..639: note = derived and/or modified sequence opt5 from Pertuzuab_LightChain1
  source 1..639: mol_type = other RNA
gacatccagacccaaagcccctcctctctgagcgcctccgtgggcgatagagtcacaattacgtgcaaggcttctcaggacgttagcatcggggtggcctggtaccagcagaaacctggaaaggcgccgaaactcctgatttattccgcttcttaccggtataccggcgtgcccagccgcttctccgggagcggatctggcacagattttacccttacaatctccagcctgcaacctgaggacttcgccacctactattgtcagcagtactatatttacccctacacatttgggcagggaaccaaggtcgaaatcaaaagaacggtggccgctccttctgttttcatctttcccccttccgatgagcaactcaagagcggcaccgcctctgtggtctgcctgcttaacaatttctatccgcgggaagctaaggtgcagtggaaagttgacaacgccctgcagtccggcaatagccaggagtccgtgacagaacaagattctaaggacagcacctactccctcagctctacactgaccctgtccaaagcggattatgagaagcacaaagtctacgcctgtgaggtgacgcatcaggggctcagctctcccgtgacaaagagctttaaccgcggagaatgc

SEQ ID NO: 38897 - RNA, 642 nt, synthetic construct
  misc_feature 1..642: note = derived and/or modified sequence opt5 from Pertuzumab_HeavyChain
  source 1..642: mol_type = other RNA
gacatccagatgacccaaagcccctcctctctgagcgcctccgtgggcgatagagtcacaattacgtgcaaggcttctcaggacgttagcatcggggtggcctggtaccagcagaaacctggaaaggcgccgaaactcctgatttattccgcttcttaccggtataccggcgtgcccagccgcttctccgggagcggatctggcacagattttacccttacaatctccagcctgcaacctgaggacttcgccacctactattgtcagcagtactatatttacccctacacatttgggcagggaaccaaggtcgaaatcaaaagaacggtggccgctccttctgttttcatctttcccccttccgatgagcaactcaagagcggcaccgcctctgtggtctgcctgcttaacaatttctatccgcgggaagctaaggtgcagtggaaagttgacaacgccctgcagtccggcaatagccaggagtccgtgacagaacaagattctaaggacagcacctactccctcagctctacactgaccctgtccaaagcggattatgagaagcacaaagtctacgcctgtgaggtgacgcatcaggggctcagctctcccgtgacaaagagctttaaccgcggagaatgc

SEQ ID NO: 38898 - RNA, 1344 nt, synthetic construct
  misc_feature 1..1344: note = derived and/or modified sequence opt5 from Pertuzumab_LightChain
  source 1..1344: mol_type = other RNA
gaggtgcagctggtcgaaagcggcgggggactcgttcaacccggcgggtccctgagactttcttgcgccgctagcggattcacctttacagactacacgatggattgggtgcggcaggcccctggcaaggggctggagtgggtggcggacgtcaaccccaattccggaggctctatctataaccagcgcttcaaaggcagatttaccctcagcgtggatcggtccaagaatacactgtaccttcagatgaactctctgcgcgctgaagacaccgccgtttattactgtgccagaaatctcgggcccagcttctattttgattactggggacaaggcacactggtgaccgtctccagcgcttctacaaaagggccttccgtgttccccctggcccctagctctaagtccaccagcggaggcacggctgccctcgggtgcctggttaaagactattttcccgagcctgtgaccgtctcttggaactccggagcgcttacaagcggcgtgcacaccttcccggccgtgctgcagtcctctggcctctacagcctgtccagcgtcgttacagtgccctcttccagccttgggacccagacgtacatttgtaatgtgaaccataagccttctaatacaaaggtcgataaaaaggtggaacccaaaagctgcgacaagacccacacatgtcctccctgcccggctcctgagctgctcggaggcccctccgtttttctgttccctcccaaacccaaggataccctgatgatctctcggacccctgaggtgacatgtgtcgtggttgacgtgagccatgaagatccggaggtcaagtttaactggtatgtggacggggtcgaagtgcacaatgccaaaacgaagccccgcgaggagcagtacaactccacctatagagttgtgagcgtcctcacagtgctgcatcaagattggcttaatggaaaagaatacaagtgcaaagtttctaacaaggctctgcctgcccccattgagaaaaccatctccaaggcgaagggccagcctcgggaaccccaggtgtatacactcccgcctagccgcgaggaaatgaccaaaaatcaggtctctctgacgtgtcttgtgaaggggttctacccctccgacattgccgtggagtgggagagcaacggacaacctgaaaacaattataaaacaaccccgcctgttctggactccgatggcagctttttcctctactctaagctgaccgtcgacaaatccagatggcagcagggcaacgtgttctcttgcagcgtgatgcacgaggctctgcacaatcattacacacaaaagtccctcagcctgtctcccggg

SEQ ID NO: 38899 - RNA, 750 nt, synthetic construct
  misc_feature 1..750: note = derived and/or modified sequence opt5 from Pexelizumab_h5g1.1-scFv
  source 1..750: mol_type = other RNA
atggccgacatccagatgacccaaagcccctcctctctgagcgcttccgtgggcgatagagtcacaattacgtgcggggcctctgagaacatctacggagcgctcaattggtatcagcggaagcctggcaaagctccgaagctgcttatttacggggccaccaacctggccgacggagttcccagccgcttctccggctctgggagcggaacagattataccctcacaatctccagcctgcagcctgaagactttgctacctactattgtcagaatgtgcttaacacacccctgaccttcggccaaggcacgaaagtggagattaagagaaccgggggaggcgggtctggaggcgggggatccggcggcgggggaagccaggtccagctcgtgcagtctggcgccgaagttgagaaacctggggcttccgtgaagaaggtcagctgcaaagcctctggatacatcttttccaattattggatccaatgggtgcggcaggcgcccggccaggggctggaatggatgggagagattctgcctggcagcggctccacagagtacgcccagaagttccaagggcgcgttaccatgacagctgatacctctacgagcacagcctacatggaactctccagcctgagatctgaggacaccgctgtgtattactgtgcccggtactttttcggatccagcccgaactattggtattttgatgtctggggccaggggacacttgtgaccgtgtctagc

SEQ ID NO: 38900 - RNA, 345 nt, synthetic construct
  misc_feature 1..345: note = derived and/or modified sequence opt5 from Pexelizumab_h5g1.1VHC_+_F_Heavy_Chain_V-Region
  source 1..345: mol_type = other RNA
caggtgcaactggtccagagcggcgccgaggttaagaaacccggggcttccgtgaaggtgtcttgcaaagccagcggatacatcttctccaactattggattcagtgggtcagacaggcgcctggccaagggctcgaatggatgggagagatcctgccgggctctgggagcaccgaatacgctcagaagtttcagggacgggtgacaatgacggccgacacctccacatctaccgcctatatggagcttagctccctgcgcagcgaagatacagctgtttactattgtgccagatacttctttgggtcttcccccaattggtatttcgtgtggggccagggcacc

SEQ ID NO: 38901 - RNA, 318 nt, synthetic construct
  misc_feature 1..318: note = derived and/or modified sequence opt5 from Pexelizumab_h5g1.1VHC_+_F_Light_Chain_V-Region
  source 1..318: mol_type = other RNA
gacatccagatgacccaaagcccctccctgtctgccagcgtgggcgatagagtcacaattacgtgcggggcttccgagaacatctacggagccctcaattggtatcagcggaagcctggcaaagcgccgaagctgcttatttacggggctaccaacctggccgacggagttccctctcgcttcagcggctccgggtctggaacagattataccctcacaatcagctccctgcagcctgaagactttgccacctactattgtcagaatgtgcttaacacacccctgaccttcggccaaggcacgaaagtggagattaag

SEQ ID NO: 38902 - RNA, 1326 nt, synthetic construct
  misc_feature 1..1326: note = derived and/or modified sequence opt5 from PF-05082566_HeavyChain1
  source 1..1326: mol_type = other RNA
gaggtgcagctggtccaaagcggcgccgaagttaagaaacccggggagtccctcagaatctcttgcaagggaagcggctactccttctctacctattggattagctgggtgcggcagatgcctgggaaaggactggaatggatgggcaagatctacccgggggactcctatacaaactactctcccagctttcagggacaggtgacgatttccgctgataaaagcatctctaccgcctatcttcaatggtccagcctgaaggcgtctgacacagctatgtactattgtgcccgcggctacggcattttcgattactgggggcagggaaccctcgtcacagtgtccagcgcctctaccaagggcccttccgtttttcccctggctccttgcagcagatccacatctgagagcaccgccgctcttgggtgtctggtgaaagactatttccccgaacctgtcacggtgtcctggaatagcggagccctcacctctggcgttcacacatttccggcggtgctgcagtccagcgggctgtactctctcagctccgtcgtgaccgtgccctctagcaacttcggaacacagacctatacgtgcaatgtcgatcataagccttccaacacaaaagttgacaagaccgtggagcggaaatgttgcgtggagtgtcccccttgccccgccccgcctgtcgctggccccagcgtgtttctgttccctcccaagcccaaggatacacttatgatctctcgcacccctgaagttacctgtgtggtcgtggacgtttcccacgaggatccggaagtgcaatttaattggtacgtcgacggcgtggaggtccataacgccaaaacaaagcccagagaggaacagttcaatagcacgtttcgggtggtttctgtgctgaccgtcgtgcaccaggattggctcaacgggaaagagtataagtgcaaagtttccaataagggactgcctgctcccatcgaaaagacaattagcaagaccaagggccagcctcgcgagccccaagtgtacacacttccgccttccagagaagagatgaccaaaaaccaggtctctctgacgtgtctcgtgaaggggttctatcccagcgacatcgccgtggagtgggaatccaatggacagcctgagaacaattacaaaacaacaccccctatgctggattctgacggcagctttttcctgtactccaagctcaccgttgacaaaagccggtggcaacaggggaacgtcttctcttgctccgtgatgcatgaagcgctgcacaatcactatacccagaaaagcctttctctgtcccccggaaag

SEQ ID NO: 38903 - RNA, 642 nt, synthetic construct
  misc_feature 1..642: note = derived and/or modified sequence opt5 from PF-05082568_LightChain1
  source 1..642: mol_type = other RNA
agctacgagctgacccagcccccttccgtgtctgtcagcccgggccaaacagcctccatcacgtgctctggggacaacattggagatcagtatgctcactggtaccagcagaagcccggccaaagccctgttctcgtgatctatcaggacaaaaatagaccctccgggattcctgaacggttctctggaagcaactccggcaataccgccacactgaccatcagcgggacacaggcgatggatgaggctgactactattgtgccacctacacaggatttggctctcttgccgtgttcggcgggggaaccaagctgacggtcctcggccagcccaaagctgccccttccgtgaccctgtttccgcccagctctgaagaacttcaagctaacaaggccacactggtttgcctcatttccgatttctatcctggggcggtgaccgtcgcctggaaagctgacagctctcccgtgaaggccggagttgaaacaaccacgccttccaagcagagcaataacaaatacgctgcctcctcttacctgagcctgacacccgagcagtggaagtcccatcgcagctattcttgtcaggtgacccacgagggctccacagtcgagaaaaccgtggcgccgaccgagtgcagc

SEQ ID NO: 38904 - RNA, 1341 nt, synthetic construct
  misc_feature 1..1341: note = derived and/or modified sequence opt5 from Pidilizumab_HeavyChain1
  source 1..1341: mol_type = other RNA
caggtgcaactggtccagagcggctccgagctcaagaaacccggggcctctgttaagatcagctgcaaggcttccggatacaccttcacaaactatggcatgaattgggtgagacaggcccctgggcagggactgcaatggatgggctggattaacacggactctggggaaagcacctacgcggaggaatttaaaggacggttcgtgttttcccttgatacatctgtcaataccgcttatctgcagatcacaagcctcaccgccgaggacacaggcatgtacttctgtgtgcgcgttggctatgatgccctggactactgggggcagggaacccttgtgacggtctccagcgcttctaccaaaggcccgtccgtgtttcccctggcccctagctctaagtccacaagcgggggaaccgctgccctcggctgcctggttaaggattatttccccgaacctgtgacagtctcttggaactccggggcgctgaccagcggagtgcacacgtttcccgccgtgctccagtcctctggcctgtacagcctttccagcgtcgttacagtgccttcttccagcctgggcacccaaacatacatttgtaatgtgaaccataaaccgtctaataccaaggtcgacaaaagagtggagcccaagagctgcgataaaacccacacatgtcctccctgccctgctcccgagctccttgggggaccgtccgttttcctgtttcctcccaagcctaaggacacgctgatgatctctcggacccccgaagtgacatgtgtcgtggttgatgtgagccatgaggaccccgaagtcaaattcaactggtatgtggatggcgtcgaggtgcacaatgccaagaccaaacctcgcgaggaacagtacaactccacatatagagttgtgagcgtcctcaccgtgctgcatcaggactggctgaatgggaaggagtacaaatgcaaggtttctaacaaagctctcccggcccccattgaaaagacgatctccaaggcgaaaggacagcctcgggagccccaagtgtatacactgcctcccagccgcgaagagatgaccaagaatcaggtctctcttacctgtctggtgaaaggcttttacccgtccgatatcgccgtggagtgggaaagcaacgggcagcctgagaataactataagacaacaccccctgttctcgactccgacggatctttctttctgtacagcaaacttaccgtcgataagtccagatggcaacagggcaacgtgttctcttgcagcgtgatgcacgaagctctgcacaatcattacacgcagaagtccctcagcctgtctcccggcaaa

SEQ ID NO: 38905 - RNA, 639 nt, synthetic construct
  misc_feature 1..639: note = derived and/or modified sequence opt5 from Pidilizumab_LightChain1
  source 1..639: mol_type = other RNA
gagatcgtgctgacccagagcccctcctctctcagcgcctccgtcggcgacagagttacaattacgtgctctgctcggagctccgtgtcttacatgcactggttccaacagaagcctgggaaagccccgaagctgtggatctatcgcaccagcaaccttgcgtccggagtgcccagcagattttctggctccgggagcggaacatcttactgtctgaccattaattccctccagcctgaagatttcgctacatattactgccagcaacggagctcttttcccctgaccttcggcgggggaacaaaacttgagatcaagcgcaccgtcgccgccccttccgtgtttatttttccccctagcgacgaacagctgaaatccggcacggcttctgttgtgtgtctcctgaacaatttctatccgagagaggccaaggtccagtggaaggtggataacgctctgcagagcggcaattcccaagaaagcgttaccgagcaggactctaaagattccacatacagcctctctagcaccctgacactttccaaggccgactatgagaaacataaggtgtacgcgtgcgaagtcacccaccaggggctgtctagccccgtgacgaaatccttcaaccggggagagtgt

SEQ ID NO: 38906 - RNA, 1350 nt, synthetic construct
  misc_feature 1..1350: note = derived and/or modified sequence opt5 from Pinatuzumab_vedotin_HeavyChain1
  source 1..1350: mol_type = other RNA
gaggtgcagctggtcgaaagcggcgggggactcgttcaacccggcgggtccctgagactttcttgcgccgctagcggatacgagttctcccggtcttggatgaactgggtgcgccaggcccctggcaaggggctggaatgggtgggaagaatctatccgggcgacggcgataccaattacagcgggaaatttaagggacggttcacaatttccgcggacacgtctaaaaacaccgcttatctccagatgaatagcctgcgcgccgaggatacagccgtctactattgtgctagagacggctccagctgggattggtactttgacgtgtgggggcagggaacccttgttacagtgtcttccgccagcaccaagggcccctctgtcttccctctggctccctccagcaaatctacatccgggggaaccgccgcgctcggctgcctggtgaaggattattttcctgaacccgttacggtgagctggaactccggcgccctgacctctggggtccacacattccctgctgtgctccaaagctccggactgtacagcctttcttccgtggtcaccgttccgagctctagcctgggcacacagacctacatctgtaatgtgaaccataagccctccaatacgaaagtggacaagaaagtcgagcctaagtcttgcgataaaacacacacctgtcccccttgccccgccccggagctccttgggggacctagcgtgtttctgtttccccctaagcccaaggacacactgatgatttcccggacccccgaagttacctgtgtggtcgtggatgttagccatgaggaccctgaagtgaaattcaactggtatgtcgatggcgtggaggtccacaatgctaagacaaaaccgcgcgaggaacagtacaactctacgtatagagtggtttccgtgctcaccgtcctgcatcaggactggctgaatgggaaggagtacaaatgcaaggtgagcaacaaagccctccccgcgcctatcgaaaagacaatttctaaggccaaaggacaaccccgggagcctcaggtttataccctgcccccgtcccgcgaagagatgacaaagaatcaggtgagccttacctgtctggtcaaaggcttctacccttccgacatcgctgtggagtgggaatctaacggccagcccgagaataactataagacgacacctcccgtgctcgatagcgacgggtcctttttcctgtactctaaacttaccgttgataagagcagatggcaacagggaaacgtcttttcctgcagcgtgatgcacgaagccctgcacaatcattacacccagaagtctctctccctgagccctggcaaa

SEQ ID NO: 38907 - RNA, 657 nt, synthetic construct
  misc_feature 1..657: note = derived and/or modified sequence opt5 from Pinatuzumab_vedotin_LightChain1
  source 1..657: mol_type = other RNA
gacatccagatgacccaaagcccctcctctctgagcgcctccgtgggcgatagagtcacaattacgtgccggtctagccagtccatcgttcactctgtggggaacaccttcctcgagtggtaccagcagaagcctggaaaagctccgaagctgcttatttataaagtgagcaatcgcttttccggcgtccccagcagattctctgggtccggaagcggcacagactttaccctgacaatctcttccctccaacctgaagatttcgccacctactattgttttcaggggagccagttcccctacacatttggacagggcaccaaggtggagattaaacggacggttgcggctccttctgtgttcatctttcccccttccgacgaacaacttaagagcggcaccgcctccgtcgtgtgcctgctgaacaatttctatccgcgcgaggccaaggttcagtggaaagtggataacgctctccagtctgggaatagccaggaatccgtcacagagcaagacagcaaggattctacctactccctgagctctacactgaccctcagcaaagccgactatgagaagcataaagtgtacgcttgtgaagtgacgcaccagggactgtcctctcccgtcacaaagagctttaacagaggcgagtgc

SEQ ID NO: 38908 - RNA, 1023 nt, synthetic construct
  misc_feature 1..1023: note = derived and/or modified sequence opt5 from Placulumab_chain1
  source 1..1023: mol_type = other RNA
gacatccagatgacccaaagcccctcctctctgagcgcctccgtgggcgatagagtcacaattacgtgccgggcttctcaggccatcgacagctacctccactggtatcagcagaagcctgggaaagcgccgaagctgcttatttactccgcttctaacctggagaccggagttcccagccgcttctccggcagcgggtctggaacagattttaccctcacaatctccagcctgcttcctgaagacttcgccacctattactgtcaacaggtggtgtggagaccctttacattcggccaggggaccaaagtcgagattaagcgggtggaacctaaatcttccgataagacgcatacctgtcccccttgcccggcccccgagctgctcggaggccctagcgtttttctgtttccccctaagcccaaagacacactgatgatctctcgcaccccggaagtgacatgcgtcgtggttgatgtgtcccacgaggaccctgaggtcaagtttaattggtatgtggatggcgtggaagtccataacgctaaaaccaagcccagagaggaacagtacaatagcacgtatcgggttgtgtccgtgctcacagtcctgcaccaagactggcttaacgggaaagagtacaagtgtaaggtgtctaataaagccctgcctgctcccatcgagaagaccattagcaaagccaagggacagccccgcgaacctcaggtttacacactcccgccctccagagatgagctgaccaaaaaccaggtgagccttacctgcctggtcaagggcttctatccttctgacatcgcggtggaatgggagtccaatgggcaacccgaaaacaattacaaaacaacgcctcccgttctcgatagcgacggatctttcttcctgtatagcaagctgaccgtggacaagtcccggtggcagcagggcaacgtcttttcttgtagcgtgatgcatgaggccctccacaatcactacacacaaaaatccctgagcctttctccggggaag

SEQ ID NO: 38909 - RNA, 1023 nt, synthetic construct; identical to SEQ ID NO: 38908
  misc_feature 1..1023: note = derived and/or modified sequence opt5 from Placulumab_HeavyChain1
  source 1..1023: mol_type = other RNA

SEQ ID NO: 38910 - RNA, 1341 nt, synthetic construct
  misc_feature 1..1341: note = derived and/or modified sequence opt5 from Plozalizumab_HeavyChain1
  source 1..1341: mol_type = other RNA
gaggtgcagctggtcgaaagcggcgggggactcgttaagcccggcgggtccctgagactttcttgcgccgctagcggattcaccttttccgcctacgcgatgaactgggtgcggcaagctcctggcaaagggctggagtgggtgggacgcatcagaacaaagaataacaattatgccacgtactatgccgactctgtcaaagatcggttcaccattagccgcgacgattccaagaacacactctacctgcagatgaatagccttaaaaccgaagacacagctgtgtattactgtaccacattttatggcaacggcgtttgggggcagggaaccctggtgacggtcagctccgccagcaccaagggcccgtctgtgttccccctcgctccttccagcaagtctacatccgggggaaccgccgcgctgggctgcctggttaaagattactttcccgagcctgtgacagtcagctggaatagcggggccctcacctccggagtgcacacgttccccgctgtgctgcagagctccggcctttactctctgagctccgtcgttacagtgccttcttcttccctcggcacccaaacatatatctgtaacgtgaatcataagccgagcaacaccaaagtcgacaagaaagtggaacccaagtcttgcgataagacccacacatgtcctccctgccctgcccccgagctggctggggccccgagcgtttttcttttccctcccaaacctaaggacacgctgatgatttccagaacccccgaggtgacatgtgtcgtggttgatgtgtctcatgaagaccccgaggtcaaatttaattggtacgtggatggagtcgaagtgcacaacgcgaagaccaaacctcgggaggagcagtataatagcacataccgcgttgtgtccgtcctcaccgtgctgcatcaggactggctgaacggcaaggaatataaatgcaaggttagcaataaggccctcccggctcccatcgagaaaacgatttctaaggccaaagggcagcctagagaaccccaagtgtacacactgcctccctcccgggatgagcttaccaagaaccaggtcagcctgacctgtctcgtgaaaggattctatccgtctgacatcgctgtggaatgggagtccaacggccagcctgagaataactacaagacaacaccccctgttctggacagcgatgggtcctttttcctttactctaagctgaccgtcgacaaaagccgctggcagcaaggaaatgtgttttcctgctctgtgatgcacgaagccctccacaaccattatacgcagaagtctctgtccctgagccccggcaaa

SEQ ID NO: 38911 - RNA, 657 nt, synthetic construct
  misc_feature 1..657: note = derived and/or modified sequence opt5 from Plozalizumab_LightChain1
  source 1..657: mol_type = other RNA
gacgtggtcatgacccagagccccctgtccctccctgttacactgggccaaccggcctctatcagctgcaaatcctctcagagccttctggattccgacgggaaaacgttcctcaactggtttcagcagagacccggacaatctcctcggcgcctgatttaccttgtgagcaagctggattccggcgtgcccgacagattcagcgggtctggatccggcaccgattttacactcaaaatcagccgggtcgaggctgaagacgtgggggtttattactgttggcagggaacccacttcccttatacatttggccagggcacccgcctggagattaagagaacagtggccgcgccctctgtcttcatctttcctccgtccgatgaacagctgaaaagcgggaccgcttctgtggtttgcctcctgaataacttctacccccgggaggccaaggtgcaatggaaggtcgacaatgcccttcagtccggaaacagccaggaatccgtgacggagcaggattctaaagacagcacctattccctgagctctacactcaccctgtccaaggctgattacgagaaacataaggtgtatgcctgtgaagtcacacaccaaggccttagctctcctgttaccaagagctttaatcgcggggagtgc

SEQ ID NO: 38912 - RNA, 1341 nt, synthetic construct
  misc_feature 1..1341: note = derived and/or modified sequence opt5 from Pogalizumab_HeavyChain1
  source 1..1341: mol_type = other RNA
gaggtgcaactggtccaaagcggcgccgaagttaagaaacccggggcttccgtgaaggtgtcttgcaaagccagcggatacaccttcacagactcctatatgtcttgggtcagacaggcgcctggccaggggctcgagtggatcggagatatgtacccggacaacggcgatagctcctataatcagaagtttcgggaacgcgtgacgattaccagagacacatctaccagcacagcttacctggagctttccagcctgcggtctgaagataccgccgtttattactgtgtgctcgctccccgctggtatttctccgtctgggggcaaggaacactggtgaccgttagctctgcttccacgaaaggccctagcgtgtttccccttgccccttcttccaagagcacctccggcgggacagctgccctgggatgcctcgtcaaggactacttccccgagcctgtgaccgtgtcttggaacagcggcgcgctgacatccggggtccacacctttccggccgttctgcagagctctggactctactccctgagctctgtggtgacggtccccagctcctctcttggcacacagacctatatctgtaatgtgaaccataaacctagcaatacaaaggttgataaaaaggtggagcccaaatcctgcgacaagacccacacctgtcctccctgcccggctcctgaactgctcgggggacccagcgtcttcctgtttcctcccaagcccaaagatacacttatgatttctagaacgcctgaggtgacctgtgttgtggtcgacgtgtcccatgaagatccggaggtcaagttcaactggtacgtggacggcgttgaggtgcacaatgccaaaacaaagccccgggaggaacagtataacagcacctaccgcgtcgtgtctgttctgacagtgctccatcaagattggctgaatggcaaagaatataagtgcaaagtctccaacaaggctctgcctgcccccatcgagaagaccattagcaaagcgaaggggcagcctagagaaccccaggtgtacacgctcccgccttcccgggaggagatgaccaaaaatcaggtgtctctgacatgtcttgttaagggattttatcccagcgacatcgccgtcgaatgggagtccaacggccaacctgaaaataactacaaaaccacaccccctgtgctggactctgatgggagcttctttctctactccaagctgaccgtggacaagagccgctggcagcagggaaatgtcttctcttgctccgtgatgcacgaggcccttcacaaccattatacacagaaaagcctgtctctctcccccggcaag

SEQ ID NO: 38913 - RNA, 642 nt, synthetic construct
  misc_feature 1..642: note = derived and/or modified sequence opt5 from Pogalizumab_LightChain1
  source 1..642: mol_type = other RNA
gacatccagatgacccaaagcccctcctctctgagcgcctccgtgggcgatagagtcacaattacgtgccgggcttctcaggacatcagcaactacctcaattggtatcagcagaaacctgggaaagccccgaagctgcttatttactatacctcccgcctgagatctggagttcccagccggttctccggcagcgggtctggaacagattttaccctcacaatctccagcctgcaacctgaggacttcgcgacctactattgtcagcagggccacacacttccccctacctttgggcagggaacgaaagtggaaattaagcgcaccgtggctgccccctctgtcttcatctttcctccgtccgatgagcaactgaaaagcggcacagcctctgtggtttgcctcctgaacaatttctaccccagagaagctaaggtgcagtggaaggtcgacaacgccctgcagtccggcaatagccaggagtccgtgaccgaacaagattctaaagacagcacatattccctcagctctaccctgacgctttccaaggctgattacgagaaacataaggtttacgcctgtgaggtgacacaccaggggctgagctctcctgtcaccaagagctttaaccggggagaatgc

SEQ ID NO: 38914 - RNA, 1341 nt, synthetic construct
  misc_feature 1..1341: note = derived and/or modified sequence opt5 from Polatuzumab_vedotin_HeavyChain1
  source 1..1341: mol_type = other RNA
gaggtgcagctggtcgaaagcggcgggggactcgttcaacccggcgggtccctgagactttcttgcgccgctagcggatacaccttctcctcttattggatcgagtgggtgcggcaggcccctggcaaggggctggaatggattggagagatcctcccgggcggcggggacacaaactacaatgaaatttttaaaggacgcgcgacgttcagcgctgatacctccaagaacacagcctatctgcagatgaatagccttagagccgaggacaccgctgtgtactattgtacacggcgcgtccccatcagactggattactggggccaggggaccctcgtgacagttagctccgccagcaccaaaggaccttctgtgtttcccctggctccttccagcaagtctacgtccggcgggaccgccgcgctgggatgcctcgtcaaagactatttccccgagcctgtgacagttagctggaactctggcgccctgacctccggcgtgcacacatttccggctgtccttcaaagctccgggctgtactctctcagctccgtggtgaccgtcccctcttcttccctgggaacgcagacatacatttgtaatgttaaccataagcctagcaataccaaggtggataaaaaggtggaacccaaatcttgcgacaagacacacacctgtcctccctgcccggcccctgagcttctgggcgggcccagcgtcttcctctttcctcccaaacccaaggataccctgatgatctcccggacacctgaagtgacgtgtgttgtggtcgacgtgtctcatgaggatccggaggttaagttcaactggtatgtggacggagtcgaagtgcacaatgctaaaaccaagccccgcgaggaacagtacaacagcacatatagagtcgtgtccgttctgaccgtgctccatcaggattggctgaatggcaaagagtacaagtgcaaagtcagcaacaaggcccttcctgcgcccatcgaaaagacaatttctaaggccaaggggcaacctcgggagccccaggtgtataccctgccgccttcccgcgaggaaatgacgaaaaatcaggttagcctcacatgtctggtgaagggattttacccctctgacatcgctgtcgagtgggaatccaacggccagcctgagaataactataaaaccacaccccctgtgcttgatagcgacggctccttctttctgtactctaagctcaccgtggacaaaagcagatggcaacaggggaacgttttctcctgctctgtcatgcacgaagccctgcacaatcattacacccagaaaagcctgtccctcagccccggaaag

SEQ ID NO: 38915 - RNA, 654 nt, synthetic construct
  misc_feature 1..654: note = derived and/or modified sequence opt5 from Polatuzumab_vedotin_LightChain1
  source 1..654: mol_type = other RNA
gacatccagctgacccaaagcccctcctctctcagcgcctccgtgggcgatagagtcacaattacgtgcaaggcttctcagagcgttgactacgagggggattccttcctgaactggtatcagcagaaacctggaaaggccccgaaacttctgatctacgcggcttctaatctcgaaagcggcgtgccctcccggtttagcgggtctggatccggcaccgacttcacactgaccattagctctcttcaacctgaggattttgccacatattactgtcagcagtccaacgaagaccccctgaccttcgggcagggaacaaaggtggagatcaaacgcaccgtcgccgctcctagcgtgtttatttttcccccttctgatgaacaactcaagtccggcacggccagcgttgtgtgcctgctgaataacttctatccgagagaggctaaggtccagtggaaagtggacaatgccctccagtccggcaactctcaggagagcgttaccgaacaagattccaaggacagcacatactctctgtccagcacccttacactgtctaaagcggattatgagaagcacaaagtgtacgcctgtgaagtcacccatcaggggctcagctcccccgtgacgaagtctttcaatcggggagagtgc

SEQ ID NO: 38916 - RNA, 1326 nt, synthetic construct
  misc_feature 1..1326: note = derived and/or modified sequence opt5 from Ponezumab_HeavyChain1
  source 1..1326: mol_type = other RNA
caggtgcagctggtccagagcggcgccgaggttaagaaacccggggcttccgtgaaggtgtcttgcaaagccagcggatactataccgaagcgtactatatccactgggtcagacaggctcctggccaggggctcgagtggatgggacggattgacccggccacaggcaacacgaagtacgctccccgcctgcaagatagagtgaccatgacacgggacacctccacatctaccgtttatatggaacttagctccctgcgctctgaggatacagctgtgtactattgtgccagcctctactccctgcctgtctactgggggcagggaaccacggtgaccgttagctctgcttccacaaaaggccccagcgtgttccctcttgccccctgctctagatccaccagcgaatctacagcggccctgggctgtctcgtcaaggactattttcctgagccggtgaccgtgtcctggaatagcggggctctgacgtccggagtccatacattccccgccgttctgcagtctagcggcctctactccctgagctctgtggtgaccgtcccttccagcaactttgggacacagacctatacctgcaatgtggatcacaagccctctaacacaaaagttgacaagacggtggagcggaaatgttgcgtcgaatgtcctccctgcccggctcctcccgtggccggacctagcgttttcctttttcctcccaagcccaaagataccctgatgatctcccgcacaccggaggtgacctgtgtcgtggtcgacgtgtctcatgaagatcccgaggttcaattcaattggtacgtggacggcgtcgaggtgcacaacgcgaagacaaagcctagagaggaacagtttaatagcaccttccgggttgtgtccgtcctcacggtggtgcatcaggattggctgaacgggaaagaatataagtgcaaagttagcaataagggacttccctcttccattgagaaaacaatcagcaagaccaaaggccagcctcgcgaaccccaagtctacaccctgccgccttctagagaggagatgacaaagaaccaggtgtccctcacctgtctggtgaagggcttttatcccagcgacattgccgtcgaatgggagtccaatgggcagcctgaaaacaattacaaaacaacgccccctatgctggattctgacggcagcttctttctctactccaagctgaccgtggacaaatctcggtggcaacagggaaacgttttcagctgctccgtgatgcacgaggcccttcacaatcattatacacaaaagagcctgtctctctcccccgggaaa

SEQ ID NO: 38917 - RNA, 657 nt, synthetic construct
  misc_feature 1..657: note = derived and/or modified sequence opt5 from Ponezumab_LightChain1
  source 1..657: mol_type = other RNA
gacgtggtcatgacccagagccccctgtccctccctgttacactgggccaaccggcctctatcagctgcaagtcctctcagagccttctgtactccgatgctaaaacgtatctcaactggttccagcagagacccgggcaatctcctcggcgcctgatttaccagatcagcagacttgaccccggagtgcctgatcggttttccggcagcgggtctggaaccgacttcacactgaagatttcccgcgtggaggccgaagatgtcggcgtgtattactgtctccaggggacccactatcccgttctgtttggacagggcacaagactggagatcaaacggaccgtggcggctcctagcgtcttcatttttccgccctctgacgaacaactcaagtccggcacagccagcgtggtttgcctgcttaataacttctaccctcgcgaggccaaagtgcagtggaaggtcgataatgctctgcagtctgggaactcccaggaaagcgtgaccgagcaagactccaaggattctacgtatagcctctccagcaccctgacactttctaaagccgactacgagaagcataaagtgtacgcttgtgaagtcacccaccagggactgtccagccccgttacaaagtcttttaatagaggcgagtgc

SEQ ID NO: 38918 - RNA, 1362 nt, synthetic construct
  misc_feature 1..1362: note = derived and/or modified sequence opt5 from Pritoxaximab_HeavyChain1
  source 1..1362: mol_type = other RNA
caggtgcaactgcaggagagcggcgctgaactcgtcagatccggggcttctgttcggatgagctgcaaggcctccggatacaccttcacatcttataacatgcactgggtgaaacagacgcccggccaggggctggagtggatcggatacatttatcctggcaatgggggaaccaactacatccaaaagtttaaaggcaaggcgattcttacagctgacaccagctcctctacagcctatatgcagatcagctccctgaccagcgaagattctgccgtgtacttctgtacacgctccccgagccattattcttccgacccctactttgattactggggccaggggaccacgctcaccgtcagctctgagttcgcttccacaaaaggacctagcgtgtttcccctggccccttcctctaagagcacctccggcgggacagctgcccttggatgcctggttaaggactatttccccgaacctgtgaccgtcagctggaactctggcgcgctcacgtccggggtgcacacatttccggccgttctgcagagctctggactgtacagcctctcctctgtggtcaccgtgcccagctccagcctgggcacacaaacctatatttgtaatgtgaatcataaaccttctaacaccaaggtcgataaaaaggttgagcccaaatcctgcgacaagacacacacgtgtcctccctgcccggctcctgagcttctgggcgggcccagcgtgttcctctttcctcccaagcccaaagataccctgatgatctctagaacacctgaagtgacctgtgtcgtggttgacgtgtcccatgaggatccggaagtcaagttcaattggtacgtggacggagttgaggtgcacaacgccaaaacaaagccccgggaggaacagtataatagcacctaccgcgtcgtgtccgtccttacggtgctgcaccaggattggctcaacggcaaagagtataagtgcaaagtttctaataaggctctgcctgcccccatcgaaaagacaattagcaaagcgaaggggcagcctagagagccccaagtgtacaccctgccgccttcccgggacgaactcaccaaaaaccaggtctctctgacatgtcttgtgaagggattttaccccagcgatatcgccgttgagtgggagtccaatggccagcctgaaaacaattataaaaccacaccccctgtgctggacagcgacgggtctttctttctctactccaagctgacggtcgataagagccgctggcaacagggaaacgtgttctcttgctccgtgatgcatgaggcccttcacaaccattatacccagaaaagcctgtctctcagccccggcaag

SEQ ID NO: 38919 - RNA, 642 nt, synthetic construct
  misc_feature 1..642: note = derived and/or modified sequence opt5 from Pritoxaximab_LightChain1
  source 1..642: mol_type = other RNA
gacatcgtgatgagccagtcccacaagttcatgtctaccagcgtcggcgatagagtttccattacatgcaaagcctctcaagacgtggggacggctgtggcctggtaccagcagaaccccggacagagccctaagtttctgatctattgggcgtccacccggcatacaggcgtcccggatcgcttcaccgggtctggaagcggcacagactttaccctcacaattaccaatgtgcaatccgaggatctggctgactacttctgtcagcagtatagctcttacccccttacgtttggggccggaacctccctggaactcaaaagaacagttgccgctcctagcgtgttcatctttcccccttctgatgagcagctgaagtccggcaccgccagcgtcgtgtgccttctgaacaatttctatccccgggaagctaaagttcaatggaaggtggacaacgccctccagtctggcaattcccaggagagcgtcacagaacaggattccaaggactctacctacagcctgtccagcacgctgacactctctaaagcggattatgagaagcacaaagtgtacgcctgtgaggtgacccatcaagggctgtccagccctgtcacaaagtcttttaaccgcggagaatgc

SEQ ID NO: 38920 - RNA, 1350 nt, synthetic construct
  misc_feature 1..1350: note = derived and/or modified sequence opt5 from Pritumumab_HeavyChain1
  source 1..1350: mol_type = other RNA
gaggtgcaactgctcgaaagcggcggggacctggtccaacccggaggctcccttagactgtcttgcgccgctagcgggttcaccttttccaactacgccatgtcttgggttcggcaggcgcctggaaagggcctcgagtgggtgagcgctatcacaccgtccgggggatctacgaattatgccgatagcgtgaaaggccgcttcaccatttccagagacaacagccagaatacactgtaccttcagatgaactctctgcgggtcgaagataccgccgtgtatatctgtggccgcgttccctacagatccacatggtatcctctctactgggggcaaggaaccctggtgacagtcagctctgcttccaccaagggccccagcgtgtttcctctggccccctcttccaaaagcacgtccgggggaaccgctgccctcggctgcctggttaaggactatttccctgagccggtgacagtctcttggaatagcggggcgcttacctccggagtgcacacatttcccgccgtgctgcagagctctggcctctactccctgagctctgtcgttaccgtgcctagctcctctcttggcacgcagacatacatttgtaacgtgaatcataaacccagcaacaccaaggtcgataagaaagtggaacctaagtcctgcgacaaaacacacacctgtcccccgtgccctgctcccgagctgctcgggggacctagcgttttcctgtttccgcccaagcctaaagataccctgatgatctctcggacaccggaggtgacgtgtgtcgtggttgacgtgtcccatgaagatcccgaggtcaagttcaattggtatgtggacggcgtcgaagtgcacaacgccaagaccaaacctcgcgaggagcagtacaatagcacatatagagttgtgtctgtcctcaccgtgctgcatcaagattggcttaacgggaaggaatacaaatgcaaggtttccaataaagctctgcccgcccctattgagaagacaatcagcaaagcgaagggacagccccgggaaccccaggtgtataccctccctccctcccgcgacgagctgacgaagaaccaggtctctcttacatgtctggtgaaaggcttttaccctagcgatatcgccgtggaatgggagtccaatgggcaacccgagaacaactataagaccacccctcccgttctcgactctgacggcagcttctttctgtactccaaactgacagtcgataagagcagatggcagcagggaaatgtgttctcttgctccgtgatgcacgaagctctccacaaccattacacccagaaaagcctgtctctttccccgggcaag

SEQ ID NO: 38921 - RNA, 642 nt, synthetic construct
  misc_feature 1..642: note = derived and/or modified sequence opt5 from Pritumumab_LightChain1
  source 1..642: mol_type = other RNA
gacatccagatgacccaaagcccctcctctctgagcgcctccgtgggcgatcgggtcacaattacgtgccgggcttctcaggacatcagcaactacctcgcctggttccagcagaagcctgggaaagcgccgaagtccctgatttatgctgcctctagccttcactccaaagttcccacccaatttagcggatctggctccgggacagatttcaccctgacaatcagctctctccagcctgaggactttgccacctactattgtctgcagtactccacatatcccattaccttcggaggcgggacgaaggtggaaatcaaacgcaccgtggctgcccctagcgtctttatctttcccccttctgatgagcagcttaagtccggaacagctagcgtggtttgcctgctcaataacttctacccgagagaagccaaggtgcaatggaaagtcgacaatgcgctgcagtccggcaactctcaggagagcgtgaccgaacaggattccaaggacagcacatattctctgtccagcaccctcacgctgtctaaagccgattacgagaagcataaagtttacgcttgtgaggtgacacaccaaggccttagctcccccgtcaccaagtctttcaatagaggggaatgc

SEQ ID NO: 38922 - RNA, 1341 nt, synthetic construct
  misc_feature 1..1341: note = derived and/or modified sequence opt5 from Quilizumab_HeavyChain1
  source 1..1341: mol_type = other RNA
gaggtgcagctggtcgaaagcggcgggggactcgttcaacccggcgggtccctgagactttcttgcgccgctagcggattcaccttttccgactacggcatcgcctgggtgcggcaggcgcctgggaagggactggagtgggtggctttcatttctgatctcgcctatacaatctactatgccgacacggtcaccggccgctttacaattagcagagataactccaaaaataccctgtaccttcagatgaactctctgcgggctgaagacacagccgtgtattactgtgctcgcgataattgggacgccatggattattggggccaggggaccctcgttacagtgagctccgcgagcaccaagggaccgtctgtcttccccctggccccttccagcaaatctacgtccggcgggaccgctgccctgggatgcctcgtgaaggactactttcccgagcctgttacagtgagctggaactctggcgctctgacctccggggtccacacattccccgccgtgcttcaaagctccggactgtactctctcagctccgtggtcaccgttccttctagctccctgggcacgcagacatatatctgtaatgtgaaccataaaccgagcaataccaaggtggataagaaagtcgaacccaagtcttgcgacaaaacacacacctgtcctccctgccctgcgcccgagcttctgggcgggccgagcgtgtttctcttccctcccaagcctaaagataccctgatgatttccagaacacccgaggttacgtgtgtggtcgtggacgtttctcatgaagatcccgaggtgaagtttaactggtacgtcgacggagtggaagtccacaatgccaagaccaaacctcgggaggagcagtataacagcacataccgcgtggtttccgtgctgaccgtcctccatcaggactggctgaatggcaaggaatataaatgcaaggtgagcaacaaagcccttccggctcccatcgagaagacaatctctaaagctaaggggcaacctagagaaccccaggtttacaccctgcctccctcccgggaggaaatgacgaagaatcaggtgagcctcacatgtctggtcaaaggattctatccgtctgatattgccgtggagtgggagtccaacggccagcctgaaaataactacaagaccacaccccctgtgcttgacagcgatgggtcctttttcctgtactctaaactcaccgttgacaagagccgctggcaacagggaaacgtcttttcctgctctgtgatgcacgaggccctgcacaatcattatacccagaaaagcctgtccctcagccccggcaag

SEQ ID NO: 38923 - RNA, 657 nt, synthetic construct
  misc_feature 1..657: note = derived and/or modified sequence opt5 from Quilizumab_LightChain1
  source 1..657: mol_type = other RNA
gacatccagatgacccaaagcccctcctctctgagcgcctccgtgggcgatagagtcacaattacgtgccggtctagccagtccctcgttcacaacaatgctaacacctacctgcattggtatcagcagaagcctgggaaagccccgaaacttctgatctacaaggtgtctaatcgcttcagcggagtgccctccagatttagcggctctgggtccggaacagacttcaccctcacaattagctctctgcaacctgaggattttgcgacctattactgttcccagaacacacttgtcccctggaccttcggccaggggacgaaggtggaaatcaaacggaccgttgctgcccctagcgtgtttatttttcccccttctgacgagcagctgaagtccggaacagccagcgtcgtgtgcctcctgaataacttctatccgcgcgaagctaaggttcaatggaaagtggataatgccctgcagtccggcaactctcaggagagcgtcaccgaacaggactccaaggatagcacatactctctctccagcaccctgacgctttctaaagctgactatgagaagcacaaagtgtacgcctgtgaggtgacacatcaaggcctgagctcccccgtcaccaagtctttcaatagaggggaatgc

SEQ ID NO: 38924 - RNA, 1335 nt, synthetic construct
  misc_feature 1..1335: note = derived and/or modified sequence opt5 from Racotumomab_HeavyChain1
  source 1..1335: mol_type = other RNA
caggtgcaactgcagcagagcggcgccgagctcgtcaagcccggggcttccgttaaactgtcttgcaaggccagcggatacaccttcacatcctatgacatcaactgggtgagacagcggcctgaacaaggccttgagtggattgggtggatctttccgggagatggctctacgaaatacaatgaaaagttcaaagggaaggcgaccctgacaaccgacaagagctcctctacagcttatatgcagctcagccgcctgacctccgaggatagcgccgtgtacttttgtgccagagaagactattacgataactcttattacttcgactactggggacagggcacaacccttacggtctccagcgctaaaaccacacccccttctgtgtatcccctggcccctggctccgctgcccagaccaatagcatggttacactcgggtgcctggtgaagggatactttcccgagcctgtcaccgtgacgtggaactctggctccctgagctccggggttcacacattcccggcggtgctccaatctgatctgtatacccttagctccagcgtcacagtgccctcttcccctcggcccagcgagaccgtgacctgtaatgtcgcccatcctgcttctagcacaaaagttgacaagaaaattgtgccccgcgattgcggatgtaagccgtgcatctgtacggtgcctgaagtctcctctgtgtttatttttccccctaagcccaaagacgttctgaccatcacactcacccccaaggtgacatgcgtcgtggttgatatcagcaaagacgatcctgaggtgcagttctcctggttcgtcgacgacgtggaagtccacaccgcccagacgcagccgagagaggagcaatttaacagcacattccggtctgtgtccgaactgcccattatgcatcaggattggcttaatggcaaggagtttaaatgtcgcgttaacagcgctgccttccctgcgcccatcgaaaagaccatttctaaaaccaaggggagacctaaggctccccaggtgtacacaatcccgcctcccaaagagcaaatggccaaggacaaagtctccctgacctgcatgattacagatttctttcctgaagacatcacggtggagtggcagtggaatggacagcccgccgagaactataagaatacccagcctattatgaacacaaatggcagctacttcgtttattccaaactcaacgtgcaaaagtctaattgggaagctggcaacacctttacatgtagcgtcctgcacgaggggctgcataaccaccacaccgaaaagtccctctctcatagccccggaaaa

SEQ ID NO: 38925 - RNA, 642 nt, synthetic construct
  misc_feature 1..642: note = derived and/or modified sequence opt5 from Racotumomab_LightChain1
  source 1..642: mol_type = other RNA
gacatccagatgacccaaacaacgagcagcctgtctgccagcctcggcgatagagtgaccatttcctgccgggcttctcaggacatcagcaactacctgaattggtatcagcagaagcccgatgggacagtcaaacttctgatttactatacctcccgcctccactctggagttcctagcagattctccggcagcgggtctggaacagactactccctgaccatcagcaaccttgagcaagaagatattgccacatatttttgtcagcagggcaataccctgccgtggacgttcgggggaggcaccaagctcgagatcaaacgggcggacgctgcccccacagtgtctatctttcctccctccagcgaacagctgacctctggcggggcctccgtggtctgcttcctgaacaatttttaccctaaggatattaacgtgaaatggaagatcgacggaagcgagcgccaaaatggcgttctcaactcctggacagatcaggactctaaggatagcacctattccatgagctctacgctgacacttaccaaagacgaatacgagagacataattcctacacatgtgaggctacccacaagaccagcacatctcccattgtgaaatccttcaaccggaatgaatgc

SEQ ID NO: 38926 - RNA, 1089 nt, synthetic construct; identical to SEQ ID NO: 38864
  misc_feature 1..1089: note = derived and/or modified sequence opt5 from Racotumomab_scVH-VH'-VH_chain
  source 1..1089: mol_type = other RNA

SEQ ID NO: 38927 - RNA, 1071 nt, synthetic construct
  misc_feature 1..1071: note = derived and/or modified sequence opt5 from Radretumab_HeavyChain1
  source 1..1071: mol_type = other RNA
gaggtgcagctgctcgaaagcggcgggggactggtccaacccggcgggtcccttagactgtcttgcgccgctagcggattcaccttttcctctttcagcatgtcctgggttcggcaggcccctggcaaggggctcgagtgggtgtctagcatctccggaagctctggcacaacgtactatgcggactccgtgaaaggccgctttaccattagcagagataactctaagaatacactgtaccttcagatgaactccctgcgggctgaagacaccgccgtctattactgtgccaaaccgttcccctattttgattactgggggcagggaacactcgtgaccgttagctctggcgacgggtccagcggaggctccgggggagcttctgagatcgtgctgacacaaagccctggcaccctgtccctcagccccggcgaacgcgccacgctgtcttgcagagcttcccagagcgtctctagctccttccttgcctggtatcagcagaagcctgggcaagcgccccggctgctcatttactacgcctctagccgcgctaccggaatccctgatagattttccggcagcgggtctggaacagacttcaccctgacaatttcccggcttgagccggaggattttgccgtgtattactgtcagcagaccggccgcattccccctacgttcgggcagggaacaaaagttgaaatcaagagcggcggctctgggggacccagagctgcccctgaggtgtatgcgtttgccacccccgaatggccgggctcccgggacaagcgcacactggcttgcctcatccaaaatttcatgcctgaggatatcagcgtccagtggctgcacaacgaggtgcagctgcccgacgccagacattccaccacccaacctcggaaaacaaaggggtctggatttttcgtgttcagccgcctcgaagtcacgagagctgagtgggaacagaaagatgagtttatttgtcgggccgttcacgaagccgcttccccctctcagaccgtgcagagagcggtgagcgtcaatcccgagtccagccgccggggcgggtgc

SEQ ID NO: 38928 - RNA, 414 nt, synthetic construct; identical to SEQ ID NO: 38879
  misc_feature 1..414: note = derived and/or modified sequence opt5 from Radretumab_j_chain
  source 1..414: mol_type = other RNA

SEQ ID NO: 38929 - RNA, 1368 nt, synthetic construct
  misc_feature 1..1368: note = derived and/or modified sequence opt5 from Rafivirumab_HeavyChain1
  source 1..1368: mol_type = other RNA
caggtgcaactggtccagagcggcgctgaggttaagaaacccgggtcctctgtgaaggtgagctgcaaggcttccggaggcaccttcaacagatacacagtcaattgggtgcggcaggcccctgggcagggactcgaatggatgggcgggatcattccgatctttggaacggcgaactatgctcaacgcttccagggcagactgaccattacagccgacgagtctaccagcacagcctacatggaactttcctctctgcggagcgatgacaccgctgtttatttttgtgcccgcgagaatctcgataactccggcacatactattacttcagcgggtggtttgacccctggggacagggcaccctggtgacggtctcttccgctagcaccaaagggccttctgtgttcccccttgccccttccagcaaatctacatccggaggcaccgcggccctggggtgcctcgttaaggattattttcccgaacctgtgacagtcagctggaactccggagctctgacctctggcgtgcacacgttcccggccgtgctgcagagctccggcctctacagcctgtcttccgtcgttacagtgcccagctctagccttgggacccaaacatacatctgtaatgtgaatcataagccttccaacaccaaagtcgacaagagagtggagcccaaatcttgcgataagacccacacatgtcctccctgcccggctcctgagctgctcggaggccccagcgtttttctgttccctcccaaacccaaggacacgcttatgatttcccggacccctgaagtgacatgtgtcgtggttgatgtgagccatgaggacccggaagtcaagtttaattggtatgtggatggggtcgaggtgcacaacgccaaaaccaagccccgcgaggaacagtacaattctacatatagagttgtgtccgtcctgaccgtgctccatcaggactggctgaacggaaaagagtacaagtgcaaagttagcaataaggcgctgcctgcccccatcgagaaaacgatctctaaggctaagggccagcctcgggaaccccaagtgtatacactcccgccttcccgcgaagagatgaccaaaaaccaggtcagcctgacctgtcttgtgaaggggttctacccctccgatattgccgtggagtgggaatctaatggacagcctgagaacaactataaaacaacaccccctgttctggacagcgacggctcctttttcctctactctaagctgaccgtcgataaaagcagatggcaacagggcaatgtgttctcctgcagcgtgatgcacgaagcccttcacaaccattacacgcagaagtctctgtccctcagccccggg

SEQ ID NO: 38930 - RNA, 1368 nt, synthetic construct
  misc_feature 1..1368: note = derived and/or modified sequence opt5 from Rafivirumab_HeavyChain
  source 1..1368: mol_type = other RNA
gaggtgcagctggtccaaagcggcgctgaagttaagaaacccgggtcctctgtgaaggtgagctgcaaggcttccggaggcaccttcaacagatacacagtcaattgggtgcggcaggcccctgggcagggactcgagtggatgggcgggatcattccgatctttggaacggcgaactatgctcagcgcttccaaggcagactgaccattacagccgacgaatctaccagcacagcctacatggagctttcctctctgcggagcgatgacaccgctgtttatttttgtgcccgcgaaaatctcgataactccggcacatactattacttcagcgggtggtttgacccctggggacagggcaccctggtgacggtctcttccgctagcaccaaagggccttctgtgttcccccttgccccttccagcaaatctacatccggaggcaccgcggccctggggtgcctcgttaaggattattttcccgagcctgtgacagtcagctggaactccggagctctgacctctggcgtgcacacgttcccggccgtgctgcagagctccggcctctacagcctgtcttccgtcgttacagtgcccagctctagccttgggacccagacatacatctgtaatgtgaatcataagccttccaacaccaaagtcgacaagagagtggagcccaaatcttgcgataagacccacacatgtcctccctgcccggctcctgaactgctcggaggccccagcgtttttctgttccctcccaaacccaaggacacgcttatgatttcccggacccctgaggtgacatgtgtcgtggttgatgtgagccatgaagacccggaggtcaagtttaattggtatgtggatggggtcgaggtgcacaacgccaaaaccaagccccgcgaggaacaatacaattctacatatagagttgtgtccgtcctgaccgtgctccatcaggactggctgaacggaaaagaatacaagtgcaaagttagcaataaggcgctgcctgcccccatcgagaaaacgatctctaaggctaagggccagcctcgggaaccccaggtgtatacactcccgccttcccgcgaggagatgaccaaaaaccaagtcagcctgacctgtcttgtgaaggggttctacccctccgatattgccgtggaatgggagtctaatggacagcctgaaaacaactataaaacaacaccccctgttctggacagcgacggctcctttttcctctactctaagctgaccgtcgataaaagcagatggcagcaaggcaatgtgttctcctgcagcgtgatgcacgaggcccttcacaaccattacacgcagaagtctctgtccctcagccccggg

SEQ ID NO: 38931 - RNA, 654 nt, synthetic construct
  misc_feature 1..654: note = derived and/or modified sequence opt5 from Rafivirumab_LightChain1
  source 1..654: mol_type = other RNA
cagagcgccctgacccaacccagatccgtgtctggcagccctgggcagtccgtcacaatctcttgcacgggaaccagctccgacattggcgggtacaacttcgtttcttggtatcagcagcacccgggaaaggctcccaaactcatgatctacgatgccacaaagcggcctagcggcgtgcccgaccgcttttccgggagcaaatctggaaataccgcgtccctgacaattagcggccttcaagctgaggatgaagccgactattactgttgctcttatgccggcgattacacccctggggtggtcttcggaggcgggacaaagctgaccgtgctcggacagcccaaagctgccccttccgttacgctgtttccgcccagctctgaggaacttcaggctaacaaggccaccctggtgtgtctcatctccgacttctatcctggcgcggtcacagtggcctggaaggctgatagctcccccgttaaagccggggtggagaccacaaccccttctaagcagagcaataacaaatacgctgcctccagctacctgtctctgacgcccgaacaatggaagtcccatagaagctattcttgccaggtcacacacgagggaagcaccgtggagaaaacagtggcgccgaccgaatgttcc

SEQ ID NO: 38932 - RNA, 654 nt, synthetic construct
  misc_feature 1..654: note = derived and/or modified sequence opt5 from Rafivirumab_LightChain
  source 1..654: mol_type = other RNA
gagagcgccctgacccagcccagatccgtgtctggcagccctgggcaatccgtcacaatctcttgcacgggaaccagctccgacattggcgggtacaacttcgtttcttggtatcagcagcacccgggaaaggctcccaaactcatgatctacgatgccacaaagcggcctagcggcgtgcccgaccgcttttccgggagcaaatctggaaataccgcgtccctgacaattagcggccttcaggctgaagatgaggccgactattactgttgctcttatgccggcgattacacccctggggtggtcttcggaggcgggacaaagctgaccgtgctcggacaacccaaagctgccccttccgttacgctgtttccgcccagctctgaagaacttcaggctaacaaggccaccctggtgtgtctcatctccgacttctatcctggcgcggtcacagtggcctggaaggctgatagctcccccgttaaagccggggtggaaaccacaaccccttctaagcagagcaataacaaatacgctgcctccagctacctgtctctgacgcccgagcagtggaagtcccatagaagctattcttgccaagtcacacacgagggaagcaccgtggagaaaacagtggcgccgaccgagtgttcc

SEQ ID NO: 38933 - RNA, 1332 nt, synthetic construct
  misc_feature 1..1332: note = derived and/or modified sequence opt5 from Ralpancizumab_HeavyChain1
  source 1..1332: mol_type = other RNA
caggtgcaactggtccagagcggcgccgaggttaagaaacccggggcttccgtgaaggtgtcttgcaaagccagcggatacaccttcacatcctattacatgcactgggtcagacaggcgcctggccaggggctcgaatggatgggagagatccatccgtctggcgggcggacgaactataatgaaaagtttaaaagccgcgtgaccatgacaagagacacctccacatctaccgtttacatggagctgagctcccttcggagcgaagatacagctgtgtattactgtgcccgcgagagacccctgtatgcctctgacctctggggacaaggcaccacggtcaccgtgtccagcgcttctacaaagggcccttccgttttccccctggccccttgcagccggtctacctccgagagcacagctgcccttgggtgtctggtgaaggattactttcccgaacctgtcaccgtgtcctggaactctggagcgctcacgagcggcgtgcacacattcccggccgtcctgcagtccagcgggctgtactctctctccagcgttgtgaccgtgccctctagcaattttggaacacagacctatacctgcaacgtcgaccataaaccttccaatacaaaggtggataaaacggttgagcgcaagtgttgcgtggaatgtcccccttgccccgctccgcctgtcgccggcccctctgtgttcctgtttcctcccaaacccaaggacacccttatgattagcagaacacctgaggttacctgtgtggtcgtggatgtctcccacgaggacccggaagtgcagttcaactggtacgttgatggggtggaggtccataatgctaagacaaaaccccgggaggaacaatttaacagcaccttccgcgtggtttctgtgctgacggtcgtgcaccaggactggctcaatggaaaggaatataaatgcaaggtgtccaacaaaggcctgcctagctctatcgagaagacaatttccaaaaccaagggccagcccagagagcctcaggtttacacccttcccccgagccgggaagagatgacaaagaatcaagtctccctgacctgtctcgtgaaagggttttatccttctgatatcgccgtggaatgggagagcaacggacagcccgaaaataactacaagacaacgcctcccatgctggactccgatggctctttctttctgtatagcaaactcaccgtcgacaagtcccgctggcagcaagggaatgtgttcagctgctctgttatgcacgaggcgctgcataaccactacacacagaaatcccttagcctgtctcctggaaag

SEQ ID NO: 38934 - RNA, 642 nt, synthetic construct
  misc_feature 1..642: note = derived and/or modified sequence opt5 from Ralpancizumab_LightChain1
  source 1..642: mol_type = other RNA
gacatccagatgacccaaagcccctcctctctgagcgcctccgtgggcgatcgggtcacaattacgtgcaaggcttctcaggacgttcacaccgccgtggcgtggtaccagcagaaacctgggaaggctccgaaactcctgatctatcatgccagctaccggtatacaggagtgccctcccgcttctctggcagcgggtccggaaccgattttacattcaccattagctctcttcaacctgaggacatcgccacatactattgtcagcagagatactccctgtggcggacctttggccaggggacgaagctcgaaattaaacgcaccgtcgctgcccccagcgtgttcatctttcctccctctgatgagcaactgaagtccggaacagctagcgttgtgtgccttctgaacaatttctatcctagagaagccaaggtccagtggaaagtggacaacgcgctccagtctggcaattcccaggagagcgttaccgaacaagattccaaggactctacatacagcctgtccagcaccctgacgctctctaaagccgattacgagaagcacaaagtgtatgcttgtgaggtcacacatcagggcctgtccagcccggtgaccaagtcttttaacagaggggaatgc

SEQ ID NO: 38935 - RNA, 1338 nt, synthetic construct
  misc_feature 1..1338: note = derived and/or modified sequence opt5 from Ramucirumab_HeavyChain1
  source 1..1338: mol_type = other RNA
gaggtgcagctggtccaaagcggcgggggactcgttaagcccggcgggtccctgagactttcttgcgccgctagcggattcaccttttcctcttacagcatgaactgggtgcggcaggcccctggcaaagggctggaatgggtgtcctctatcagctcctctagctcctatatttactatgcggacagcgtcaagggacgcttcacaatctctagagataatgctaaaaactccctctacctgcagatgaatagccttcgggccgaggacacggccgtgtattactgtgctcgcgttaccgatgcctttgacatttggggccagggcacaatggtgaccgtctcttccgctagcacaaaggggccgtccgtgttccccctggccccttctagcaaatccaccagcggaggcacagcggccctcgggtgcctggttaaggattattttcccgaacctgtgaccgtctcttggaactccggagctctgacgagcggcgtgcacaccttccccgccgtgctccaatctagcgggctgtactccctttctagcgtcgttacagtgccttccagctctctgggaacccagacatacatctgtaatgtgaaccataagccgtccaataccaaagtcgacaagaaagtggagcccaagagctgcgataaaacgcacacatgtcctccctgccctgctcccgaactcctgggcggcccgtctgtttttcttttccctcccaagcctaaggacaccctgatgatttccagaacacccgaggtgacctgtgtcgtggttgatgtgagccatgaggaccccgaagtcaaatttaactggtatgtggatggggtcgaggtgcacaatgccaagaccaaacctcgggaggaacagtacaactccacatatcgcgttgtgtctgtcctcacggtgctgcatcaggactggctgaatggaaaggagtacaaatgcaaggttagcaacaaagcgctcccggcccccatcgaaaagaccatctccaaggctaaaggccaacctagagagccccaggtgtatacactgcctccctctcgggaagagatgaccaagaatcaggtcagccttacatgtctggtgaaagggttctacccgtccgatattgccgtggaatgggagagcaacggacagcctgagaataactataagaccacgccccctgttctcgactctgacggctcctttttcctgtacagcaaacttacagtcgataagtctcgctggcaacaggggaacgtgttttcctgcagcgtgatgcacgaagctctgcacaatcattacacccagaagtctctcagcctgtcccccggaaaa

SEQ ID NO: 38936 - RNA, 642 nt, synthetic construct
  misc_feature 1..642: note = derived and/or modified sequence opt5 from Ramucirumab_LightChain1
  source 1..642: mol_type = other RNA
gacatccagatgacgcaaagcccctcctctgtgagcgcctccattggcgatagagtcacaatcacgtgccgggcttctcaggggattgacaactggctgggatggtaccagcagaagcctggcaaagccccgaagctcctgatctatgatgcgagcaatcttgacaccggggttccctcccgcttctctggaagcggctccgggacatactttaccctgacaattagctctctccaagctgaggatttcgccgtgtatttttgtcagcaggccaaggctttccctcccacctttggaggcggcacaaaagtggacatcaaagggaccgtcgccgctccttccgtgttcatctttccccctagcgatgaacagctgaagtctggaacggcctccgttgtgtgccttctgaacaatttctacccgagagaggcgaaggtccaatggaaagtggacaacgccctccagagcggcaattctcaggaatccgttaccgagcaggatagcaaggactccacatattctctgagctccaccctgacactcagcaaagctgattacgaaaagcacaaagtgtatgcctgtgaggtcacccatcaagggctgtcttcccccgtgaccaagagctttaaccggggagagtgc

SEQ ID NO: 38937 - RNA, 687 nt, synthetic construct
  misc_feature 1..687: note = derived and/or modified sequence opt5 from Ranibiziuab_HeavyChain1
  source 1..687: mol_type = other RNA
gaggtgcagctggtcgaaagcggcgggggactcgttcaacccggcgggtccctgagactttcttgcgccgctagcggatacgacttcacccactatggcaactgggtgcggcaggcccctgggaagggactggagtgggtgggctggatcaatacatacacgggcgaaccgacctatgcggctgattttaaacgcagattcacattttccctcgacacctctaagagcacagcctacctgcagaactcccttcgggccgaggataccgctgtctattactgtgccaaatatccctactactatgggacatctcattggtacttcgacgtgtggggacagggcaccctggttacggtgagctccgctagcaccaaggggccttctgtctttcccctcgccccttccagcaaatctacatccggaggcaccgcggccctggggtgcctggtgaaggattatttccccgaacctgttacagtgagctggaatagcggagctctcacctccggcgtccacacgtttccggccgtgctgcaaagctccggcctttactctctgagctccgtggtcacagttccctcttcttccctcgggacccagacatatatttgtaacgtgaatcataagcctagcaacaccaaagtggacaagaaagtcgagcccaagtcttgcgataaaacccacctg

SEQ ID NO: 38938 - RNA, 642 nt, synthetic construct
  misc_feature 1..642: note = derived and/or modified sequence opt5 from Ranibiziuab_LightChain1
  source 1..642: mol_type = other RNA
gacatccagctgacccaaagcccctcctctctcagcgcctccgtgggcgatcgggtcacaattacgtgctctgctagccaggacatctccaactacctgaattggtatcagcagaaacctgggaaagccccgaaggttcttatttacttcacctctagcctgcactccggagtgcccagccggttttctggctccgggagcggaacagatttcaccctcacaatctcttccctgcaacctgaggactttgcgacctattactgtcagcagtatagcacagtgccctggaccttcggccaggggacgaaagtcgaaattaagcgcaccgtggctgccccttctgtttttatctttcccccttccgatgagcaacttaaaagcggaacagcctccgtggtctgcctgctcaacaatttctacccgagagaagctaaggtgcagtggaaggttgacaacgccctgcagtctggcaatagccaggagtccgtgaccgaacaagatagcaaagactctacatattccctgagctctaccctcacgctgagcaaggctgattacgagaaacataaggtctacgcctgtgaggtgacacaccagggcctttcctctcccgtgaccaagagcttcaacagaggggaatgc

SEQ ID NO: 38939 - RNA, 639 nt, synthetic construct
  misc_feature 1..639: note = derived and/or modified sequence opt5 from Ranibizumab_fab_fragment
  source 1..639: mol_type = other RNA
gacatccagctgacccaaagcccctcctctctcagcgcctccgtgggcgatcgggtcacaattacgtgctctgctagccaggacatctccaactacctgaattggtatcagcagaaacctgggaaagccccgaaggttcttatttacttcacctctagcctgcactccggagtgcccagccggttttctggctccgggagcggaacagatttcaccctcacaatctcttccctgcaacctgaggactttgcgacctattactgtcagcagtatagcacagtgccctggaccttcggccaggggacgaaagtcgaaattaagcgcaccgtggctgccccttctgtttttatctttcccccttccgatgagcaacttaaaagcggaacagcctccgtggtctgcctgctcaacaatttctacccgagagaagctaaggtgcagtggaaggttgacaacgccctgcagtctggcaatagccaggagtccgtgaccgaacaagatagcaaagactctacatattccctgagctctaccctcacgctgagcaaggctgattacgagaaacataaggtctacgcctgtgaggtgacacaccagggcctttcctctcccgtgaccaagagcttcaacagaggggaa

SEQ ID NO: 38940 - RNA, 693 nt, synthetic construct
  misc_feature 1..693: note = derived and/or modified sequence opt5 from Ranibizumab_HeavyChain
  source 1..693: mol_type = other RNA
gaggtgcagctggtcgaaagcggcgggggactcgttcaacccggcgggtccctgagactttcttgcgccgctagcggatacgacttcacccactatggcatgaactgggtgcggcaggcccctgggaagggactggagtgggtgggctggatcaatacatacacgggcgaaccgacctatgcggctgattttaaacgcagattcacattttccctcgacacctctaagagcacagcctacctgcagatgaactcccttcgggccgaggataccgctgtctattactgtgccaaatatccctactactatgggacatctcattggtacttcgacgtgtggggacagggcaccctggttacggtgagctccgctagcaccaaggggccttctgtctttcccctcgccccttccagcaaatctacatccggaggcaccgcggccctggggtgcctggtgaaggattatttccccgaacctgttacagtgagctggaatagcggagctctcacctccggcgtccacacgtttccggccgtgctgcaaagctccggcctttactctctgagctccgtggtcacagttccctcttcttccctcgggacccagacatatatttgtaacgtgaatcataagcctagcaacaccaaagtggacaagaaagtcgagcccaagtcttgcgataaaacccacctg

SEQ ID NO: 38941 - RNA, 654 nt, synthetic construct
  misc_feature 1..654: note = derived and/or modified sequence opt5 from Ranibizumab_LightChain
  source 1..654: mol_type = other RNA
gaggtgcagctggtcgaaagcggcgggggactcgttcaacccggcgggtccctgagactttcttgcgccgctagcggatacgacttcacccactatggcatgaactgggtgcggcaggcccctgggaagggactggagtgggtgggctggatcaatacatacacgggcgaaccgacctatgcggctgattttaaacgcagattcacattttccctcgacacctctaagagcacagcctacctgcagatgaactcccttcgggccgaggataccgctgtctattactgtgccaaatatccctactactatgggacatctcattggtacttcgacgtgtggggacagggcaccctggttacggtgagctccgctagcaccaaggggccttctgtctttcccctcgccccttccggaacagcggccctgggctgcctggtgaaagattatttccccgaacctgttaccgtgagctggaactctggggctctcacatccggagtccacacctttccggccgtgctgcaaagctctggcctttactccctgagctccgtggtcacggttccctctagctccctcggcacacagacctatatttgtaatgtgaatcataagcctagcaacacaaaggtggacaaaaaggtcgagcccaaa

SEQ ID NO: 38942 - RNA, 642 nt, synthetic construct; identical to SEQ ID NO: 38938
  misc_feature 1..642: note = derived and/or modified sequence opt5 from Ranibizumab_LightChain_variant
  source 1..642: mol_type = other RNA

SEQ ID NO: 38943 - RNA, 1368 nt, synthetic construct
  misc_feature 1..1368: note = derived and/or modified sequence opt5 from Refanezumab_HeavyChain1
  source 1..1368: mol_type = other RNA
caggtgcaactggtccagagcggctccgagctcaagaaacccggggcctctgttaaggtgagctgcaaggcttccggatacaccttcacaaactatggcatgaattgggtgagacaggcccctgggcagggactggaatggatgggctggatcaacacgtacaccggggagccgacatatgcggacgattttaccggacggttcgtcttttctcttgacacaagcgtgtccaccgcttacctgcaaatttctagcctcaaagccgaagatacagccgtttattactgtgctcgcaatcccatcaactattacggcattaattacgagggctatgtgatggactactgggggcagggaaccctggtcacggtgtccagcgcctctaccaaaggcccttccgttttcccccttgctcctagctctaagtccacaagcgggggaaccgccgcgctgggctgcctcgtgaaggattattttcccgaacctgtcacagtgtcttggaactccggggccctgaccagcggagtgcacacgttcccggctgtcctgcagtcctctggcctctacagcctgtccagcgttgtgacagtgccctcttccagccttggcacccagacatatatctgtaatgtcaaccataaaccttctaataccaaggtggacaaaaaggttgagcccaaaagctgcgataagacccacacatgtcctccctgcccggcccctgagctggctggggccccctccgtgtttctcttccctcccaagcccaaagacacgctgatgatttctagaacccctgaagtcacatgtgtggttgtggatgtcagccatgaggacccggaagtgaagtttaactggtacgtcgatggagtggaggttcacaatgcgaaaaccaagccccgggaggaacaatataactccacataccgcgtggtcagcgtgcttaccgttctgcatcaggactggctcaatggcaaagagtacaagtgcaaagtgtctaacaaggccctgcctgctcccatcgaaaagacgatctccaaagccaaggggcagcctagagagccccaggtctatacactgccgcctagccgggatgaactcaccaaaaatcaagtgtctctgacctgtcttgtgaagggattctacccctccgacattgctgttgagtgggagagcaacggccagcctgaaaacaattataaaacaacaccccctgtcctggactccgatgggagctttttcctctactctaagctgaccgtggacaagtcccgctggcagcaaggaaacgtgttttcttgcagcgtcatgcacgaggcccttcacaatcattatacgcagaaatccctgagcctctctcccggcaag

SEQ ID NO: 38944 - RNA, 657 nt, synthetic construct
  misc_feature 1..657: note = derived and/or modified sequence opt5 from Refanezumab_LightChain1
  source 1..657: mol_type = other RNA
gacatcgtgatgacccagagccccgattccctggccgtctctctcggcgagagagctacaattaactgcaagagctcccactctgttctgtacagctccaatcagaaaaactatcttgcctggtaccaacagaagcctgggcagccgcccaaactgctcatctattgggcgtctacgcgggaaagcggagtgcctgaccgcttctccggcagcgggtctggaaccgattttacactgaccatttccagccttcaagctgaggacgtggccgtctactattgtcatcagtacctgtcttccctcacattcggccaggggaccaagctggaaatcaaaagaacagtggccgctcccagcgtttttattttccctccctctgatgagcagctgaagtccggaaccgccagcgtggtctgcctcctgaataacttttatcctcgggaagctaaggtgcaatggaaagttgacaatgcccttcagtccggcaactctcaggagagcgtgacggagcaggattccaaggacagcacctactctctgtccagcacactcaccctgtctaaagcggattacgaaaagcacaaagtctatgcctgtgaggtgacacatcaaggccttagctccccggtgaccaagtctttcaatcgcggggaatgc

SEQ ID NO: 38945 - RNA, 1314 nt, synthetic construct
  misc_feature 1..1314: note = derived and/or modified sequence opt5 from REGN2810_HeavyChain1
  source 1..1314: mol_type = other RNA
gaggtgcagctgctcgaaagcggcggggtcctggttcaacccggaggctcccttagactgtcttgcgccgctagcgggttcaccttttccaacttcggaacatgggtgcggcaggcccctggcaaggggctcgagtgggtgtctggaatcagcggcggcgggcgcgacacgtactttgcggattccgtcaaaggaagattcaccatttctcgggacaatagcaagaacacactgtatcttcaaaattccctgaaaggcgaagataccgctgtgtactattgtgttaagtgggggaacatctactttgactattggggacagggcacactcgtgaccgtcagctctgcctccacaaaagggccgagcgtgttccccctggccccttgctctcgctccaccagcgagtctacggctgccctgggatgtctcgttaaggattactttcccgaacctgtgaccgtctcctggaatagcggcgctctgacatccggcgtgcacaccttccccgccgtgcttcagtctagcgggctgtattccctcagctctgtcgttacagtgccttccagctctctgggaaccaagacgtacacatgcaacgtggaccataaaccgagcaataccaaggtcgataaaagagtggagtccaagtacgggcccccttgtcccccttgccccgcgccggagtttcttggcggaccttctgttttcctgtttccccctaaacccaaggacacactcattagccggacccccgaagtgacctgtgtcgtggttgatgtgtcccaggaggaccctgaagtccagttcaactggtatgtggatggcgtcgaggtgcacaatgccaagacaaaaccgcgcgaggaacagtttaacagcacgtacagagttgtgtctgtcctgaccgtgctgcatcaagactggctcaatgggaaggagtataaatgcaaggtttccaacaaaggactgcccagctctatcgaaaagacaatttccaaagctaagggccagcctcgggagccccaggtgtacacccttcctcccagccaggaagagacaaagaatcaagtctccctgacctgtctcgtgaaaggcttctatccgtctgatatcgccgtggagtgggaaagcaacgggcagcctgagaataactacaagacgacaccccctgttctggactccgacggatctttctttctttatagccgcctgaccgtcgataaatccagatggcaggaaggcaacgtgttcagctgctctgtgcacgaggctctccataatcactacacccaaaagtccctgagcctgtctctcggg

SEQ ID NO: 38946 - RNA, 639 nt, synthetic construct
  misc_feature 1..639: note = derived and/or modified sequence opt5 from REGN2810_LightChain1
  source 1..639: mol_type = other RNA
gacatccagacccaaagcccctcctctctgagcgcctccgtgggcgattctattacaatcacgtgcagagctagcctctccattaacaccttcctgaattggtaccagcagaagcctgggaaagccccgaaccttctgatctatgcggcttctagcctccacggaggcgtcccctcccggtttagcgggtctggatccggcacagacttcaccctgacaattcgcacccttcagcctgaggattttgccacatactattgtcaacagagctctaatacccccttcacgtttgggcctggaaccgttgtggacttcagacggacagtggccgctccctccgtctttatcttccctccgagcgatgaacagctgaagtctggcaccgcctccgtggtttgcctcctgaacaatttttacccccgcgaggctaaagtgcagtggaaggtcgacaacgccctgcaaagcggcaattcccaggaatctgtgacagagcaggatagcaaagactccacctatagcctctcttccacgctgacacttagcaaggcggattacgaaaagcataaagtttatgcctgtgaggtgacccaccaggggctgtctagccctgtcacaaagtccttcaacagaggagagtgc

SEQ ID NO: 38947 - RNA, 651 nt, synthetic construct
  misc_feature 1..651: note = derived and/or modified sequence opt5 from rhuMab_HER2(9CI)_LightChain
  source 1..651: mol_type = other RNA
gtgcacagcgacatccagatgacccaatccccctctagcctgtccgcctctgtcggcgatagagttacaattacgtgcaaggctagccaggacgtgtccatcggggtggcctggtaccagcagaaacctggaaaggcgccgaaactcctgatttattctgctagctaccggtataccggcgtcccctcccgcttcagcgggtctggatccggcacagattttacccttacaatcagctctctgcaacctgaggacttcgccacctactattgtcagcagtactatatttacccctacacatttgggcagggaaccaaggtggaaatcaaaagaacggttgccgctccttccgtgttcatctttccccctagcgatgagcaactcaagtctggcaccgcctccgtcgtgtgcctgcttaacaatttctatccgcgggaagctaaggttcagtggaaagtggacaacgccctgcagagcggcaattcccaggagtctgtcacagaacaagatagcaaggactccacctacagcctctcttccacactgaccctgagcaaagcggattatgagaagcataaagtgtacgcctgtgaggtgacgcaccaggggctctctagccccgtcacaaagtcctttaaccgcggagaatgc

SEQ ID NO: 38948 - RNA, 1215 nt, synthetic construct
  misc_feature 1..1215: note = derived and/or modified sequence opt5 from rhuMab_HER2_HeavyChain
  source 1..1215: mol_type = other RNA
gaggtgcagctggtcgaaagcggcgggggactcgttcaacccggcgggtccctgagactttcttgcgccgctagcggattcacctttacagactacacgatggattgggtgcggcaggcccctggcaaggggctgaccgcggtgtattactgtgctcgcaacctcggaccgtccttctattttgactactggggccagggcacactggtcaccgtgtctagcgcctccacaaaagggccctctgttttccctcttgcccccagctccaagagcacctctggaggcacagctgccctggggtgcctcgtgaaagattattttcctgagcccgtcaccgtgtcctggaatagcggagctctgacgtctggcgttcacaccttccctgccgtgctgcagtccagcgggctctactctctgtccagcgtcgtgacagtgccgtcctctagccttggaacccaaacatatatctgtaacgtcaatcataagccctccaacaccaaagttgacaagaaggtggaacctaaaagctgcgataagacgcacacatgtcccccttgccccgcgccggagctgctcggcggcccttctgtgtttctgtttccccctaaacccaaggacacccttatgatttccagaacacccgaagtcacctgtgtggttgtggatgtcagccatgaggaccctgaggtgaaattcaattggtacgttgatggggtggaagtccacaacgccaagaccaagccgcgggaggaacagtacaattctacatatcgcgtggtcagcgtgctgacggttctccatcaggactggctgaacggaaaagagtacaagtgcaaagtgtccaataaggctctgcccgcccctatcgagaaaaccatttctaaggctaaaggccagcccagagaacctcaagtctatacactgcccccgagccgggaggaaatgaccaagaaccaggtgtccctcacatgtcttgttaaggggttctaccctagcgatatcgccgtggagtgggaatctaatggacagcccgagaacaattataaaaccacgcctcccgtcctggactccgatggcagctttttcctctactctaagctgacagtggacaaatcccgctggcagcaagggaacgtgtttagctgctccgttatgcacgaggcgcttcacaatcattatacccagaagtctctgagcctctcccctggacccaaa

SEQ ID NO: 38949 - RNA, 645 nt, synthetic construct
  misc_feature 1..645: note = derived and/or modified sequence opt5 from rhuMab_HER2_LightChain
  source 1..645: mol_type = other RNA
agcgacatccagatgacccaatccccctctagcctgtccgcctctgtgggcgatagagtcacaattacgtgccgggctagccaggacgttaacaccgccgtggcgtggtaccagcagaagcctgggaaagctccgaagctcctgatctattccgcctctttcctttacagcggagtgccctcccgctttagcggctctagatccgggacagatttcaccctgacaattagctctctccaacctgaggactttgccacctattactgtcagcagcactatacaacgccccctaccttcggacagggcaccaaagtcgaaatcaagcggacagtggctgccccctccgtttttattttccctccgagcgatgagcaactgaaatctgggaccgcttccgtggtctgccttctgaataacttttacccccgcgaagccaaggtgcagtggaaggttgacaatgcgctccagagcggaaactcccaggagtctgtgacagaacaagatagcaaagactccacctatagcctgtcttccacgctgacactcagcaaggccgattacgagaaacataaggtctacgcttgtgaggtgacccaccagggcctgtctagccctgtgacaaaatccttcaatagaggcgaatgc

SEQ ID NO: 38950 - RNA, 318 nt, synthetic construct
  misc_feature 1..318: note = derived and/or modified sequence opt5 from rhuMab_HER2_LightChain_variant1
  source 1..318: mol_type = other RNA
accgtggccgctcccagcgtcttcatctttcctccgtccgacgagcagctgaagtctggcacagccagcgttgtgtgcctcctgaacaatttctaccccagagaagcgaaagtgcaatggaaggtcgataacgcccttcagtccggaaattctcaggagagcgtgacggaacaggactccaaagattctacctatagcctgtccagcacactcaccctgtctaaggctgactacgagaaacacaaggtttatgcctgtgaagtgacacatcaagggctttccagccctgtcaccaagtcttttaaccggggcgagtgc

SEQ ID NO: 38951 - RNA, 642 nt, synthetic construct
  misc_feature 1..642: note = derived and/or modified sequence opt5 from rhuMab_HER2_LightChain_variant2
  source 1..642: mol_type = other RNA
gacatccagatgacccaaagcccctcctctctgagcgcctccgtgggcgatagagtcacaattacgtgccgggcttctcaggacgttaacaccgccgtggcgtggtaccagcagaaacctgggaaagctccgaagctcctgatctatagcgcctccttcctttactctggagtgcccagccgcttttccggcagcagatctgggacagatttcaccctgacaatttccagcctccaacctgaggactttgccacctattactgtcagcagcactatacaacgccccctaccttcggacagggcaccaaagtcgaaatcaagcggacatgcgctgccccctctgtgtttattttccctccgtccgatgagcaactgaaaagcgggaccgcttctgttgtgtgtcttctgaataacttttacccccgcgaagccaaggtccagtggaaggtggacaatgcgctccagtccggaaacagccaggagtccgttacagaacaagattctaaagacagcacctattccctgagctctacgctgacactctccaaggccgattacgagaaacataaggtgtacgcttgcgaggtcacccaccagggcctgagctctcctgtgacaaagagcttcaatagaggcgaatgt

SEQ ID NO: 38952 - RNA, 642 nt, synthetic construct
  misc_feature 1..642: note = derived and/or modified sequence opt5 from rhuMab_HER2_LightChain_variant3
  source 1..642: mol_type = other RNA
gacatccagatgacccaaagcccctcctctctgagcgcctccgtgggcgatagagtcacaattacgtgccgggcttctcaggacgttaacaccgccgtggcgtggtaccagcagaaacctgggaaagctccgaagctcctgatctatagcgcctccttcctttactctggagtgcccagccgcttttccggcagcagatctgggacagatttcaccctgacaatttccagcctccaacctgaggactttgccacctattactgtcagcagcactatacaacgccccctaccttcggacagggcaccaaagtcgaaatcaagcggacagtggctgccccctctgtttttattttccctccgtccgatgagcaactgaaaagcgggaccgcttctgtggtctgccttctgaataacttttacccccgcgaagccaaggtgcagtggaaggttgacaatgcgctccagtccggaaacagccaggagtccgtgacagaacaagattctaaagacagcacctattccctgagctctacgctgacactctccaaggccgattacgagaaacataaggtctacgcttgtgaggtgacccaccagggcctgagctctcctgtgacaaagagcttcaatagaggcgaatgc

SEQ ID NO: 38953 - RNA, 645 nt, synthetic construct; identical to SEQ ID NO: 38949
  misc_feature 1..645: note = derived and/or modified sequence opt5 from rhuMab_HER2_LightChain_variant4
  source 1..645: mol_type = other RNA

SEQ ID NO: 38954 - RNA, 321 nt, synthetic construct
  misc_feature 1..321: note = derived and/or modified sequence opt5 from rhuMab_HER2_LightChain_V-Region
  source 1..321: mol_type = other RNA
gacatccagatgacccaaagcccctcctctctgagcgcctccgtgggcgatagagtcacaattacgtgccgggcttctcaggacgttaacaccgccgtggcgtggtaccagcagaagcctgggaaagctccgaagctcctgatctatagcgcctccttcctttactctggagtgcccagccgcttttccggcagcagatctgggacagatttcaccctgacaatttccagcctccaacctgaggactttgccacctattactgtcagcagcactatacaacgccccctaccttcggacagggcaccaaagtcgaaatcaag

SEQ ID NO: 38955 - RNA, 1350 nt, synthetic construct
  misc_feature 1..1350: note = derived and/or modified sequence opt5 from rhuMab_HER2_gamma1-Chain
  source 1..1350: mol_type = other RNA
gaggtgcagctggtcgaaagcggcgggggactcgttcagcccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaatagcctgcgcgctgaagatacagccgtgtattactgttctagatggggcggggacggattctatgctatggattactggggccaggggacccttgttacagtgagctccgccagcaccaagggaccctctgtctttcctctggcgccctccagcaaatctacgtccggcgggaccgccgctctcggatgcctggtgaaggactacttccctgagcccgttacagtgagctggaactctggcgccctgacctccggcgtccatacatttcctgctgtgctccaaagctccgggctgtattctcttagctccgtggtcaccgttccgtcctcttccctgggaacgcagacatacatctgtaatgtgaaccacaagcccagcaataccaaagtggataagaaagtcgaacctaagtcttgcgacaaaacacatacctgtcccccttgccccgccccggagctcctgggcgggcctagcgtgttcctttttccccctaagcccaaggataccctgatgatttcccggacacccgaggttacgtgtgtggtcgtggacgtttctcacgaagatcctgaggtgaaattcaactggtatgtcgacggagtggaagtccataatgcgaagaccaaaccgcgcgaggagcagtacaacagcacatatagagtggtttccgtgctcaccgtcctgcaccaggattggctgaatggcaaggaatacaaatgcaaggtgagcaacaaagccctccccgctcctatcgagaagacaatctctaaggccaaagggcaaccccgggaacctcaggtttataccctgcccccgtcccgcgaggaaatgacgaagaatcaggtgagccttacatgtctggtcaaaggattttacccttctgacattgctgtggagtgggagtccaacggccagcccgaaaataactacaagaccacccctcccgtgctcgacagcgatggctccttctttctgtattctaaacttacagttgacaagagcagatggcaacaggggaacgtcttctcctgctctgtgatgcacgaggccctgcataatcactacacccaaaagagcctctccctgagccctggaaaa

SEQ ID NO: 38956 - RNA, 1350 nt, synthetic construct
  misc_feature 1..1350: note = derived and/or modified sequence opt5 from rhuMab_HER2__gamma1-Chain
  source 1..1350: mol_type = other RNA
gaggtgcagctggtcgaaagcggcgggggactcgttcagcccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaatagcctgcgcgctgaagatacagccgtgtattactgttctagatggggcggggacggattctatgctatggattactggggccaggggacccttgttacagtgagctcctgcagcaccaagggaccctctgtctttcctctggccccctccagcaaatctacgtccggcgggaccgcggccctcggatgtctggtgaaggactacttccctgagcccgttacagtgagctggaactctggcgctctgacctccggcgtccatacatttcctgccgtgctccaaagctccgggctgtattctcttagctccgtggtcaccgttccgtcctcttccctgggaacgcagacatacatctgcaatgtgaaccacaagcccagcaataccaaagtggataagaaagtcgaacctaagtcttgtgacaaaacacatacctgtcccccttgccccgctccggagctcctgggcgggcctagcgtgttcctttttccccctaagcccaaggataccctgatgatttcccggacacccgaggttacgtgcgtggtcgtggacgtttctcacgaagatcctgaggtgaaattcaactggtatgtcgacggagtggaagtccataatgccaagaccaaaccgcgcgaggagcagtacaacagcacatatagagtggtttccgtgctcaccgtcctgcaccaggattggctgaatggcaaggaatacaaatgtaaggtgagcaacaaagcgctccccgcccctatcgagaagacaatctctaaggctaaagggcaaccccgggaacctcaggtttataccctgcccccgtcccgcgaggaaatgacgaagaatcaggtgagccttacatgcctggtcaaaggattttacccttctgacattgccgtggagtgggagtccaacggccagcccgaaaataactacaagaccacccctcccgtgctcgacagcgatggctccttctttctgtattctaaacttacagttgacaagagcagatggcaacaggggaacgtcttctcctgttctgtgatgcacgaggctctgcataatcactacacccaaaagagcctctccctgagccctggaaaa

SEQ ID NO: 38957 - RNA, 729 nt, synthetic construct
  misc_feature 1..729: note = derived and/or modified sequence opt5 from rhuMab_HER2_gamma1-Chain__rhuMab_HER2_LightChain_sc4D5
  source 1..729: mol_type = other RNA
gaggtgcagctggtcgaaagcggcgggggactcgttcaacccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaactccctgcgcgctgaagatacagccgtgtattactgttctagatggggcggggacggattctatgctatggattactggggccaggggacccttgttacagtgagctccggaggcgggggaagcggcggcgggggatctggcgggggaggctccgacatccaaatgacccagagcccctcttccctgagcgcctctgtcggggatcgggtgacgattacctgccgcgcgtcccaggacgttaatacagccgtggcttggtaccagcaaaagcctggaaaagcccccaagctcctgatctatagcgcttcctttctgtactctggcgtccctagcagattctccggcagccggtctgggaccgattttacactcaccatctccagcctgcagcccgaggacttcgccacgtattactgtcagcagcattatacaacccctccgacatttggacaaggcaccaaggtggaaattaaacgc

SEQ ID NO: 38958 - RNA, 1350 nt, synthetic construct; identical to SEQ ID NO: 38955
  misc_feature 1..1350: note = derived and/or modified sequence opt5 from rhuMab_HER2_gamma1-Chain_variant1
  source 1..1350: mol_type = other RNA

SEQ ID NO: 38959 - RNA, 1350 nt, synthetic construct; identical to SEQ ID NO: 38956
  misc_feature 1..1350: note = derived and/or modified sequence opt5 from rhuMab_HER2_gamma1-Chain_variant2
  source 1..1350: mol_type = other RNA

SEQ ID NO: 38960 - RNA, 1350 nt, synthetic construct
  misc_feature 1..1350: note = derived and/or modified sequence opt5 from rhuMab_HER2_gamma1-Chain_variant3
  source 1..1350: mol_type = other RNA
gaggtgcagctggtcgaaagcggcgggggactcgttcagcccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaatagcctgcgctgtgaagatacagctgtgtattactgctctagatggggcggggacggattctatgccatggattactggggccaggggacccttgttacagtgagctccgctagcaccaagggaccctctgtctttcctctggccccctccagcaaatctacgtccggcgggaccgcggccctcggatgtctggtgaaggactacttccctgagcccgttacagtgagctggaactctggcgctctgacctccggcgtccatacatttcctgccgtgctccaaagctccgggctgtattctcttagctccgtggtcaccgttccgtcctcttccctgggaacgcagacatacatctgcaatgtgaaccacaagcccagcaataccaaagtggataagaaagtcgaacctaagtcttgtgacaaaacacatacctgtcccccttgccccgctccggagctcctgggcgggcctagcgtgttcctttttccccctaagcccaaggataccctgatgatttcccggacacccgaggttacgtgcgtggtcgtggacgtttctcacgaagatcctgaggtgaaattcaactggtatgtcgacggagtggaagtccataatgccaagaccaaaccgcgcgaggagcagtacaacagcacatatagagtggtttccgtgctcaccgtcctgcaccaggattggctgaatggcaaggaatacaaatgtaaggtgagcaacaaagcgctccccgcccctatcgagaagacaatctctaaggctaaagggcaaccccgggaacctcaggtttataccctgcccccgtcccgcgaggaaatgacgaagaatcaggtgagccttacatgcctggtcaaaggattttacccttctgacattgccgtggagtgggagtccaacggccagcccgaaaataactacaagaccacccctcccgtgctcgacagcgatggctccttctttctgtattctaaacttacagttgacaagagcagatggcaacaggggaacgtcttctcctgttctgtgatgcacgaggctctgcataatcactacacccaaaagagcctctccctgagccctggaaaa

SEQ ID NO: 38961 - RNA, 360 nt, synthetic construct
  misc_feature 1..360: note = derived and/or modified sequence opt5 from rhuMab_HER2_gamma1-Chain_V-Region
  source 1..360: mol_type = other RNA
gaggtgcagctggtcgaaagcggcgggggactcgttcaacccggcgggtccctgagactttcttgcgccgctagcggattcaatatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaactccctgcgcgctgaagatacagccgtgtattactgttctagatggggcggggacggattctatgctatggattactggggccaggggacccttgttacagtgagctcc

SEQ ID NO: 38962 - RNA, 1359 nt, synthetic construct; identical to SEQ ID NO: 38293
  misc_feature 1..1359: note = derived and/or modified sequence opt5 from rhuMAb-VEGF_HeavyChain1
  source 1..1359: mol_type = other RNA

SEQ ID NO: 38963 - RNA, 642 nt, synthetic construct; identical to SEQ ID NO: 38294
  misc_feature 1..642: note = derived and/or modified sequence opt5 from rhuMAb-VEGF_LightChain1
  source 1..642: mol_type = other RNA

SEQ ID NO: 38964 - RNA, 642 nt, synthetic construct; identical to SEQ ID NO: 38294
  misc_feature 1..642: note = derived and/or modified sequence opt5 from rhuMAb-VEGF_LightChain
  source 1..642: mol_type = other RNA

SEQ ID NO: 38965 - RNA, 321 nt, synthetic construct; identical to SEQ ID NO: 38303
  misc_feature 1..321: note = derived and/or modified sequence opt5 from rhuMAb-VEGF_LightChain__VG-Region
  source 1..321: mol_type = other RNA

SEQ ID NO: 38966 - RNA, 1359 nt, synthetic construct; identical to SEQ ID NO: 38293
  misc_feature 1..1359: note = derived and/or modified sequence opt5 from rhuMAb-VEGF_gamma1-Chain
  source 1..1359: mol_type = other RNA

SEQ ID NO: 38967 - RNA, 369 nt, synthetic construct; identical to SEQ ID NO: 38298
  misc_feature 1..369: note = derived and/or modified sequence opt5 from rhuMAb-VEGF_gamma1-Chain_VDG-Region
  source 1..369: mol_type = other RNA

SEQ ID NO: 38968 - RNA, 1338 nt, synthetic construct
  misc_feature 1..1338: note = derived and/or modified sequence opt5 from Rilotumumab_HeavyChain1
  source 1..1338: mol_type = other RNA
caggtgcagctgcaggagagcggccccgggctcgtcaagccttccgaaaccctgtctcttacatgcacggttagcggaggctccatctctatttactattggagctggatcagacagccgcccgggaaaggactggagtggattggctacgtgtattactccgggtctaccaactataatcctagcctcaagtcccgggtgacaatcagcgtcgacacctctaaaaaccagttctccctgaaacttaatagcgtgacagccgctgataccgccgtttactattgtgcgcgcggaggctacgacttttggtctggctacttcgattattgggggcaaggaacactggtgaccgtctccagcgcttctacgaagggcccctccgtgtttcctctcgccccctgcagcagatccacctctgaaagcacagccgctctggggtgtctggttaaggactacttccctgagccggtgaccgtctcctggaacagcggagccctcacatctggcgtgcacacctttcccgctgtgctgcagtccagcgggctttattctctgagctccgtcgttacggtgccttctagcaatttcggaacacagacctacacatgcaacgtggatcataagccctccaataccaaagtcgacaagaccgtggaacggaaatgttgcgttgagtgtcctccctgcccggcccctcccgtggcgggccctagcgtctttctcttcccgcccaagcctaaagatacactgatgatttctcgcacgccggaggtgacctgtgttgtggtcgacgtgtcccacgaagatcccgaggtccagtttaactggtatgtggacggcgttgaagtgcataatgccaagacaaagcctagagaggagcaattcaacagcacctttcgggtcgtgtctgttcttacagtggtccaccaggattggctgaatgggaaagaatacaagtgcaaagtgtccaacaagggactccccgctcctatcgagaaaaccatcagcaagacgaaaggccagccccgcgaaccccaggtgtatacactgcctccctccagagaggaaatgaccaagaatcaagtttctctgacctgtctcgtcaaggggttctaccctagcgacattgccgtggagtgggagtccaacggacagcccgaaaataactacaaaacaacccctcccatgctggattctgacggcagctttttcctttattccaagctgacagtggacaaaagccggtggcagcaagggaacgtcttctcttgctccgtgatgcatgaggctctccacaatcactacacgcaaaagagcctgtctctttccccgggaaaa

SEQ ID NO: 38969 - RNA, 645 nt, synthetic construct
  misc_feature 1..645: note = derived and/or modified sequence opt5 from Rilotumumab_LightChain1
  source 1..645: mol_type = other RNA
gagatcgtgatgacccagagccccgccacactgtccgtctctcctggcgaaagagctacgctcagctgccgggcctcccaatctgttgacagcaacctggcgtggtaccgccagaagccggggcaggctcccagacttctgatttatggagcctccacccgggccacaggcatccctgctcgcttctctgggagcggatccggcaccgagtttacactcaccattagctctctgcagtccgaagatttcgccgtgtactattgtcaacagtacatcaattggccccctattacatttgggcagggaaccagacttgagatcaaacggacggtggctgcccccagcgtcttcatctttcctccgtctgacgaacagctgaagtccggcaccgcgagcgtggtttgcctcctgaacaatttctatccccgcgaggccaaagtgcaatggaaggtcgataacgctctgcagtctggcaattcccaggagagcgtgacagaacaggactccaaagattctacctacagcctctccagcacactgaccctttctaaggccgactatgagaagcacaaagtttacgcttgtgaagtgacgcatcaagggctgtccagccctgtcacaaagtcttttaacagaggagagtgc

SEQ ID NO: 38970 - RNA, 1071 nt, synthetic construct; identical to SEQ ID NO: 38927
  misc_feature 1..1071: note = derived and/or modified sequence opt5 from Rilotumumab_scFv-CH_chain
  source 1..1071: mol_type = other RNA

SEQ ID NO: 38971 - RNA, 1347 nt, synthetic construct
  misc_feature 1..1347: note = derived and/or modified sequence opt5 from Rinucumab_HeavyChain1
  source 1..1347: mol_type = other RNA
cagctgcaactccaggagagcggccccgggctggtgaagccttccgaaaccctttctctgacatgcacggtcagcggaggctccatcacctctagctcctactattgggggtggattagacagccgcccggaaaaggcctcgagtggatcgggtctatttactatcggggaagcacaaactacaatccttccctgaagtctcgcgttaccatctctgtggactccagcaaaaaccagttctatcttaaggtgtcttccgtcacagccgtggataccgctgtttactattgtgccagacaaaatggcgcggctcggcccagctggtttgacccttggggccaggggacactggtgaccgtctcttccgccagcacgaaaggaccctccgtgttccctctcgccccgtgctctcgcagcacctccgaaagcacagctgccctgggctgtctggttaaggattactttcccgagcctgtgaccgtctcttggaactccggggctctcacaagcggagtgcacaccttccccgccgtgctgcagtctagcggcctttactccctgtctagcgtcgttacggtgccttccagctctctcgggacaaagacctatacatgcaatgtggaccataaaccctccaacaccaaggtcgataaaagagtggaaagcaagtacggaccgccttgtcccccttgccccgcgcccgagtttctgggcggcccttctgttttcctttttccgcccaaacctaaggacaccctgatgatttcccggacacccgaggtgacgtgtgtcgtggttgatgtgagccaggaagaccctgaggtccaattcaattggtatgtggatggggtcgaagtgcacaacgccaagaccaaaccccgcgaggagcagtttaattccacatacagagttgtgtctgtcctcaccgtgctgcatcaggactggctgaacggaaaggaatataaatgcaaggttagcaataaaggcctcccgtcctctatcgagaagacaatcagcaaagctaaggggcagcctcgggaaccccaagtgtacaccctgcctccctcccaggaggaaatgacgaagaaccaggtcagccttacatgtctggtgaaaggattctatccttctgatattgccgtggagtgggagtccaatggccaacccgaaaacaattacaagaccaccccgcctgttctcgacagcgatgggagctttttcctgtactcccgccttacagtcgacaaaagcagatggcaggagggaaacgtgttttcttgcagcgtgatgcacgaagctctgcataaccactatacccagaagtccctcagcctgtctctgggcaaa

SEQ ID NO: 38972 - RNA, 1344 nt, synthetic construct
  misc_feature 1..1344: note = derived and/or modified sequence opt5 from Rinucumab_HeavyChain
  source 1..1344: mol_type = other RNA
cagctgcaactccaggagagcggccccgggctggtgaagccttccgaaaccctttctctgacatgcacggtcagcggaggctccatcacctctagctcctactattgggggtggattagacagccgcccggaaaaggcctcgagtggatcgggtctatttactatcggggaagcacaaactacaatccttccctgaagtctcgcgttaccatctctgtggactccagcaaaaaccagttctatcttaaggtgtcttccgtcacagccgtggataccgctgtttactattgtgccagacaaaatggcgcggctcggcccagctggtttgacccttggggccaggggacactggtgaccgtctcttccgccagcacgaaaggaccctccgtgttccctctcgccccgtgctctcgcagcacctccgaaagcacagctgccctgggctgtctggttaaggattactttcccgagcctgtgaccgtctcttggaactccggggctctcacaagcggagtgcacaccttccccgccgtgctgcagtctagcggcctttactccctgtctagcgtcgttacggtgccttccagctctctcgggacaaagacctatacatgcaatgtggaccataaaccctccaacaccaaggtcgataaaagagtggaaagcaagtacggaccgccttgtcccccttgccccgcgcccgagtttctgggcggcccttctgttttcctttttccgcccaaacctaaggacaccctgatgatttcccggacacccgaggtgacgtgtgtcgtggttgatgtgagccaggaagaccctgaggtccaattcaattggtatgtggatggggtcgaagtgcacaacgccaagaccaaaccccgcgaggagcagtttaattccacatacagagttgtgtctgtcctcaccgtgctgcatcaggactggctgaacggaaaggaatataaatgcaaggttagcaataaaggcctcccgtcctctatcgagaagacaatcagcaaagctaaggggcagcctcgggaaccccaagtgtacaccctgcctccctcccaggaggaaatgacgaagaaccaggtcagccttacatgtctggtgaaaggattctatccttctgatattgccgtggagtgggagtccaatggccaacccgaaaacaattacaagaccaccccgcctgttctcgacagcgatgggagctttttcctgtactcccgccttacagtcgacaaaagcagatggcaggagggaaacgtgttttcttgcagcgtgatgcacgaagctctgcataaccactatacccagaagtccctcagcctgtctctgggc

SEQ ID NO: 38973 - RNA, 645 nt, synthetic construct
  misc_feature 1..645: note = derived and/or modified sequence opt5 from Rinucumab_LightChain1
  source 1..645: mol_type = other RNA
gagatcgtgctgacgcagagccccgacacaatttccctctctcctggcgaaagagccacgctgagctgccgggcttcccaatctatcagctccatttaccttgcctggtatcagcagaagccggggcaggcgccccgcctgctcatctacggagcttctagcagagtcaccggcattcctgatcggttctccgttagcgggtctggaacagactttaccctgacaatctcccgccttgagcccgaagatttcgccgtgtattactgtcaacactatggcatcagcccttttaccttcgggcccggaacaaaagtggacattagacggaccgtcgccgctccttctgtgtttatcttcccgccctccgatgagcagctcaagagcggcacggcctctgttgtgtgcctgctgaacaatttttaccctcgcgaagctaaagtccagtggaaggtggacaacgccctgcagtccggcaatagccaagagtccgttaccgagcaggattctaaagacagcacatattccctcagctctaccctgacactttccaaggcggattacgaaaagcataaagtgtacgcctgtgaggtcacccaccaggggctgagctctcccgtgaccaagagcttcaacagaggagaatgc

SEQ ID NO: 38974 - RNA, 1347 nt, synthetic construct
  misc_feature 1..1347: note = derived and/or modified sequence opt5 from Risankizumab_HeavyChain1
  source 1..1347: mol_type = other RNA
caggtgcaactggtccagagcggcgccgaggttaagaaacccgggtcctctgtgaaggtgagctgcaaggcttccggatacaccttcacagaccagacgatccactggatgagacaggcccctggccaagggctcgaatggattggatatatctacccgcgggatgactctcccaaatataacgagaattttaaaggcaaggtcaccattacagcggataagagcacctccacagcttacatggaactgtctagccttcgctccgaggacaccgccgtgtattactgtgccatccctgatagaagcgggtatgcttggttcatttactggggacagggcacactggttaccgtgtcttccgccagcacgaaaggcccctctgtctttcctctcgctccctccagcaagtctacctccgggggaacagccgcgctgggctgccttgtgaaagactacttccctgaaccggttaccgtgagctggaactccggggccctgacatctggagtccatacctttcccgctgtgctccagagctccggcctgtatagcctgtcttccgtggtcacggttcctagctctagcctcgggacacagacctacatctgtaatgtgaaccacaagccctccaatacaaaagtggataagcgggtcgagcctaagtcttgcgacaaaacccatacctgtcccccgtgccctgcccccgaggctgccggaggccctagcgtgttcctgtttcctcccaagcccaaagatacacttatgatctcccgcacgccggaagttacctgtgtggtcgtggacgttagccacgaggatcccgaagtgaagttcaactggtatgtcgacggcgtggaggtccataatgcgaaaacaaagcctagagaggaacaatacaactctacctatcgggtggtttccgtgctgacagtcctccaccaggattggctgaatgggaaagagtacaagtgcaaggtgagcaacaaagcccttcccgctcctattgaaaagaccatctctaaagccaagggacagccccgcgagccgcaggtttatacgctgcctccctccagagaagagatgaccaaaaatcaagtgagcctcacatgtctggtcaagggcttttacccttccgacattgctgtggagtgggaatctaacgggcagcccgagaataactacaagaccacacctcccgtgctggacagcgatggatccttctttctctattctaaactgaccgttgacaagagccggtggcagcaaggcaatgtcttctcctgcagcgtgatgcacgaagcccttcataaccactacacacagaaatctctgtccctcagcccgggg

SEQ ID NO: 38975 - RNA, 642 nt, synthetic construct
  misc_feature 1..642: note = derived and/or modified sequence opt5 from Risankizumab_LightChain1
  source 1..642: mol_type = other RNA
gacatccagatgacccaaagcccctcctctctgagcgcctccgtgggcgatagagtcacaattacgtgcaaggcttctcgggacgttgccatcgcggtggcttggtaccagcagaaacctgggaaggtgccgaaactcctgatttattgggccagcacccgccacacaggagtcccctccagattctctggcagcgggtcccggaccgattttacacttaccatcagctctctgcagcctgaggacgtggccgattacttctgtcatcaatattccagctacccctttacattcggatctggcaccaagctcgaaattaaacgcacggttgctgccccttccgtgtttatctttccccctagcgacgagcagctgaagtctgggaccgcttccgtcgtgtgccttctgaacaatttctatccgagagaagccaaggttcagtggaaagtggataacgcgctccagagcggaaattcccaagagtctgtcacagaacaggacagcaaggattccacctacagcctgtcttccacactgaccctcagcaaagccgactatgagaagcacaaagtgtacgcttgtgaggtgacgcatcagggcctgtctagccccgtcacaaagtccttcaaccggggcgaatgc

SEQ ID NO: 38976 - RNA, 1353 nt, synthetic construct
  misc_feature 1..1353: note = derived and/or modified sequence opt5 from Rituximab_HeavyChain
  source 1..1353: mol_type = other RNA
caggtgcaactgcagcagcccggcgccgagctcgtcaagcctggggctagcgttaaaatgtcctgcaaggcctctggatacaccttcacaagctataacatgcactgggtgaaacagacgccgggcagagggctggaatggatcggagcgatttaccccggcaatggggacacctcctataaccaaaagtttaaaggaaaggctacacttaccgccgataagtctagctccacagcctacatgcagctgtctagcctcacctccgaggacagcgctgtgtattactgtgcccggtctacatattacggcggcgattggtacttcaatgtctggggagctgggaccacggtgaccgtttccgccgcgagcacaaaaggcccttctgtgtttcccctggccccttccagcaagtctacctccgggggaacagctgcccttggctgcctggtcaaagactatttccccgaacctgtgaccgttagctggaactccggggctctcacgtctggagtgcatacatttccggccgtcctgcagagctccggcctgtacagcctctcttccgtggtgaccgtccccagctctagcctgggcacacagacctatatctgtaatgttaaccacaagccttccaataccaaagtggataagaaggtggagcccaaatcttgcgacaagacacatacgtgtcctccctgcccggcgcctgaacttctcgggggacccagcgtcttcctgtttcctcccaaacccaaggataccctgatgatttcccgcacacctgaggtgacctgtgttgtggtcgacgtgagccacgaggatccggaagttaaattcaactggtacgtggacggcgtcgaggtgcataatgccaagacaaaacccagagaagaacaatataactctacctaccgggtcgtgtccgttcttacggtgctgcaccaggattggctcaatgggaaggagtataagtgcaaagtcagcaacaaggctctgcctgcccccatcgagaaaacaatttctaaggctaaaggacagcctcgcgagccccaggtgtacaccctgccgccttccagagacgaactcaccaagaatcaagttagcctgacatgtcttgtgaagggcttttacccctccgatatcgccgtcgagtgggaatctaacgggcagcctgagaataactataaaaccacaccccctgtgctggacagcgacggatccttctttctctactctaagctgacggtggataaaagccggtggcagcaaggcaacgttttctcctgcagcgtcatgcacgaggcccttcataatcactatacccagaagtctctgtccctcagccccggcaaa

SEQ ID NO: 38977 - RNA, 1353 nt, synthetic construct
  misc_feature 1..1353: note = derived and/or modified sequence opt5 from Rituximab_HeavyChain_variant
  source 1..1353: mol_type = other RNA
caggtgcaactgcagcagcccggcgccgagctcgtcaagcctggggctagcgttaaaatgtcctgcaaggcctctggatacaccttcacaagctataacatgcactgggtgaaacagacgccgggcagagggctggaatggatcggagcgatttaccccggcaatggggacacctcctataaccaaaagtttaaaggaaaggctacacttaccgccgataagtctagctccacagcctacatgcagctgtctagcctcacctccgaggacagcgctgtgtattactgtgcccggtctacatattacggcggcgattggtacttcaatgtctggggagctgggaccacggtgaccgtttccgccgcgagcacaaaaggcccttctgtgtttcccctggccccttccagcaagtctacctccgggggaacagctgcccttggctgcctggtcaaagactatttccccgaacctgtgaccgttagctggaactccggggctctcacgtctggagtgcatacatttccggccgtcctgcagagctccggcctgtacagcctctcttccgtggtgaccgtccccagctctagcctgggcacacagacctatatctgtaatgttaaccacaagccttccaataccaaagtggataagaaggcggagcccaaatcttgcgacaagacacatacgtgtcctccctgcccggcccctgaacttcttgggggacccagcgtgttcctctttcctcccaaacccaaggataccctgatgatttcccgcacacctgaggtcacctgtgtggttgtggacgtcagccacgaggatccggaagtgaaattcaactggtacgttgacggcgtggaggtccataatgctaagacaaaacccagagaagaacaatataactctacctaccgggtggtctccgtgcttacggttctgcaccaggattggctcaatgggaaggagtataagtgcaaagtgagcaacaaggccctgcctgctcccatcgagaaaacaatttctaaggccaaaggacagcctcgcgagccccaggtctacaccctgccgccttccagagacgaactcaccaagaatcaagtgagcctgacatgtcttgttaagggcttttacccctccgatatcgccgtggagtgggaatctaacgggcagcctgagaataactataaaaccacaccccctgtcctggacagcgacggatccttctttctctactctaagctgacggtggataaaagccggtggcagcaaggcaacgtgttctcctgcagcgttatgcacgaggctctgcataatcactatacccagaagtctctgtccctcagccccggcaaa

SEQ ID NO: 38978 - RNA, 639 nt, synthetic construct
  misc_feature 1..639: note = derived and/or modified sequence opt5 from Rituximab_LightChain
  source 1..639: mol_type = other RNA
cagatcgtgctgagccaatcccccgccattctctctgctagccctggcgagaaggtcaccatgacatgcagagcctcctctagcgtttcctacatccactggttccagcagaaaccggggtctagccccaagccttggatttatgcgacgtccaacctggctagcggagtgcccgtgcggttttctggctccgggagcggaacctcttactcccttacaatcagccgcgtcgaagccgaggacgccgctacctattactgtcagcaatggacatctaatcctcccaccttcggcgggggaacaaaactggaaattaagagaaccgtggccgctccttccgtttttatcttcccgcccagcgatgagcagctcaaatccggcacggcctctgtggtctgcctgcttaacaatttttatcctcgggaagcgaaggtgcagtggaaggttgacaacgccctgcagagcggcaattcccaagagagcgtgaccgagcaggattctaaagactccacatacagcctctctagcaccctgacactgtccaaggctgattatgaaaaacataaggtctacgcctgtgaggtgacccaccaggggctctctagccccgtgacgaaatccttcaaccgcggagaatgc

SEQ ID NO: 38979 - RNA, 714 nt, synthetic construct
  misc_feature 1..714: note = derived and/or modified sequence opt5 from Rivabazumab_pegol_HeavyChain1
  source 1..714: mol_type = other RNA
gaggtgcagctggtcgaaagcggcgggggagttgtgcaacccggcagatccctccggctgtcttgcgccgctagcgggttcaccttttccaactaccctatgcactgggtgcgccaggccccgggaaagggccttgagtgggtcgcggtgatctcttatgacgggagcgaaaaatggtacgctgattccgttaagggaagattcacaatttctcgggacaatagcaaaaacacgctgtatctcgagatgaactccctgcgccccgaagataccgccgtgtactattgtgccagaaatcggggcgacatctactatgattttacatacgctatggacatttggggccaggggaccacagtcaccgtgagctctgcctccacaaagggacctagcgttttcccccttgctccttcttccaaaagcacctctggcgggacggccgcgctgggatgcctcgtgaaggattactttcccgagcctgtcaccgtgtcctggaatagcggcgccctgacatccggggtgcataccttcccggctgtcctgcagtctagcggactctattccctgagctctgttgtgacagtgccctccagctctcttggcacccaaacgtacatctgtaacgtcaatcacaagcctagcaacacaaaagtggacaagaaagttgagcccaagtcctctgataaaacccatacatgccctccctgtccggcc

SEQ ID NO: 38980 - RNA, 642 nt, synthetic construct
  misc_feature 1..642: note = derived and/or modified sequence opt5 from Rivabazumab_pegol_LightChain1
  source 1..642: mol_type = other RNA
gacatccagctgacccaaagcccctccacactctctgccagcgtgggcgattccgtcacgattacctgcagagcttctgagggggttgaccggtggctggcctggtaccagcagaagcctggacgcgcgccgaaacttctgatctatgatgctagcacactccagtccggcgtgccctctagattcagcgggtccggaagcggcaccgaattttctctgacaatttccagccttcaacctgacgatgtggccacctactattgtcagcacttctgggggacaccctacacctttggacagggcacgaagctggagatcaaacggaccgtcgccgctccttctgtgttcatttttcccccttccgacgaacagctcaagagcggcacagcctctgttgtgtgcctgctgaacaatttctatccgcgcgaggctaaagtccaatggaaggtggataacgccctccagtccgggaatagccaggaatccgttaccgagcaggactctaaggatagcacatactccctgagctctacccttacgctgtccaaagcggactatgagaagcataaagtgtacgcctgtgaagtcacacaccaaggactcagctctcccgtgaccaagagctttaacagaggcgagtcc

SEQ ID NO: 38981 - RNA, 1344 nt, synthetic construct
  misc_feature 1..1344: note = derived and/or modified sequence opt5 from Robatumumab_HeavyChain1
  source 1..1344: mol_type = other RNA
gaggtgcagctggtccagagcggcgggggactcgttaagcccggcgggtccctgagactttcttgcgccgctagcggattcaccttttcctctttcgccatgcactgggtgcggcaggcgcctggcaaagggctggaatggatcagcgtgattgacacacgcggagctacgtactatgccgattccgtcaagggcagatttaccatctctcgggacaacgccaaaaatagcctctacctgcagatgaactcccttcgcgctgaggatacagccgtgtattactgtgctagactgggcaatttctattacgggatggacgtttggggacagggcaccacagtgaccgtcagctctgcctccacaaaggggccgagcgtgtttcccctcgcgccttcttccaaaagcacctctggaggcacggccgctctggggtgcctggttaaggattatttccccgaacctgtgaccgtctcctggaacagcggagccctcacatccggcgtgcatacctttcccgctgtgctgcaatctagcggcctttactccctgagctctgtcgttacagtgccttccagctctctcgggacccagacgtacatttgtaatgtgaaccacaagccgagcaatacaaaagtcgacaagaaagtggagcccaagtcctgcgataaaacccatacatgtcctccctgccctgcccccgaactgcttggaggcccgtctgttttcctgtttcctcccaagcctaaggacaccctcatgatcagccggacccccgaggtgacatgtgtcgtggttgatgtgtcccacgaggaccccgaagtcaaattcaactggtatgtggatggggtcgaggtgcataatgcgaagacgaaacctcgcgaggaacagtacaacagcacctatagagttgtgtctgtcctgacagtgctgcaccaggactggctcaatggaaaggagtacaaatgcaaggtttccaacaaagccctgccggctcccattgaaaagaccatcagcaaggccaaaggccaacctcgggagccccaggtgtatacacttcctccctctcgcgatgaactgaccaagaatcaggtctccctcacgtgtctggtgaaagggttttacccgagcgacatcgctgtggagtgggaatccaacggacagcctgagaataactataagacaacaccccctgttcttgactctgatggcagcttctttctgtactccaaactcaccgtcgacaagtctagatggcaacagggcaacgtgttcagctgctccgtgatgcacgaggccctgcataatcactacacccaaaagagcctgtctctctcccccgggaaa

SEQ ID NO: 38982 - RNA, 642 nt, synthetic construct
  misc_feature 1..642: note = derived and/or modified sequence opt5 from Robatumumab_LightChain1
  source 1..642: mol_type = other RNA
gagatcgtgctgacccagagccccggcacactctccgtctctcctggggaaagagccacgctgagctgccgggcttcccaatctattggaagctcccttcactggtaccagcagaagccgggccaggcgccccgcctgctcatcaaatatgcctctcaaagcctgtccgggattcctgacagattcagcggatctggctccgggaccgattttacacttaccatcagccggctggagcccgaagacttcgctgtttactattgtcatcagtcttcccgcctccctcacacatttggacagggcaccaaggtggagattaaaagaacagtggccgcccccagcgtcttcatctttcctccgtctgatgaacagctgaagtccggcaccgctagcgtggtttgcctgctcaacaatttctacccccgggaggccaaagtgcaatggaaggtcgacaacgctctgcagtccggaaattctcaggagagcgtgacggaacaggattccaaggacagcacctattctctttccagcacactgaccctctctaaagccgattacgagaagcataaagtttatgcgtgtgaagtgacacaccaagggctgagctcccctgtcaccaagtcttttaaccgcggcgagtgc

SEQ ID NO: 38983 - RNA, 1368 nt, synthetic construct
  misc_feature 1..1368: note = derived and/or modified sequence opt5 from Roledumab_HeavyChain1
  source 1..1368: mol_type = other RNA
caggtgcaactggtcgagagcggcgggggagttgtgcagcccggcagatccctccggctgtcttgcaccgccagcgggttcacatttaagaactacgctatgcactgggtgcgccaggcccctgcgaaaggacttgaatgggtcgctacgatctcctatgacggcagaaatattcagtacgccgattctgtgaaggggcggttcacctttagccgcgacaactcccaagatacactgtatctccagcttaattctctgagaccggaggacaccgccgtttactattgtgctcggcccgtgcgcagcagatggctgcagctcggactggaagatgccttccatatctggggccagggcacaatggtcaccgtgtccagcgcttctacaaaagggccttccgtttttcccctggcccctagctctaagtccaccagcggaggcacggcggccctcgggtgcctggtgaaagactacttccccgagcctgtcaccgtgtcttggaactccggagctcttacaagcggcgtgcacacctttccggccgtcctgcaatcctctgggctctatagcctgtccagcgttgtgacagtgccctcttccagccttggaacccagacgtacatttgtaatgtcaaccataagccttctaatacaaaggtggataaaaaggttgaacccaaaagctgcgacaagacccacacatgtcctccctgcccggctcctgagctgctcggcggcccctccgtgttcctgtttcctcccaaacccaaggataccctgatgatctctcggacccctgaggtcacatgtgtggttgtggacgtcagccatgaagatccggaggtgaagttcaactggtacgtcgacggggtggaagttcacaatgccaaaacgaagccccgcgaggagcagtataactccacctacagagtggtcagcgtgctcacagttctgcaccaggattggcttaatggaaaagaatataagtgcaaagtgtctaacaaggcgctgcctgcccccattgagaaaaccatctccaaggctaagggccaacctcgggaaccccaggtctacacactcccgcctagccgcgacgagctgaccaaaaatcaggtgtctcttacgtgtctggtgaaggggttttatccctccgacatcgccgttgaatgggagagcaacggacaacctgagaataactacaaaacaacaccccctgtcctcgattccgacggctctttctttctgtatagcaagctgaccgtggataaatccagatggcagcaggggaacgtgttctcttgcagcgtcatgcatgaagctctccacaatcattacacccagaagtccctgagcctttctcccggaaag

SEQ ID NO: 38984 - RNA, 642 nt, synthetic construct
  misc_feature 1..642: note = derived and/or modified sequence opt5 from Roledumab_LightChain1
  source 1..642: mol_type = other RNA
gccatcagaatgacccagagcccctcctctttcagcgcttccacaggcgaccgggtgacgattacctgccgcgcctctcaagatatcagaaactacgtcgcgtggtatcagcaaaagagcgggaaagctcctaagtttctgatttacgccgcctccacactccagtctggagttccgagccggttctccggcagcgggtctggaaccgactttacactgaccatcaattcccttcagagcgaggatttcgctacatattactgtcagcagtattacaactctccccctacctttggccaggggacgcgcgtggaaattaccagaacagtggccgctccctccgtcttcatctttcctcccagcgacgagcaactgaaatctggaaccgcctccgtggtttgcctcctgaataacttctatcctcgggaagcgaaggtgcagtggaaagtcgataatgcccttcagagcggcaactcccaggagtctgtgacagaacaagacagcaaggattccacctacagcctgtcttccacgctcacactgagcaaggctgactacgagaaacacaaggtttatgcctgtgaggtgacccatcagggcctgtctagcccggtcacaaaatcctttaatcgcggggaatgc

SEQ ID NO: 38985 - RNA, 639 nt, synthetic construct; identical to SEQ ID NO: 38939
  misc_feature 1..639: note = derived and/or modified sequence opt5 from Romosozumab_fab_fragment
  source 1..639: mol_type = other RNA

SEQ ID NO: 38986 - RNA, 1347 nt, synthetic construct
  misc_feature 1..1347: note = derived and/or modified sequence opt5 from Romosozumab_HeavyChain1
  source 1..1347: mol_type = other RNA
gaggtgcagctggtccaaagcggcgccgaagttaagaaacccggggcttccgtgaaggtgtcttgcaaagccagcggatacaccttcacagactataacatgcactgggtcagacaggcgcctggccaggggctcgagtggatgggagaaatcaatccgaactccggcggggctggatacaatcagaagtttaaaggccgggtgacgatgaccacagatacctctacaagcaccgcctatatggagctgcgctcccttagatctgacgatacagccgtttactattgtgctcggctgggctacgacgatatttatgacgattggtacttcgacgtgtgggggcaaggaaccacggtcaccgtgagctccgccagcacaaagggcccctctgtttttcctctcgctccctgctcccgcagcacctctgaatccacagccgcgctggggtgtcttgtgaaggattacttccctgagcccgtcaccgtgagctggaactctggagccctgacgtccggcgtgcatacatttcctgctgtcctccagagctccgggctgtattctctgagctccgttgtgaccgtgccgagctctaatttcggaacacagacctatacctgcaacgtcgaccacaaaccctccaatacaaaggtggataaaacggttgagagaaagtgttgcgtggaatgtcctccctgccctgctcccccggtcgccggccctagcgtgtttctctttccccctaaacccaaggacaccctgatgatctctcggacacccgaggttacctgtgtggtcgtggatgtcagccatgaagaccctgaggtgcagttcaactggtacgttgacggcgtggaggtccacaatgccaagacaaaaccgcgcgaggaacaattcaactccacctttagagtggtttctgtgcttacggtcgtgcatcaggattggctgaatgggaaggaatacaaatgcaaggtgagcaacaaaggactccccgcgcctattgagaagacaatctccaaaaccaagggccagccccgggaacctcaggtttataccctgcccccgagccgcgaggagatgacaaagaatcaagtctctcttacctgtctggtgaaagggttctacccttccgacattgccgtggaatgggagagcaacggacagcccgaaaataactataagacaacgcctcccatgctcgattctgacggctcctttttcctgtacagcaaactgaccgtcgataagtccagatggcagcaagggaacgtgttctcttgcagcgttatgcacgaggctctccacaatcattacacacagaaatccctgtctcttagccctggaaag

SEQ ID NO: 38987 - RNA, 642 nt, synthetic construct
  misc_feature 1..642: note = derived and/or modified sequence opt5 from Romosozumab_LightChain1
  source 1..642: mol_type = other RNA
gacatccagatgacccaaagcccctcctctctgagcgcctccgtgggcgatagagtcacaattacgtgccgggcttctcaggacatcagcaactacctcaattggtatcagcagaaacctgggaaagccccgaagctgcttatttactatacctcccgcctgctctctggagttcccagcagattctccggcagcgggtctggaacagattttaccctgacaatctccagccttcaacctgaggacttcgcgacctactattgtcagcagggcgatacactgccctacacctttgggggaggcacgaaagtggaaattaagcggaccgtggctgccccttctgtcttcatctttcccccttccgacgagcagctcaaaagcggcacagcctctgtggtttgcctgctgaacaatttctatccgcgcgaagctaaggtgcaatggaaggtcgataacgccctccagtccgggaatagccaggagtccgtgaccgaacaggactctaaagatagcacatactccctgagctctacccttacgctgtccaaggctgactacgagaaacacaaggtttatgcctgtgaggtgacacatcaaggactcagctctcccgtcaccaagagctttaacagaggcgaatgc

SEQ ID NO: 38988 - RNA, 1326 nt, synthetic construct
  misc_feature 1..1326: note = derived and/or modified sequence opt5 from Rontalizuab_HeavyChain1
  source 1..1326: mol_type = other RNA
gaggtgcagctggtcgaaagcggcgggggactcgttcaacccggcgggtccctgagactttcttgcgccaccagcggatacacattcacggagtatatcattcactgggtgcggcaggctcctggcaaggggctggaatgggtggcctccatcaacccggactacgatattaccaattataaccagcgctttaaaggaagattcacaatctctctcgacaagagcaaacggaccgcgtacctgcaaaattcccttcgcgctgaggatacagccgtctattactgtgcctcttggattagcgactttttcgattattggggccagggcaccctggtgacagtttccagcgcttctaccaaggggccctccgtgtttcctctcgcccccagctctaaatccacgagcggaggcaccgctgccctggggtgcctggtcaaggactacttccctgaacccgtgacagtttcttggaactccggagcgctcaccagcggcgtgcatacatttcctgccgtcctgcagtcctctgggctttacagcctgtccagcgtggtgaccgtcccgtcttccagcctcggaacgcagacatatatctgtaatgttaaccacaagccctctaataccaaagtggataagaaagtggagcctaagagctgcgacaaaacacatacctgtcccccttgccccgctccggagctgcttggcggcccttccgtcttcctgtttccccctaagcccaaggataccctcatctctagaacacccgaagtgacgtgtgttgtggtcgacgtgagccacgaggatcctgaagttaaattcaactggtacgtggacggggtcgaggtgcataatgccaagaccaaaccgcgggaggaacagtataactccacataccgcgtcgtgagcgttctgaccgtgctgcaccaagattggctcaatggaaaggagtataaatgcaaggtctctaacaaagctctgcccgcccctattgaaaagacaatctccaaggcgaaaggccagcccagagagcctcaggtgtacacccttcccccgagccgggaagagacgaagaatcaggtttctctgacatgtctcgtgaaagggttttatccttccgacattgccgtcgagtgggaaagcaacggacaacccgagaataactacaagaccacccctcccgtgctggactccgatggctctttctttctttacagcaaactgacagtggacaagtcccgctggcagcaggggaacgttttctcttgcagcgtccacgaagctctccataatcactatacccaaaagtccctgagcctgtctcctgga

SEQ ID NO: 38989 - RNA, 648 nt, synthetic construct
  misc_feature 1..648: note = derived and/or modified sequence opt5 from Rontalizuab_LightChain1
  source 1..648: mol_type = other RNA
gacatccagacccaaagcccctcctctctgagcgcctccgtgggcgatagagtcacaattacgtgccgggcttctcagagcgtttccacctctagctactcctatcactggtaccagcagaagcctgggaaagccccgaaggtgctcatcagctatgcgtctaacctggagtccggagtgcccagccgcttctctggctccgggagcggaacagactttacccttacaatttcttccctgcaacctgaagatttcgctacctactattgtcagcatagctggggcatccccagaacatttgggcagggaaccaaagtcgagattaagcggacggtggccgccccttccgttttcatctttcccccttctgacgaacagctcaaaagcggcaccgcttccgtggtctgcctgcttaataacttctacccgcgcgaggccaaggtgcaatggaaggttgataatgctctgcagagcggcaactctcaggaatccgtgacagagcaggacagcaaagattctacctatagcctctcctctacactgaccctgagcaaggccgactacgagaaacacaaggtctacgcgtgtgaagtgacgcatcaagggctctccagccccgtgacaaaatcttttaatagaggagagtgc

SEQ ID NO: 38990 - RNA, 1341 nt, synthetic construct
  misc_feature 1..1341: note = derived and/or modified sequence opt5 from Rontalizumab_HeavyChain1
  source 1..1341: mol_type = other RNA
gaggtgcagctggtcgaaagcggcgggggactcgttcaacccggcgggtccctgagactttcttgcgccaccagcggatacacattcacggagtatatcattcactgggtgcggcaggctcctggcaaggggctggaatgggtggcctccatcaacccggactacgatattaccaattataaccagcgctttaaaggaagattcacaatctctctcgacaagagcaaacggaccgcgtacctgcagatgaactcccttcgcgctgaggatacagccgtctattactgtgcctcttggattagcgactttttcgattattggggccaaggcaccctggtgacagtttccagcgcttctaccaaggggccctccgtgtttcctctcgcccccagctctaaatccacgagcggaggcaccgctgccctggggtgcctggtcaaggactacttccctgaacccgtgacagtttcttggaactccggagcgctcaccagcggcgtgcatacatttcctgccgtcctgcagtcctctgggctttacagcctgtccagcgtggtgaccgtcccgtcttccagcctcggaacgcagacatatatctgtaatgttaatcacaagccctctaataccaaagtggataagaaagtggagcctaagagctgcgacaaaacacatacctgtcccccttgccccgctccggagctgcttggcggcccttccgtcttcctgtttccccctaagcccaaggataccctcatgatctctagaacacccgaagtgacgtgtgttgtggtcgacgtgagccacgaggatcctgaagttaaattcaactggtacgtggacggggtcgaggtgcataatgccaagaccaaaccgcgggaggaacagtataactccacataccgcgtcgtgagcgttctgaccgtgctgcaccaagattggctcaatggaaaggagtataaatgcaaggtctctaacaaagctctgcccgcccctattgaaaagacaatctccaaggcgaaaggccagcccagagagcctcaggtgtacacccttcccccgagccgggaagagatgacgaagaatcaggtttctctgacatgtctcgtgaaagggttttatccttccgacattgccgtcgagtgggaaagcaacggacaacccgagaataactacaagaccacccctcccgtgctggactccgatggctctttctttctttacagcaaactgacagtggacaagtcccgctggcagcaggggaacgttttctcttgcagcgtcatgcacgaagctctccataatcactatacccaaaagtccctgagcctgtctcctggaaaa

SEQ ID NO: 38991 - RNA, 654 nt, synthetic construct
  misc_feature 1..654: note = derived and/or modified sequence opt5 from Rontalizumab_LightChain1
  source 1..654: mol_type = other RNA
gacatccagatgacccaaagcccctcctctctgagcgcctccgtgggcgatagagtcacaattacgtgccgggcttctcagagcgtttccacctctagctactcctatatgcactggtaccagcagaagcctgggaaagccccgaaggtgctcatcagctatgcgtctaacctggagtccggagtgcccagccgcttctctggctccgggagcggaacagactttacccttacaatttcttccctgcaacctgaagatttcgctacctactattgtcagcatagctggggcatccccagaacatttgggcagggaaccaaagtcgagattaagcggacggtggccgccccttccgttttcatctttcccccttctgacgaacagctcaaaagcggcaccgcttccgtggtctgcctgcttaataacttctacccgcgcgaggccaaggtgcaatggaaggttgataatgctctgcagagcggcaactctcaggaatccgtgacagagcaggacagcaaagattctacctatagcctctcctctacactgaccctgagcaaggccgactacgagaaacacaaggtctacgcgtgtgaagtgacgcatcaagggctctccagccccgtgacaaaatcttttaatagaggagagtgc

SEQ ID NO: 38992 - RNA, 1341 nt, synthetic construct
  misc_feature 1..1341: note = derived and/or modified sequence opt5 from Rovalpituzumab_tesirine_HeavyChain1
  source 1..1341: mol_type = other RNA
caagtgcaactggtccagagcggcgccgaggttaagaaacccggggcttccgtgaaggtgtcttgcaaagccagcggatacaccttcacaaactatggcatgaattgggtcagacaggcgcctgggcagggactcgaatggatgggctggatcaacacgtacaccggggagccgacatatgctgacgattttaagggacgggtgaccatgacaaccgacacatccacctctacggcctacatggaactgcgcagccttagatccgatgacaccgccgtttattactgtgctcggattggcgattctagcccctccgactattggggccaagggacactggtgaccgtcagctctgcctccacaaaaggacctagcgtgttccccctcgctccttcttccaagagcacctctggcgggacggccgcgctgggatgccttgttaaggattactttcccgagcctgtgacagtctcctggaatagcggcgccctgacctccggggtgcacacattcccggctgtgctccagtctagcggactgtactccctgagctctgtcgttaccgtgccctccagctctctcggcacccagacatatatctgtaacgtgaatcataaacctagcaacacgaaggtcgacaaaaaggtggaacccaaatcctgcgataagacccacacatgtcctccctgcccggcccctgagctgcttggcgggccctctgtttttctgttccctcccaagcccaaagacaccctcatgattagccgcacacctgaggtgacctgtgtcgtggttgatgtgtcccatgaagacccggaggtcaagtttaattggtacgtggatggagtcgaagtgcacaacgctaaaacgaagcccagagaggagcagtataatagcacataccgggttgtgtctgtcctgaccgtgcttcatcaagactggctgaacggcaaagaatataagtgcaaagtttccaataaggccctccctgcgcccatcgagaagaccattagcaaagccaaggggcagcctcgcgaaccccaggtgtacacactgccgccttctagagacgagctgaccaaaaaccaggtctccctcacatgtctggtgaagggattctatcccagcgatatcgctgtggaatgggagtccaatggccaacctgagaacaattacaaaacgacaccccctgttcttgactctgatgggagctttttcctgtactccaagctcaccgtcgacaagtctcggtggcagcagggaaacgtgtttagctgctccgtgatgcacgaagccctgcacaaccattatacccagaaaagcctttctctgtcccccggc

SEQ ID NO: 38993 - RNA, 642 nt, synthetic construct
  misc_feature 1..642: note = derived and/or modified sequence opt5 from Rovalpituzumab_tesirine_LightChain1
  source 1..642: mol_type = other RNA
gagatcgtgatgacccagagccccgccacactgtccgtctctcctggcgaaagagctacgctcagctgcaaggcctcccaatctgttagcaacgacgtggtgtggtaccagcagaaaccggggcaggcgccccggctgcttatttattacgcttccaatcgctataccggaatccctgccagattctctggcagcgggtccggaacagagtttaccctgacaattagctctctccaatccgaagatttcgccgtctactattgtcagcaggactacaccagcccctggacatttggccaggggaccaagctggagatcaaacggacggtggctgccccttctgttttcatttttcccccttccgatgaacaacttaagagcggaaccgcttctgtggtctgcctgctcaacaatttctatccgcgcgaggccaaagtgcagtggaaggttgacaacgcgctgcagtccggcaatagccaggagtccgtgacagaacaagattctaaggacagcacctactccctgagctctacactcaccctgtccaaagccgattacgagaagcacaaagtctatgcttgtgaagtgacgcatcagggccttagctctcccgtgacaaagagctttaacagaggggagtgc

SEQ ID NO: 38994 - RNA, 1341 nt, synthetic construct
  misc_feature 1..1341: note = derived and/or modified sequence opt5 from Rovelizumab_HeavyChain1
  source 1..1341: mol_type = other RNA
caggtgcaactggtccagagcggcgccgaggttaagaaacccggggcttccgtgaaggtgtcttgcaaagccagcggatacaccttcacaaacaattggatgcagtgggtcagacaggcgcctggccaagggctcgaatggatgggagctatctttccgggcgacgatgagacgcggtatacccagaagttccgcgggaaagccacaattaccgccgacacatccacctctacagcttacatggaactgagctcccttagatctgaggataccgccgtgtattactgtggacggggcggcaagctgcgcccctttgctctcgactattgggggcagggaacgctggttaccgtgagctccgccagcacaaagggcccttctgtcttcccccttgcgccttgctccagaagcacctctgaatccacagccgctctggggtgtctcgtgaaagattactttcccgagcctgttaccgtgagctggaactctggagccctgacgtccggcgtccacacattcccggctgtgctgcagagctccgggctctattctctgagctccgtggtcaccgttccctctagctcccttggaacaaagacctatacctgcaatgtggaccataaacctagcaacacaaaggtggataaacgggtcgagtctaagtacgggcccccttgtcccagctgcccggcccctgaatttctgggcggcccctccgtgttcctctttcctcccaagcccaaagacacgctgatgatctctcgcacccctgaggttacatgtgtggtcgtggatgttagccaagaagacccggaggtgcagttcaattggtacgtcgatggagtggaggtccacaacgcgaagaccaaacccagagaggaacagtttaattccacataccgggtggttagcgtgcttaccgtcctgcatcaggactggctcaacggcaaggaatataaatgcaaggtgtctaataaagggctgccttccagcattgagaagacgatctctaaggccaaaggacaaccccgcgaacctcaggtttacacactgcccccgtcccaggaggagatgaccaagaaccaagtgagcctcacctgtctggtcaaaggcttctatccttccgatattgctgtggaatgggagtctaatgggcagcccgaaaacaattacaagacaacccctcccgtgcttgacagcgacggatcctttttcctgtattctagactcacagttgataaaagccggtggcaggagggcaacgtcttctcctgcagcgtgatgcacgaagccctgcataatcactacacgcagaagtctctttccctgagcctcggcaag

SEQ ID NO: 38995 - RNA, 654 nt, synthetic construct
  misc_feature 1..654: note = derived and/or modified sequence opt5 from Rovelizumab_LightChain1
  source 1..654: mol_type = other RNA
gacatccagatgacccaaagcccctcctctctgagcgcctccgtgggcgatagagtcacaattacgtgccgggcttctgagagcgttgaatcctacgggaacaatttcatgtattggtaccagcagaagcctggaaaagccccgaagctcctgatctatcttgcgtctaacctggagagcggcgtgccctcccgctttagcgggtctggatccggcaccgacttcacactcaccattagctctctgcagcctgaagattttgctacatactattgtcaccaagacaatgaggatccccctaccttcgggcagggaacaaaacttgaaatcaagagaaccgtggccgccccctccgtctttattttccctccgagcgacgagcagctgaaatctggcacggcttccgtggtttgcctcctgaacaatttttacccccgggaggccaaggtgcagtggaaggtcgataacgctctgcaaagcggcaattcccaggaatctgtgaccgagcaggacagcaaagattccacatatagcctctcttccaccctgacacttagcaaggccgactacgaaaaacataaggtttacgcgtgtgaggtgacccaccaggggctgtctagccctgtcacgaaatccttcaaccgcggagagtgc

SEQ ID NO: 38996 - RNA, 1341 nt, synthetic construct
  misc_feature 1..1341: note = derived and/or modified sequence opt5 from Ruplizumab_HeavyChain1
  source 1..1341: mol_type = other RNA
caggtgcaactggtccagagcggcgccgaggttgtgaagcccggggcttccgtgaaactctcttgcaaggccagcggatacatcttcacctcctattacatgtattgggtcaaacaggcgcctggccaggggctggaatggattggagagatcaacccgtctaatggcgacacaaactttaatgaaaagttcaaaagcaaggctacgcttaccgtggataagtccgcctctacagcctacatggagctgagctccctcagaagcgaagacaccgctgtttattactgtacacggtctgatgggcgcaacgacatggattcctggggacaaggcaccctggtgacagtcagctctgcctccaccaaaggccccagcgtgtttcctcttgctccctcttccaagagcacgtccgggggaaccgccgcgctgggctgcctcgttaaagactatttccctgagcccgtgacagtctcttggaatagcggggccctgacctccggagtgcacacatttcctgctgtgctgcagagctctggcctctactccctgagctctgtcgttaccgtgccgagctcctctcttgggacgcagacatacatttgtaacgtgaatcataagcccagcaacaccaaagtcgataagaaggtggagcctaaatcctgcgacaagacacacacctgtcccccttgccccgccccggaactgctcggaggccctagcgttttcctgtttccccctaaacccaaggatacccttatgatctctagaacacccgaggtgacgtgtgtcgtggttgacgtgtcccatgaagatcctgaggtcaaattcaattggtatgtggacggcgtcgaggtgcacaacgctaagaccaaaccgcgggaggaacagtacaatagcacatatcgcgttgtgtctgtcctgaccgtgctccatcaagattggctgaacgggaaggaatacaagtgcaaagtttccaataaggccctgcccgcgcctattgagaaaacaatcagcaaggccaaaggacagcccagagaacctcaggtgtatacccttcccccgtcccgggacgagctgacgaagaaccaggtctctcttacatgtctggtgaagggcttttaccctagcgacatcgctgtggagtgggaatccaatgggcaacccgagaacaactataaaaccacccctcccgttctcgattctgacggcagcttctttctgtactccaagctcacagtcgataaaagccgctggcagcagggaaatgtgttctcttgctccgtgatgcacgaagccctgcacaaccattacacccaaaagagcctctctctgtcccctggg

SEQ ID NO: 38997 - RNA, 654 nt, synthetic construct
  misc_feature 1..654: note = derived and/or modified sequence opt5 from Ruplizumab_LightChain1
  source 1..654: mol_type = other RNA
gacatcgtgctgacccagagccccgccacactctccgtctctcctggcgagagagctacgattagctgccgggcctcccaacgcgtttctagctccacctactcttatatgcactggtaccagcagaagccggggcagccccctaaactgcttatcaagtatgcgagcaacctggaatccggagtgcccgctagattcagcggctctgggtccggaacagattttaccctcacaattagctctgtggagcctgaagacttcgccacctactattgtcaacattcctgggagattccccctacatttggcgggggaaccaaactggaaatcaagcggacggtcgccgctccgagcgtgttcatctttcccccttctgatgagcagcttaaatccggcaccgccagcgttgtgtgcctgctcaataacttctacccccgcgaggctaaggtccagtggaaggtggacaatgccctgcagtccggcaactctcaagaaagcgttacagagcaggattccaaagacagcacctattctctgtccagcacactcaccctgtctaaggcggattacgaaaaacacaaggtgtacgcctgtgaggtcacgcatcaggggcttagctcccctgtgacaaaatcttttaatagaggagagtgc

SEQ ID NO: 38998 - RNA, 1353 nt, synthetic construct
  misc_feature 1..1353: note = derived and/or modified sequence opt5 from Sacituzumab_govitecan_HeavyChain1
  source 1..1353: mol_type = other RNA
caggtgcaactgcagcagagcggctccgagctcaagaaacccggggcctctgtcaaggttagctgcaaggcttccggatacaccttcacaaactatggcatgaattgggtgaaacaggcccctgggcaaggactgaaatggatgggctggatcaacacgtacaccggggaaccgacatataccgacgattttaagggaagattcgcgttttctcttgacacaagcgtgtccaccgcttacctgcagatttctagcctcaaggccgatgacacagccgtctatttctgtgctcggggcggctttgggtccagctactggtatttcgatgtgtggggacagggctctctggttaccgtgtccagcgcctctacgaaagggccctccgtctttcctcttgctcccagctctaagtccaccagcggaggcacagccgcgctggggtgcctcgtgaaagactacttccctgagcccgttaccgtgtcctggaactctggagccctgacaagcggcgtccacacctttcctgctgtgctgcagtccagcggcctctactctctgtccagcgtggtcacggttccgtctagctcccttgggacacaaacctatatctgtaatgtgaatcataagccctctaacacaaaagtggataagcgcgtcgaacctaagagctgcgacaaaacccacacctgtcccccttgccccgccccggagctgctcggaggcccttccgtgttcctgtttccccctaagcccaaagatacacttatgattagcagaacgcccgaagttacctgtgtggtcgtggacgtttctcatgaggatcctgaggtgaagttcaattggtacgtcgacggggtggaagtccacaacgctaaaacaaagccgcgggaggaacagtataattccacctaccgcgtggttagcgtgctgacagtcctccatcaggattggctgaacggaaaagagtataagtgcaaggtgtctaataaagccctgcccgcgcctatcgagaagaccatttccaaagccaagggccagcccagagaacctcaagtttacacgctgcccccgagccgggaggaaatgaccaaaaaccaggtgtccctcacatgtcttgtcaaggggttttatccttctgacatcgctgtggagtgggaaagcaatggacagcccgagaacaattacaagaccacacctcccgtgctggactccgatggctctttcttcctctacagcaaactgaccgttgacaagtcccgctggcaacagggcaacgtctttagctgctctgtgatgcacgaggcccttcacaaccattatacacagaaatccctgagcctctctcctgggaag

SEQ ID NO: 38999 - RNA, 642 nt, synthetic construct
  misc_feature 1..642: note = derived and/or modified sequence opt5 from Sacituzumab_govitecan_LightChain1
  source 1..642: mol_type = other RNA
gacatccagctgacgcaaagcccctcctctctcagcgcctccgtgggcgatagagtctctattacatgcaaggctagccaggacgtttccatcgccgtggcgtggtaccagcagaaacctgggaaggctccgaaactgcttatttattctgccagctaccggtatacgggagtgcccgatcgcttctccggcagcgggtctggaaccgactttacactgaccatctccagcctccaacctgaggatttcgccgtctactattgtcagcagcactacattacacccctgacctttggcgctgggacaaaggtggaaatcaaaagaaccgttgccgctccttctgtgttcatctttcccccttccgacgagcagcttaagagcggaacggcctctgtcgtgtgcctgctcaacaatttctatccgcgggaagcgaaggttcaatggaaagtggataacgccctgcagtccggcaatagccaggagtccgtcaccgaacaggactctaaggatagcacatactccctgagctctaccctcacactgtccaaagctgactacgagaagcataaagtgtatgcctgtgaggtgacccaccaaggccttagctctcccgtcaccaagagctttaaccgcggggaatgc

SEQ ID NO: 39000 - RNA, 1326 nt, synthetic construct
  misc_feature 1..1326: note = derived and/or modified sequence opt5 from Samalizumab_HeavyChain1
  source 1..1326: mol_type = other RNA
caggtgcaactgcagcagagcggctccgagctcaagaaacccggggcctctgtcaagatcagctgcaaggcttccggatactctttcaccgactatattatcctgtgggttagacagaaccctggcaaagggcttgaatggattggacacatcgatccgtactatggcagctccaattacaacctgaaatttaaggggcgggtgacaattacggccgaccaatctaccacaaccgcgtatatggagctcagctccctgcgcagcgaagatacagctgtgtactattgtggaagatctaagcgggactacttcgattactggggccagggcaccacacttaccgtctccagcgcctctacgaaagggccctccgtgtttcctctggccccctgcagccgctctacctccgagagcacagctgccctcggatgtctggttaaggactatttccctgaacccgtgaccgtctcctggaactctggcgctctgacaagcggggtgcatacctttcctgccgttctccagtccagcggactgtactctctttccagcgtggtcacggtgccgtctagcaatttcggcacacagacctatacatgcaatgtggatcacaaaccctccaacaccaaggtcgacaaaaccgttgagagaaagtgttgcgtggagtgtcctccctgccctgcgcccccggtggccgggccttctgtctttctgtttccccctaagcccaaagatacactcatgatcagccggacgcccgaagtgacctgtgttgtggtcgacgtgtcccaagaggatcctgaagttcagttcaattggtacgtggacggagtcgaggtgcataacgctaagacaaaaccgcgcgaggaacagttcaatagcacctatagagtcgtgtctgttctgacagtgcttcaccaggattggctgaacggcaaggagtacaaatgcaaggtctccaataaaggcctccccagctctatcgaaaagaccatttccaaggccaaagggcaacctcgggagccccaggtgtatacgctgcctcccagccaggaagagatgacaaagaaccaagtttccctgacctgtctcgtgaaaggattttacccgtctgacatcgctgtcgagtgggaaagcaatggccagcctgagaacaattacaagaccacaccccctgtgctggactccgatgggtctttctttctttatagccgcctgaccgtggacaaatccagatggcaggaaggaaacgttttcagctgctctgtcatgcatgaggccctccacaaccactacacacagaagtccctgagcctttctctgggc

SEQ ID NO: 39001 - RNA, 642 nt, synthetic construct
  misc_feature 1..642: note = derived and/or modified sequence opt5 from Samalizumab_LightChain1
  source 1..642: mol_type = other RNA
gacatccagatgacccaaagcccctcctctctgagcgcctccattggcgatagagtgacaatcacgtgcaaggcttctcaggacattaacagctacctctcctggttccagcagaaacctgggaaggccccgaaactgcttatctatcgggcgaatcgcctggtcgatggagttccctctagatttagcggctccgggagcggaaccgactacacactcaccatttcttccctgcaacctgaggatttcgctgtgtattactgtcttcagtatgacgaatttccctacacattcggcgggggaaccaagctggagatcaaacggacagtggccgcccctagcgtctttatctttcccccttctgatgaacagctcaagtccggcaccgctagcgtggtttgcctgctgaacaatttctatccgcgcgaggccaaggtgcagtggaaagtcgacaacgctctccaatctggcaattcccaggaaagcgtgacggagcaggattccaaggactctacctacagcctgtccagcacacttaccctgtctaaagccgattacgagaagcacaaagtttatgcgtgtgaagtgacacatcaggggctctccagccccgtcaccaagtctttcaacagaggagagtgc

SEQ ID NO: 39002 - RNA, 1338 nt, synthetic construct
  misc_feature 1..1338: note = derived and/or modified sequence opt5 from Sarilumab_HeavyChain1
  source 1..1338: mol_type = other RNA
gaggtgcagctggtcgaaagcggcgggggactcgttcaacccggcagatccctgcggctttcttgcgccgctagccgcttcacctttgacgattacgccatgcactgggtgagacaggcgcctgggaagggactggagtgggtgtccggcatctcttggaacagcgggcggattggatatgctgactccgtcaaaggccgcttcacaatctctagagataatgccgaaaacagcctctttctgcagatgaatggccttcgggccgaggacacggctctgtactattgtgccaaggggcgcgattccttcgacatttggggacagggcaccatggtgacagttagctctgcttccaccaaagggccgagcgtgtttcccctcgccccttcttccaagagcacatctggaggcaccgcggccctggggtgcctggtcaaagattacttccccgaacctgtgacagtttcctggaacagcggagctctcacctccggcgtgcatacgtttcccgccgtcctgcaatctagcggcctttattccctgagctctgtggtgaccgtcccttccagctctctcgggacacagacctacatctgtaatgttaaccacaagccgagcaatacaaaggtggacaaaaaggtggagcccaaatcctgcgataagacccatacgtgtcctccctgccctgctcccgagctgcttggaggcccgtctgtcttcctgtttcctcccaaacctaaggacacactcatgattagcagaacccccgaagtgacatgtgttgtggtcgatgtgtcccacgaggaccccgaagttaagttcaactggtatgtggatggggtcgaggtgcataatgccaaaaccaagcctcgggaggaacagtacaacagcacctaccgcgtcgtgtctgttctgacagtgctgcaccaggactggctcaatggaaaagagtataagtgcaaagtctccaacaaggcgctgccggcccccatcgaaaagacgatcagcaaggctaagggccaacctagagagccccaggtgtacacccttcctccctctcgggacgaactgaccaaaaatcaggtttccctcacctgtctggtgaaggggttttatccgagcgatattgccgtcgagtgggagtccaacggacagcctgaaaataactacaaaacaacaccccctgtgcttgactctgatggcagcttctttctgtattccaagctcacggtggacaaatctcgctggcaacagggcaacgttttcagctgctccgtcatgcacgaggctctgcataatcactacacacagaaaagcctgtctctctcccccgggaag

SEQ ID NO: 39003 - RNA, 642 nt, synthetic construct
  misc_feature 1..642: note = derived and/or modified sequence opt5 from Sarilumab_LightChain1
  source 1..642: mol_type = other RNA
gacatccagatgacccaaagcccctcctctgtgagcgcctccgtcggcgatagagttacaattacgtgccgggcttctcaggggatcagctcctggctggcctggtaccagcagaagcctggaaaagcgccgaagctcctgatttatggcgcttctagccttgagtccggggtgcccagccgcttctctggatccggcagcgggaccgactttacactgaccatctcttccctccaacctgaagatttcgccagctactattgtcagcaggccaactcttttccctacacattcggacagggcaccaaactggagattaagagaacagtggctgccccttccgtctttatctttccccctagcgacgaacaacttaaatccggcaccgcttctgtggtttgcctgctcaataacttctatccgcgggaggccaaggtgcagtggaaggtcgataatgcgctgcagagcgggaactcccaggaaagcgtgacggagcaagactctaaagattccacctacagcctgtctagcacactcaccctgtccaaggccgactatgagaaacacaaggtttacgcttgtgaagtgacacatcagggactttctagccccgtcaccaaatccttcaatcgcggcgagtgc

SEQ ID NO: 39004 - RNA, 1296 nt, synthetic construct
  misc_feature 1..1296: note = derived and/or modified sequence opt5 from Satumomab_pendetide_HeavyChain
  source 1..1296: mol_type = other RNA
caggtgcaactgcagcagagcgacgccgagctcgtcaagcccggcgcttccgttaaaatctcttgcaaggccagcgggtacaccttcacagatcacgcgattcattgggctaaacagaagcctgaacaaggactggagtggatcggctatatttccccggggaacgacgatatcaaatacaatgaaaagtttaagggaaaagccacgcttaccgccgacaagtctagctccacagcttatatgcagctgaactctctcaccagcgaggattccgccgtgtacttctgtaaaagaagctattacggccactgggggcagggaacaaccctgacagtgtcttccgctagcaccaagggcccctctgtctttcctcttgccccctgctcccggagcacgtctgaatccaccgcggccctgggctgtctcgtgaaagactatttccctgagcccgttacagtgagctggaactccggggctctgacctctggagtccatacatttcctgccgtgctgcagagctccggcctctacagcctgtcttccgttgtgaccgtcccgagctctagccttgggacgaagacatatacctgcaatgtggatcacaagccctccaatacaaaagtggacaagcgcgtctgtcctccctgcaaatgtcctgctcccaacctgctcggaggcccgtctgttttcatttttcctcccaagatcaaagatgtgctgatgatcagcctttcccctattgtgacctgcgtcgtggttgacgtgagcgaggatgaccccgatgtccaaatctcttggttcgtgaataacgttgaagtgcataccgcccagacacagacgcacagagaggactacaattccaccctgcgggtcgtgagcgcgctccccattcagcaccaagactggatgtctgggaaggaatttaaatgtaaggtcaacaataaggatctgcctgccccgatcgagcgcacaatttccaaacccaagggaagcgtgagagctcctcaggtttacgtgctgccccctcccgaggaagagatgaccaaaaagcaggtcacactgacctgcatggtgacggacttcatgccggaagatatctatgttgagtggacaaacaatggcaaaaccgaactcaactacaagaataccgagcctgtgcttgactccgatggctcttattttatgtacagcaagctgcgggtcgagaaaaagaactgggtggaacgcaactcctattcttgtagcgtggttcatgaggggctccacaatcatcacacaaccaaatccttcagcaga

SEQ ID NO: 39005 - RNA, 630 nt, synthetic construct
  misc_feature 1..630: note = derived and/or modified sequence opt5 from Satumomab_pendetide_LightChain
  source 1..630: mol_type = other RNA
gacatccagatgacccaaagccccgcctccctgtctgtgagcgtcggcgagacagttacgattacctgcagagcttccgaaaacatctactctaatctcgcctggtatcagcagaagcaggggaaaagccctcaactgcttgtgtacgcggctacaaacctggccgatggagtgccgtcccggttctctggcagcgggtccggaacccagtatagcctcaagattaattctctgcagtccgaggactttggcagctactattgtcagcacttctgggggacaccctacacctttggaggcggcacacgccttgaaatcaaaagagccgatgctgcccctaccgtcttcatttttcccccttctgacgagcaactgaagtccgggacggctagcgtggtttgcctcctgaacaatttctatccccgggaagccaaagtgcagtggaaggtcgataacgcgctgcagtctggaaattcccaggagagcgtgaccgagcaagactccaaggattctacatacagcctctccagcaccctgacactttctaaagccgactacgaaaagcataaagtttatgcttgtgaggtgacccaccagggcctgtccagccctgtcacgaagtcttttaac

SEQ ID NO: 39006 - RNA, 1371 nt, synthetic construct
  misc_feature 1..1371: note = derived and/or modified sequence opt5 from Secukinumab_HeavyChain1
  source 1..1371: mol_type = other RNA
gaggtgcagctggtcgaaagcggcgggggactcgttcaacccggcgggtccctgagactttcttgcgccgctagcggattcaccttttccaactactggatgaattgggtgcggcaggcccctggcaaggggctggagtgggtggcggctatcaaccaggacggatctgaaaaatattacgtcggcagcgtgaagggccgcttcacaatttccagagataatgccaaaaactctctctatctgcagatgaatagccttcgggttgaggacacggccgtgtactattgtgtccgcgattactatgacatcctgaccgattactacattcactattggtactttgacctctgggggagaggaacactggtgaccgtttccagcgcttctacaaagggcccgtccgtgttccccctggcccctagctctaaatccaccagcgggggaacagctgccctcggctgcctggtcaaggattattttcccgaacctgtgaccgtgtcttggaactccggggcgcttacgagcggagtccataccttccccgccgttctgcaatcctctggcctctacagcctgtccagcgtggtgacagtcccttcttccagccttggcacccagacatatatctgtaatgtgaaccacaagccgtctaataccaaagttgacaagcgggtggagcccaaaagctgcgataagacgcatacatgtcctccctgccctgctcccgagctgctcgggggaccgtccgtctttctgttccctcccaaacctaaggacaccctgatgatttctcgcacacccgaagtgacctgtgttgtggtcgatgtgagccacgaggaccccgaagtcaagtttaactggtacgtggatggcgttgaggtgcataatgccaaaaccaagcctagagaggaacagtataactccacataccgggtcgtgagcgttctcacggtgctgcaccaggactggcttaatgggaaagagtacaagtgcaaagtctctaacaaggctctgccggcccccatcgagaaaaccatctccaaggcgaagggacaacctcgcgaaccccaggtgtatacactccctcccagcagagaagagatgaccaaaaatcaggtgtctctgacatgtcttgttaagggcttctacccgtccgacattgccgtcgagtgggaaagcaacgggcagcctgagaacaattataaaaccacgccccctgtgctggattccgacggatctttctttctctacagcaagctgacagtggataaatcccggtggcaacagggcaacgtcttttcttgcagcgtgatgcacgaagctctgcataatcactatacccagaagtccctcagcctgtctcccggcaag

SEQ ID NO: 39007 - RNA, 645 nt, synthetic construct
  misc_feature 1..645: note = derived and/or modified sequence opt5 from Secukinumab_LightChain1
  source 1..645: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttccccttgcacctttggccagggcacaagactcgagatcaaacggaccgtggctgcccccagcgtgttcatttttcctccgtctgatgaacagctgaagtccgggacggctagcgtcgtgtgtctgctcaacaatttctacccccgcgaggccaaagttcaatggaaggtggacaacgcgctgcagtccggaaattctcaggagagcgtcaccgaacaggattccaaagacagcacatattctctttccagcaccctgacactctctaaggccgattacgagaagcacaaagtgtacgcttgcgaagttacccatcaaggcctgagctcccctgtgacgaagtcttttaacagaggggagtgt

SEQ ID NO: 39008 - RNA, 1335 nt, synthetic construct
  misc_feature 1..1335: note = derived and/or modified sequence opt5 from Seribantumab_HeavyChain1
  source 1..1335: mol_type = other RNA
gaggtgcagctgctcgaaagcggcgggggactggtccaacccggcgggtcccttagactgtcttgcgccgctagcggattcaccttttcccactacgttatggcctgggtgcggcaggcgcctggcaaggggctcgagtgggtgtctagcatctcctctagcggaggctggacactgtatgctgactccgtcaaaggccgcttcacgattagcagagataactctaagaataccctttacctgcagatgaactccctccgggccgaagacacagccgtgtattactgtacccgcgggctgaaaatggctacaatctttgattattggggacagggcaccctggttacagtgagctctgcctccaccaaggggccgagcgtcttccccctcgctccttgctctagatccacgagcgagtccaccgccgcgctgggatgtcttgtgaaagactactttcccgaacctgttacagtgtcttggaatagcggcgccctgacctccggggtccatacattccccgctgtgctccaaagctctggactgtattcccttagctctgtggtcaccgttcctagctccaactttggcacgcagacatacacatgcaatgtggatcacaagccgtctaacacaaaggtggacaaaaccgtcgagcggaagtgttgcgtggagtgtcccccttgccccgcccctcccgttgctggcccgagcgtgttcctgtttcctcccaaacctaaggataccctcatgatttcccgcacacccgaagtcacgtgtgtggttgtggacgtcagccatgaggatcccgaagtgcagttcaattggtacgtcgacggggtggaggttcacaacgccaaaaccaagcctagagaggaacagtttaattctacattccgggtggtctccgtgctgaccgttgtgcatcaagattggctgaacggaaaggagtataaatgcaaggtcagcaataaaggcctcccggcgcccatcgaaaagacaatttctaaaaccaaggggcagcctcgcgagccccaggtgtacacgctgcctccctccagagaagagatgaccaaaaaccaggtgagccttacctgtctggttaagggattttatccgtccgacatcgccgtcgagtgggaatctaatggccaacctgagaacaattacaagaccacaccccctatgctcgatagcgacgggtccttcttcctgtattctaaacttaccgtggacaagagccggtggcagcagggaaacgtgttttcctgcagcgtcatgcacgaagctctgcacaaccattacacacaaaaatctctctccctgagccccggcaag

SEQ ID NO: 39009 - RNA, 651 nt, synthetic construct
  misc_feature 1..651: note = derived and/or modified sequence opt5 from Seribantumab_LightChain1
  source 1..651: mol_type = other RNA
cagagcgccctgacccaacccgcttccgtgtctggcagccctgggcagtccatcacaatttcttgcacgggaaccagctccgacgtcggctcttacaacgttgtgagctggtatcagcagcacccggggaaggcccccaaactcatcatttacgaggtgtcccaaagacctagcggagtctctaatcggttctccggcagcaagtctgggaacacagcgtccctgaccatcagcggacttcagacagaagatgaggctgactattactgttgctcttatgccggctccagcatttttgtgatcttcggcgggggaaccaaagttacagtgctgggccagcccaaggccgctccttccgtcaccctctttcccccttctagcgaagaactgcaggccaataaagctacgcttgtgtgtctggtttccgatttctacccgggggccgtgaccgtcgcgtggaaggccgacggaagccccgtgaaggtgggcgtcgaaacaaccaaaccttctaagcaatccaacaataaatatgctgccagctcttacctcagcctgacacccgagcagtggaagtcccatcgctcttacagctgcagagttacccacgaggggtccacggtggagaaaacagtggctcctgccgagtgtagc

SEQ ID NO: 39010 - RNA, 1353 nt, synthetic construct
  misc_feature 1..1353: note = derived and/or modified sequence opt5 from Setoxaximab_HeavyChain1
  source 1..1353: mol_type = other RNA
gaggtgcagctgcaacagcccggccctgaactcgagaagccgggggccagcgtcaaactgtcctgcaaggcttctggatacagcttcaccgactataacatgaattgggttaaacagaacaatggcgaatcccttgagtggatcgggaagattgatccctactatggaggcccttcttacaaccagaaatttaaggacaaggccacactgacggtggataaaagctcctctaccgcgtatatgcaactcaagagcctgacatccgaagacagcgctgtgtactattgtaccagagggggaaatcgggattggtacttcgacgtctggggcgccggcacaacccttacagtgtctgccgagtttgcttccaccaaagggcccagcgttttccctctggccccctcttccaagagcacgtctggaggcaccgctgccctcgggtgcctggtgaaagattactttcctgagccggtcacagtgtcctggaacagcggagcgctgacctccggcgttcacacattccccgccgtgctccagtctagcgggctgtattcccttagctctgtcgtgaccgtgccttccagctctctgggaacgcagacatacatctgtaatgtcaaccataagcccagcaataccaaggttgacaaaaaggtggaacctaaatcctgcgataagacacacacctgtcccccgtgccctgctcccgagctcctgggcggcccttctgtgtttcttttccctcccaaacccaaggacaccctgatgattagccgcacaccggaagtcacgtgtgtggttgtggatgtctcccatgaggaccccgaggtgaaatttaactggtatgttgatggggtggaagtccacaatgccaagaccaagcctagagaggaacagtacaacagcacatatcgggtggtctctgtgctcaccgttctgcatcaagactggctgaatggaaaagagtacaagtgcaaagtgtccaacaaggctctccccgcccctatcgagaaaacaattagcaaggcgaagggccagccccgcgaaccgcaggtctataccctgcctccctctagagacgagcttacgaaaaatcaggtgtccctgacatgtctcgttaaggggttctaccctagcgatatcgccgtggaatgggagtccaacggacaacccgaaaacaattacaaaaccacccctcccgtcctggactctgatggcagctttttcctttattccaagctgacagtggacaaatctcggtggcagcaggggaacgtgtttagctgctccgttatgcacgaggctctccacaatcattacacccaaaagagcctgtctctgtccccgggaaag

SEQ ID NO: 39011 - RNA, 660 nt, synthetic construct
  misc_feature 1..660: note = derived and/or modified sequence opt5 from Setoxaximab_LightChain1
  source 1..660: mol_type = other RNA
gacatcgtgctgagccagtccccctctagcctcgtcgtttccgtgggcgagaaagtgaccatgtcttgcaaaagctcccaatctctgctttacagcagaaaccagaagaattatctggcctggtaccagcagaaacctgggcaatccccgaaggtcctcatttattgggctagcacacgggaatctggagtgcccgatcgcctgacgggctccgggagcggaaccgacttcacacttaccatctcttccgttaaagccgaggatctggcggtgtactattgtcagcagtactatagctaccctctcacatttggcgctgggaccaagctggaactgaagagaacagtcgccgccccctctgtgttcatttttcctccctccgacgagcagctcaaaagcggaaccgcttccgttgtgtgcctgcttaacaatttctaccctcgggaagccaaggtccaatggaaagtggataacgctctgcagtctggcaatagccaggagtccgtgacggagcaggacagcaaggattctacctattccctcagctctacactgacccttagcaaagccgactacgaaaagcacaaggtctatgcgtgtgaggttacacatcaaggcctgtcctctccggtgaccaagagctttaaccgcggggaatgc

SEQ ID NO: 39012 - RNA, 1338 nt, synthetic construct
  misc_feature 1..1338: note = derived and/or modified sequence opt5 from Sifalimumab_HeavyChain1
  source 1..1338: mol_type = other RNA
caggtgcaactggtccagagcggcgccgaggttaagaaacccggggcttccgtgaaggtgtcttgcaaagccagcggatacaccttcacatcctattctatcagctgggtcagacaggcgcctggccaggggctcgaatggatgggatggatttccgtgtacaacggcaatacgaactatgctcaaaagtttcaggggcgggttaccatgacaaccgacacatctaccagcacagcctacctggagcttcgctccctgagaagcgatgacaccgccgtgtattactgtgctcgggatccgatcgccgctggatattggggccagggcacgctcgtcaccgtgtcttccgccagcacaaaagggccctctgttttccctctggcgccctccagcaagtctacctccggaggcacagccgctcttgggtgcctggtgaaggactactttcctgaacccgtcaccgtgagctggaactccggagccctcacgtctggcgtgcacacattccctgctgtcctgcagagctccgggctgtacagcctctcttccgttgtgaccgtgccgagctctagcctgggaacacaaacctatatttgtaatgtcaatcataaaccctccaacaccaaggtggataaaaaggttgagcctaaatcttgcgacaagacacacacgtgtcccccttgccccgccccggaacttctgggcggccctagcgtgtttctctttccccctaagcccaaagataccctgatgatctcccgcacacccgaggtcacctgtgtggttgtggacgtcagccatgaggatcctgaagtgaagttcaattggtacgtcgacggggtggaggttcacaacgcgaaaacaaagccgagagaggaacagtataattctacctaccgggtggtctccgtgcttacggttctgcatcaggattggctcaacggaaaagagtataagtgcaaagtgagcaataaggccctgcccgctcctattgaaaagacaatctctaaagccaagggccagccccgcgagcctcaagtctacaccctgcccccgtccagagaagagatgaccaaaaaccaggtgagcctcacatgtctggtgaaggggttctatccttccgacatcgctgttgaatgggagtctaatggacagcccgagaacaattacaaaaccacacctcccgtccttgatagcgacggctcctttttcctgtactctaagctcacggtggacaagagccggtggcaacaggggaacgtgttttcctgcagcgtcatgcacgaagccctgcacaaccattatacccagaaatctctttccctgagccctggaaag

SEQ ID NO: 39013 - RNA, 645 nt, synthetic construct
  misc_feature 1..645: note = derived and/or modified sequence opt5 from Sifalimumab_LightChain1
  source 1..645: mol_type = other RNA
gagatcgtgctgacccagagccccggcacactctccctgtctcctggggaaagagccacgcttagctgccgggcttcccaatctgtcagctccacctacctggcctggtatcagcagaagccgggacaggcgccccgcctcctgatttacggcgcttctagcagagccacagggatccctgaccggttctccggaagcggctctgggaccgattttacacttaccatttcccgcctggagcccgaagacttcgccgtttattactgtcaacagtatggaagctctcctagaacatttggccagggcaccaaagtggagatcaagcggacggtggctgccccctccgtcttcatttttcctccgagcgatgaacagctcaaatctgggaccgcttccgtggtttgcctgctgaacaatttctacccccgcgaggccaaggtgcaatggaaagtcgacaacgcgctccagagcggaaattcccaggagtctgtgacagaacaggatagcaaggactccacctatagcctgtcttccacacttaccctgagcaaggccgattacgagaaacacaaggtttacgcttgtgaagtgacgcatcaaggcctctctagccctgtcacaaaatcctttaacagaggggagtgc

SEQ ID NO: 39014 - RNA, 1347 nt, synthetic construct
  misc_feature 1..1347: note = derived and/or modified sequence opt5 from Siltuximab_HeavyChain1
  source 1..1347: mol_type = other RNA
gaggtgcagctggtcgaaagcggcgggaagctcctgaaacccggaggctcccttaagctgtcttgcgccgctagcgggttcaccttttcctctttcgccatgagctggtttagacaatcccctgagaaacggctcgaatgggttgcggagatctctagcggaggctcctacacatattacccggacacggtgaccgggcgcttcacaattagcagagataacgctaagaataccctgtatcttgaaatgtcttccctgcggagcgaggacacagccatgtactattgtgcccgcggactctggggctactatgctctggattactggggccaggggacctctgtgacagtctccagcgcctctaccaaaggaccctccgtgtttcctctggctcccagctccaagtctacgagcggcgggaccgccgcgctcggatgcctggttaaggactacttccctgagcccgtgacagtctcctggaacagcggcgcccttacctctggggtgcacacatttcctgctgttctgcagtccagcggactctattctctgagctccgtggtcaccgtgccgtctagctcccttggcacgcagacatacatctgtaatgtgaaccataaacccagcaataccaaggtcgataaaaaggttgaacctaaatcttgcgacaagacacacacctgtcccccttgccccgccccggagctgctcggcgggccttccgtgttcctgtttccccctaagcccaaagataccctgatgattagcagaacacccgaagtgacgtgtgtcgtggttgacgtgtctcatgaggatcctgaggtcaagttcaactggtatgtggacggagttgaagtgcacaatgctaaaaccaagccgcgggaggaacaatacaactccacatatcgcgtcgtgagcgtcctcaccgtgctgcatcaggattggcttaatggcaaagagtacaagtgcaaagtttccaacaaggccctgcccgcgcctatcgaaaagacaatttctaaagccaaggggcagcccagagagcctcaggtgtataccctgcccccgagccgggacgagctcacgaaaaatcaagtctcccttacatgtctggtgaagggattttacccttctgatatcgctgttgaatgggagagcaacggccagcccgaaaataactacaaaaccacccctcccgtgctcgactccgacgggagcttctttctgtattctaagctgacagtcgataagtcccgctggcagcagggaaatgtgttcagctgctctgtgatgcacgaggccctccacaaccattacacccaaaaatccctgagcctttctcctggcaag

SEQ ID NO: 39015 - RNA, 639 nt, synthetic construct
  misc_feature 1..639: note = derived and/or modified sequence opt5 from Siltuximab_LightChain1
  source 1..639: mol_type = other RNA
cagatcgtgctgattcaaagccccgccatcatgtccgcttctcctggcgagaaggtcaccatgacatgcagcgcctcctctagcgtttcctacatgtattggtaccagcagaaaccggggtctagccccagactcctgatttatgacacgtccaaccttgcgagcggagtgcctgtgcggttctctggctccgggagcggaacctcttactccctgacaatcagccgcatggaagctgaggatgccgccacctattactgtcagcaatggtctggctatccctacacatttgggggaggcaccaagctcgaaattaaaagaacagtcgctgccccttccgtgttcatctttccccctagcgacgagcagctgaagtccggcaccgcttctgttgtgtgccttctgaataacttctacccgcgggaagccaaagtccagtggaaggtggataatgcgctccagagcgggaactcccaagagagcgttacggagcaggactctaaggattccacctatagcctgtctagcacactgaccctctccaaagccgactacgaaaagcacaaagtgtatgcttgtgaggtcacacatcagggactgtctagccccgtgaccaagtcctttaatcgcggcgaatgc

SEQ ID NO: 39016 - RNA, 1329 nt, synthetic construct
  misc_feature 1..1329: note = derived and/or modified sequence opt5 from Simtuzumab_HeavyChain1
  source 1..1329: mol_type = other RNA
caggtgcaactggtccagagcggcgccgaggttaagaaacccggggcttccgtgaaggtgtcttgcaaagccagcggatacgcgttcacctattacctcatcgaatgggtcagacaggctcctggccaggggctggagtggattggagtgatcaacccgggctccgggggaacaaattataacgaaaagtttaaaggccgggccacgattaccgccgacaagtctacaagcaccgcttacatggagctttcctctctgcgcagcgaagatacagccgtttatttctgtgctagaaattggatgaactttgactactggggccaagggaccacagtgaccgtctccagcgcctctacgaagggaccctccgtgttccctctcgcgccctgcagccggtctacctccgagagcacagccgctctgggctgtcttgttaaagattattttcctgagcccgtgaccgtctcttggaactccggggccctgacaagcggagtgcacaccttccctgctgtgctccagtcctctggcctgtacagcctgtccagcgtcgttacggtgccgtcttccagcctcgggacaaagacctacacatgcaatgtggaccataaaccctctaataccaaggtcgataaacgcgtggaaagcaagtatggacctccctgtcctccctgcccggcccctgagtttctgggcggcccctccgttttcctttttcctcccaagcccaaagacaccctgatgatctctagaacacctgaagtgacgtgtgtcgtggttgatgtgagccaggaggacccggaggtccagttcaactggtacgtggatggggtcgaagtgcacaatgcgaagaccaaaccccgggaggaacaatttaactccacatatcgcgttgtgagcgtcctcaccgtgctgcatcaggactggcttaatggaaaggagtacaaatgcaaggtttctaacaaaggcctgccttccagcattgaaaagacaatctctaaggccaaagggcagcccagagagcctcaggtgtataccctgcccccgtcccaagaggaaatgacgaagaatcaggtcagcctcacatgtctggtgaaaggattctacccttccgatatcgctgtggagtgggaatctaacggccagcccgagaataactataagaccacccctcccgttctcgacagcgatgggtcctttttcctgtactctcggcttacagtcgacaaaagccgctggcaagaaggaaacgtgttctcctgcagcgtgatgcacgaggccctgcataatcactacacccagaagtctctctccctgagccttggcaag

SEQ ID NO: 39017 - RNA, 657 nt, synthetic construct
  misc_feature 1..657: note = derived and/or modified sequence opt5 from Simtuzumab_LightChain1
  source 1..657: mol_type = other RNA
gacatcgtgatgacccagacacccctgagcctctccgtcacgcctggccaaccggcctctattagctgcagatcctctaaaagcctgcttcactccaacgggaatacctacctgtattggttcctccagaaacccggacagtctcctcagtttctgatctaccggatgagcaaccttgcttccggcgttcccgatcgcttcagcgggtctggatccggcacagactttaccctgaagattagcagagtggaggccgaagatgtgggggtctattactgtatgcaacatctcgagtatccttacacattcggaggcggcaccaaagtggaaatcaagcggacagttgcggctccctctgtgtttattttccctccgtccgacgagcagctgaaaagcgggaccgcctctgtcgtgtgcctgctcaataacttttatccccgcgaagccaaggttcagtggaaggtggataatgctctgcagtccggaaacagccaagagtccgtcacggagcaggactctaaagatagcacctactcccttagctctacactgaccctctccaaggccgactacgaaaaacacaaggtgtatgcttgtgaggtgacacatcagggcctgagctctcctgtcaccaagagcttcaatagaggggaatgc

SEQ ID NO: 39018 - RNA, 1347 nt, synthetic construct
  misc_feature 1..1347: note = derived and/or modified sequence opt5 from Sirukumab_HeavyChain1
  source 1..1347: mol_type = other RNA
gaggtgcagctggtcgaaagcggcgggggactcgttcaacccggcgggtccctgagactttcttgcgccgctagcggattcaccttttcccctttcgccatgtcttgggtgcggcaggcgccgggcaaggggctggagtgggtggctaaaatcagccccggaggctcctggacatactattctgacacggtcaccggccgctttacaattagcagagataacgccaaaaattccctctacctgcagatgaacagccttcgggccgaagacaccgctgtgtattactgtgcccgccagctgtgggggtattacgctctcgatatctggggacaaggcacaaccgttacagtgtcttccgccagcaccaaggggccttctgtcttccccctggcgccttccagcaagtctacgtccggaggcaccgccgctctggggtgcctcgtgaaagactattttcccgagcctgttacagtgagctggaactccggagccctgacctctggcgtccacacattcccggctgtgcttcagagctccggcctgtacagcctctcttccgtggtcaccgttcccagctctagcctggggacgcagacatacatttgtaatgtgaatcataagccttccaacaccaaggtggataaaaaggtcgaacccaaatcttgcgacaagacacacacctgtcctccctgcccggcccctgagcttctgggaggccccagcgtgtttctcttccctcccaaacccaaggataccctgatgatctccagaacacctgaggttacgtgtgtggtcgtggacgttagccatgaagatccggaggtgaagtttaattggtatgtcgacggggtggaagtccacaacgcgaaaaccaagccccgggaggagcagtacaattctacatatcgcgtggtttccgtgctgaccgtcctccatcaagattggctgaacggaaaagaatacaagtgcaaagtgagcaataaggcccttcctgctcccattgagaaaacaatctctaaggccaagggccagcctagagaaccccaggtttataccctgccgccttcccgggacgagctcacgaaaaaccaggtgagcctgacatgtcttgtcaaggggttctacccctccgatatcgctgtggaatgggagtctaatggacaacctgagaacaattataaaaccacaccccctgtgctggacagcgacggctcctttttcctctactctaagctgaccgttgataaaagccgctggcagcagggcaacgtcttttcctgcagcgtgatgcacgaagccctgcacaaccattacacccaaaagtctctctccctgagccccgggaag

SEQ ID NO: 39019 - RNA, 639 nt, synthetic construct
  misc_feature 1..639: note = derived and/or modified sequence opt5 from Sirukumab_LightChain1
  source 1..639: mol_type = other RNA
gagatcgtgctgacccagagccccgccacactctccctgtctcctggcgaaagagctacgcttagctgctccgcctctattagcgtctcctacatgtattggtaccaacagaagccggggcaggcgccccggctgctcatctatgacatgtctaacctggctagcggcattcctgcccgcttctccggaagcgggtctggaaccgattttacacttaccatctccagcctggagcccgaagacttcgccgtttactattgtatgcagtggtctggctacccttatacatttgggggaggcaccaaagtggagattaagagaacagtggctgccccctccgtcttcatctttcctccgagcgatgaacaactcaaatctggcaccgcttccgtggtttgcctgctgaataacttctacccccgggaggccaaggtgcagtggaaagtcgacaatgcgctccagagcgggaactcccaggagtctgtgacggaacaagatagcaaggactccacctacagcctgtcttccacacttaccctgagcaaggccgattatgagaaacacaaggtttacgcttgtgaagtgacacatcagggactctctagccctgtcaccaaatcctttaatcgcggcgagtgc

SEQ ID NO: 39020 - RNA, 1338 nt, synthetic construct
  misc_feature 1..1338: note = derived and/or modified sequence opt5 from Sofituzumab_vedotin_HeavyChain1
  source 1..1338: mol_type = other RNA
gaggtgcagctggtcgaaagcggcgggggactcgttcaacccggcgggtccctgagactttcttgcgccgctagcggatactccatcaccaacgactatgcctggaattgggtgcggcaggcgcctggcaaggggctggagtgggtgggatacatttcttatagcggctacacaacgtataacccgtccctcaaatctcgcttcaccatcagcagagatacatccaagaataccctgtaccttcagatgaacagcctgcgggctgaagacacagccgtctattactgtgcccgctggacctctggcctcgattactgggggcagggaacactggtgaccgtttccagcgcttctacgaaaggcccctccgtgtttcctctggcccccagctctaagtccaccagcgggggaacagctgccctcggctgcctggtcaaagactatttccctgagcccgtgaccgtttcctggaactctggggcgcttacaagcggagtgcacacctttcctgccgtcctgcaatccagcggcctctactctctgtccagcgtggtgacggtcccgtctagctcccttggcacacagacctatatttgtaatgttaatcataagccctctaacacaaaggtggataaaaaggtggaacctaaaagctgcgacaagacccacacctgtcccccttgccccgctccggagctgctcgggggaccttccgtcttcctgtttccccctaaacccaaggatacactgatgatcagcagaacgcccgaggtgacctgtgttgtggtcgacgtgtctcatgaagatcctgaggttaagttcaattggtacgtggacggcgtcgaagtgcacaacgccaaaacaaagccgcgggaggagcagtataattccacctaccgcgtcgtgagcgttctcacagtgctgcatcaggattggcttaacgggaaagaatataagtgcaaagtctctaataaggctctgcccgcccctattgagaaaaccatctccaaggcgaagggacaacccagagaacctcaggtgtacacgctgcccccgagccgggaggaaatgaccaaaaaccaggtttccctcacatgtcttgtgaagggcttttacccttctgacatcgccgtcgagtgggagagcaatgggcagcccgaaaacaactataaaaccacacctcccgtgctggattccgacggatctttctttctctacagcaagctgaccgtggacaaatcccgctggcaacagggcaatgttttcagctgctctgtcatgcacgaggctctgcacaaccattatacacagaagtccctcagcctgtctcctggcaag

SEQ ID NO: 39021 - RNA, 642 nt, synthetic construct
  misc_feature 1..642: note = derived and/or modified sequence opt5 from Sofituzumab_vedotin_LightChain1
  source 1..642: mol_type = other RNA
gacatccagatgacccaaagcccctcctctctgagcgcctccgtgggcgatagagtcacaattacgtgcaaggcttctgacctcatccacaactggctggcctggtaccagcagaaacctgggaaggcgccgaaacttctgatttatggagctaccagcctcgagacaggcgttccctcccggttctctgggagcggatccggcaccgattttacactgaccatcagctctcttcagcctgaagacttcgccacatactattgtcaacagtactggaccacgccctttaccttcgggcagggaacaaaggtggagattaaacgcaccgtggccgctccttccgtctttatctttccccctagcgatgaacagctgaagtctggcacagcctccgtggtttgcctcctgaataacttctatccgagagaggctaaggtgcaatggaaagtcgacaatgccctgcagagcggcaactctcaggaatccgtgaccgagcaggatagcaaggactccacgtactctctcagctccacactgacccttagcaaagcggattatgagaagcataaagtttacgcctgtgaagtgacacaccaagggctgtcttcccccgtcaccaagagcttcaatcggggagagtgc

SEQ ID NO: 39022 - RNA, 1323 nt, synthetic construct
  misc_feature 1..1323: note = derived and/or modified sequence opt5 from Solanezumab_HeavyChain1
  source 1..1323: mol_type = other RNA
gaggtgcagctggtcgaaagcggcgggggactcgttcaacccggcgggtccctgagactttcttgcgccgctagcggattcaccttttcccggtactctatgagctgggtgcgccaggcccctggcaaggggctggagctcgtggcgcagatcaactccgtcggaaattctacatattacccggacacggtgaaaggcagattcaccattagccgggataacgctaagaatacactgtatcttcagatgaactccctgcgcgccgaagacaccgccgtttactattgtgctagcggcgattactgggggcaaggaacactcgtgaccgtctcttccgccagcacaaaaggcccctctgtgtttcctctggctccctccagcaagtctacctccgggggaacggccgcgctgggctgcctcgttaaagactatttccctgagcccgtgaccgtcagctggaactccggggccctgacatctggagtgcacacctttcctgctgtgcttcagagctccggcctgtacagcctctcttccgtcgttacagtgccgagctctagcctgggcacccagacgtacatctgtaatgtgaatcataagccctccaacacaaaggtcgataaaaaggtggaacctaaatcttgcgacaagacccacacatgtcccccttgccccgccccggagcttctcgggggacctagcgttttcctgtttccccctaaacccaaggataccctgatgatttccagaacccccgaggtgacatgtgtcgtggttgacgtgagccatgaagatcctgaggtcaagttcaattggtatgtggacggcgtcgaagtgcacaacgctaaaacgaagccgcgggaggagcagtacaattctacctatcgcgttgtgtccgtcctgacagtgctccatcaagattggctgaacgggaaagaatacaagtgcaaagttagcaataaggcccttcccgcgcctatcgagaaaaccatttctaaggccaagggacagcccagagaacctcaggtgtatacactgcccccgtcccgggacgagctcaccaaaaaccaggtcagcctgacgtgtcttgtgaagggcttttacccttccgatatcgctgtggaatgggagtctaatgggcaacccgagaacaactataaaacaacccctcccgttctggacagcgacggatccttctttctctactctaagctgaccgtcgataaaagccgctggcagcagggcaatgtgttctcctgcagcgtgatgcacgaagccctgcacaaccattacacacaaaagtctctctccctgagccctggc

SEQ ID NO: 39023 - RNA, 1326 nt, synthetic construct
  misc_feature 1..1326: note = derived and/or modified sequence opt5 from Solanezumab_HeavyChain
  source 1..1326: mol_type = other RNA
gaggtgcagctggtcgaaagcggcgggggactcgttcaacccggcgggtccctgagactttcttgcgccgctagcggattcaccttttcccggtactctatgagctgggtgcgccaggcccctggcaaggggctggagctcgtggcgcagatcaactccgtcggaaattctacatattacccggacacggtgaaaggcagattcaccattagccgggataacgctaagaatacactgtatcttcagatgaactccctgcgcgccgaagacaccgccgtttactattgtgctagcggcgattactgggggcaaggaacactcgtgaccgtctcttccgccagcacaaaaggcccctctgtgtttcctctggctccctccagcaagtctacctccgggggaacggccgcgctgggctgcctcgttaaagactatttccctgagcccgtgaccgtcagctggaactccggggccctgacatctggagtgcacacctttcctgctgtgcttcagagctccggcctgtacagcctctcttccgtcgttacagtgccgagctctagcctgggcacccagacgtacatctgtaatgtgaatcataagccctccaacacaaaggtcgataaaaaggtggaacctaaatcttgcgacaagacccacacatgtcccccttgccccgccccggagcttctcgggggacctagcgttttcctgtttccccctaaacccaaggataccctgatgatttccagaacccccgaggtgacatgtgtcgtggttgacgtgagccatgaagatcctgaggtcaagttcaattggtatgtggacggcgtcgaagtgcacaacgctaaaacgaagccgcgggaggagcagtacaattctacctatcgcgttgtgtccgtcctgacagtgctccatcaagattggctgaacgggaaagaatacaagtgcaaagttagcaataaggcccttcccgcgcctatcgagaaaaccatttctaaggccaagggacagcccagagaacctcaggtgtatacactgcccccgtcccgggacgagctcaccaaaaaccaggtcagcctgacgtgtcttgtgaagggcttttacccttccgatatcgctgtggaatgggagtctaatgggcaacccgagaacaactataaaacaacccctcccgttctggacagcgacggatccttctttctctactctaagctgaccgtcgataaaagccgctggcagcagggcaatgtgttctcctgcagcgtgatgcacgaagccctgcacaaccattacacacaaaagtctctctccctgagccctggcaag

SEQ ID NO: 39024 - RNA, 657 nt, synthetic construct
  misc_feature 1..657: note = derived and/or modified sequence opt5 from Solanezumab_LightChain1
  source 1..657: mol_type = other RNA
gacgtggtcatgacccagagccccctgtccctccctgttacactgggccaaccggcctctatcagctgcagatcctctcagagccttatttactccgatgggaacgcttatctgcactggttcctccagaagcccggacagtctcctcggctgcttatctacaaagtgagcaatcgcttttccggcgtgcccgacagattcagcgggtctggatccggcacggattttaccctgaagattagccgggtcgaggccgaagacgtgggggtttattactgttctcaatccacacatgtgccttggaccttcggacagggcacaaaagtcgagatcaagcgcaccgtggcggctcccagcgtttttattttccctccgtctgatgaacagctcaaatccggcacagccagcgtggtctgcctgctgaacaatttttatcccagagaggccaaggtgcagtggaaggtggacaacgctctccaatccggaaattctcaggaaagcgtcaccgagcaggattccaaagacagcacgtactctctgtccagcacccttacactgtctaaggccgattatgagaaacacaaggtttacgcttgtgaagtgacccatcaggggctcagctcccctgtgacaaaatctttcaaccggggcgagtgc

SEQ ID NO: 39025 - RNA, 1506 nt, synthetic construct
  misc_feature 1..1506: note = derived and/or modified sequence opt5 from Solitomab_HeavyChain1
  source 1..1506: mol_type = other RNA
gagctggtgatgacccagagcccctcctctctcacagtcacggccggcgaaaaggttaccatgagctgcaaatcctctcaaagcctgcttaactccgggaatcagaagaactacctgacatggtatcagcagaaacctggacaaccgcccaagctcctgatctactgggcttctaccagagagagcggcgtgcctgaccggttcacagggtccggaagcggcaccgattttacacttaccatttcttccgtgcaggccgaagacctggcggtctattactgtcagaatgattatagctaccccctcacgttcggggctggaaccaaactggagatcaagggcggcgggggatctggcgggggaggctccgggggaggcggcagcgaagtgcagctgctcgagcaatctggggccgagctggttcgccctggaacatccgtgaagattagctgcaaagcctccggctatgcttttaccaactactggcttgggtgggtcaagcagagacccggacacggcctggaatggatcggggacattttccctggatctggcaatatccattacaacgagaaatttaagggcaaagccacactcaccgctgataagagctccagcacggcctatatgcagctgtcttcccttacattcgaagacagcgcggtgtacttttgtgcccggctgcgcaattgggatgagccgatggactattgggggcagggaaccacagttaccgtgtctagcggcgggggaggctccgatgtccaactcgtgcagtctggggctgaggtgaagaaacccggcgccagcgtcaaggtttcctgcaaagctagcggatacaccttcacaagatatacgatgcactgggtgcggcaggcccctggccaagggctggaatggatcggatacattaacccctctcgcggctataccaattacgcggactccgtgaaggggagatttacaatcaccacagataaaagcacctctacggcctacatggagctgtccagcctccggtccgaagacacagctacctattactgtgcccgctattacgatgaccattattgcctggactactggggacagggcaccacagtcaccgtgtctagcggggagggcacatccacgggatctggcgggagcggaggctccgggggagctgatgacattgttcttacccagagccctgccacactgtctctctcccccggcgaaagagccaccctgagctgtcgggcttctcagtccgtgagctatatgaactggtaccaacagaagccggggaaagcgcctaagcgctggatctacgatacatctaaggtcgccagcggcgtgcccgctagattctccggaagcggctctgggaccgactattcccttacgattaatagcctggaggccgaggatgccgctacctactattgccagcagtggtcctctaaccctctcacatttggaggcgggaccaaagttgaaatcaagcaccatcaccaccatcac

SEQ ID NO: 39026 - RNA, 1506 nt, synthetic construct; identical to SEQ ID NO: 39025
  misc_feature 1..1506: note = derived and/or modified sequence opt5 from Solitomab_SingleChain
  source 1..1506: mol_type = other RNA

SEQ ID NO: 39027 - RNA, 702 nt, synthetic construct
  misc_feature 1..702: note = derived and/or modified sequence opt5 from Sonepcizumab_LightChain_Precursor
  source 1..702: mol_type = other RNA
atgagcgtgcccacccaggtcctgggcctcctgcttctgtggctcacagacgccagatgcgagacgaccgttacacaatccccttctttcctgagcgcttccgtgggggatcgggtgaccatcacatgtattaccacaaccgacatcgatgacgatatgaactggtttcagcaggaaccgggaaaggcccccaaacttctgatttctgagggcaatatcctccgccctggggtccccagcagattctcctctagcggatacggcacggactttaccctgacaatttccaagctgcagcctgaagatttcgcgacctattactgcctccaaagcgacaacctgccctttacattcgggcagggaaccaaacttgagatcaagcggacggtggctgccccttctgtttttatcttcccgccctccgatgaacagctgaaaagcggcacagcctctgtggtctgtctcctgaataacttttatcctcgcgaggctaaggtgcagtggaaggttgacaatgcccttcaatccggcaacagccaggagtctgtgaccgaacaggattccaaagacagcacatactccctgtctagcaccctcaccctgtccaaggctgattatgagaaacacaaggtctacgcctgcgaagtgacacatcaggggctgagctctcccgtgacgaaatccttcaatagaggagagtgt

SEQ ID NO: 39028 - RNA, 1365 nt, synthetic construct
  misc_feature 1..1365: note = derived and/or modified sequence opt5 from Sonepcizumab_gamma1-Chain_Precursor
  source 1..1365: mol_type = other RNA
atggagtggagctgggtgttcctgtttttcctctccgtcaccacaggcgttcactctgaagtgcagctggtgcaaagcggggccgaggtcaagaaacccggagaatcccttaagatctcttgccagagctttggctacattttcatcgaccatacgattcactggatgagacagatgcctgggcagggactggagtggatgggcgctatctccccgcggcatgatattaccaaatataacgaaatgtttcgcgggcaagtgacaatctctgccgacaagagctccagcaccgcgtacctccagtggtcttccctgaaagctagcgatacagccatgtatttctgtgccagaggaggcttttacggctctaccatctggttcgacttttgggggcagggaacaatggttaccgtgtccagcgcttctacgaagggcccctccgtcttccctcttgcccccagctccaagtctaccagcgggggaacagctgccctgggctgcctcgtgaaagattattttcctgagcccgttaccgtgtcctggaatagcggggcgctgacatctggagtccacaccttccctgccgtgctgcagtccagcggcctctactctctgagctccgtggtcacggttccgtctagctcccttggcacacaaacctatatttgtaacgtgaatcataagcccagcaacacaaaagtggacaagcgggtcgctcctgagctgctcgggggaccctctgtgtttctgttccctcccaaaccgaaggatacccttatgatctcccgcacccctgaagttacatgcgtggtcgtggacgttagccacgaggatcccgaagtgaagttcaattggtacgtcgacggcgtggaggtccacaacgccaaaacgaagcctagagaggaacagtacaattctacctatcgggtggtttccgtgctgacagtcctccatcaggattggctgaacgggaaagagtacaagtgtaaagtgagcaataaggctctgcccgcccccattgagaaaaccatctccaaggcgaagggacagcctcgcgaaccgcaagtttatacacttcccccttctagagaagagatgaccaaaaaccaggtgagcctgacgtgccttgtcaagggcttttacccctccgacattgccgtggagtgggaatctaatgggcagcctgagaacaattataaaacaacacccccggtgctggatagcgacggatccttctttctctacagcaagctgaccgttgacaaatctcggtggcaacagggcaacgtcttctcctgtagcgtgatgcacgaagctctccataatcactatacccagaagtctctgtccctcagccctggcaag

SEQ ID NO: 39029 - RNA, 1338 nt, synthetic construct
  misc_feature 1..1338: note = derived and/or modified sequence opt5 from Stamulumab_HeavyChain1
  source 1..1338: mol_type = other RNA
gtgcagctggtccaaagcggcgccgaggttaagaaacccggggcttccgtgaaggtgtcttgcaaagccagcggatacaccttcacatcctattacatgcactgggtcagacaggcgcctggccaggggctcgaatggatgggaatcattaacccgtctggcgggagcacgtcctatgctcagaagtttcaaggacgggtgaccatgacacgcgacacctctacaagcaccgtttacatggagctgtccagccttagatctgaagatacagccgtgtattactgtgcccgggacgagaattggggcttcgatccctggggccaggggaccctggtcacggtgtccagcgcttctaccaaaggaccttccgtttttcccctcgcccctagctctaagtccacaagcggcgggaccgctgccctgggatgccttgtgaaggactatttccccgaacctgtcacagtgtcctggaactctggcgcgctgaccagcggggtgcatacgtttccggccgtcctccagtccagcggactgtactctctgtccagcgttgtgacagtgccctctagctccctcggcacccagacatacatctgtaatgtcaaccacaaaccttctaataccaaggtggataaaaaggttgagcccaaaagctgcgacaagacccatacatgtcctccctgcccggctcctgagctgcttggcgggccctccgtgttcctgtttcctcccaagcccaaagatacgctcatgattagccgcacccctgaagtcacatgtgtggttgtggacgtctctcacgaggatccggaagtgaagttcaactggtatgtcgacggagtggaggttcataatgccaaaaccaagcccagagaggaacaatacaactccacatatcgggtggtcagcgtgctgaccgttcttcaccaggattggctgaatggcaaagagtacaagtgcaaagtgtctaacaaggctctccctgcccccatcgaaaagacgatttccaaagcgaaggggcagcctcgcgagccccaggtctatacactgccgcctagcagagaagagatgaccaaaaatcaagtgtccctgacctgtctcgtgaagggattttacccctctgacatcgccgttgagtgggaaagcaacggccagcctgagaataactataaaacaacaccccctgtcctggattccgacgggtctttctttctttacagcaagctgaccgtggacaagtcccggtggcagcaaggaaatgtgttcagctgctctgtcatgcacgaagctctccataaccactacacgcagaaatccctgagcctttctcccggcaag

SEQ ID NO: 39030 - RNA, 633 nt, synthetic construct
  misc_feature 1..633: note = derived and/or modified sequence opt5 from Stamulumab_LightChain1
  source 1..633: mol_type = other RNA
agctacgagctgacccagcccccttccgtgtctgtcagcccgggccaaacagcctccatcacgtgctctgggcacgctctcggagacaagttcgttagctggtatcagcagaaacccggccagtcccctgtgctggtgatttacgatgacacccaaagaccctctgggatccctgaacggtttagcggatccaacagcggcaatacagccacccttacaatttctgggacccaggcgatggatgaggctgactattactgtcaggcctgggattccagcttcgtctttggaggcggcacaaaggtgaccgttctggggcagcccaaagccgctccttctgtgaccctcttcccgccctccagcgaagaactgcaagccaacaaggctacgcttgtctgcctgatctctgacttttatcctggagccgtgacagttgcgtggaaagccgattccagccccgtgaaggctggcgtcgaaaccacaaccccttccaagcagtctaataacaaatacgccgctagctcctatctcagcctgacgcccgagcagtggaagtctcatcgctcctacagctgtcaggtgacacacgaggggtctaccgtggagaaaacagtcgccccgaccgagtgcagc

SEQ ID NO: 39031 - RNA, 1356 nt, synthetic construct
  misc_feature 1..1356: note = derived and/or modified sequence opt5 from Suptavumab_HeavyChain1
  source 1..1356: mol_type = other RNA
gaggtgcagctggtcgaaagcggcggggacctcgttcaacccggaagatccctgcggctttcttgcgtggccagcggcttcacctttgatgactacgctatgcactgggtgcgccaggcccctgggaagggactggagtgggtctccggcgtgtcttggagcgggtccacagttggatatgcggattctgtgaaaggcagattcacggtcagccgggacaacgctcagaagtccctctacctgcagatgaatagccttcgcgccgaagataccgccctgtattactgtgtgaaagacgcttataagtttaactactattactacggcctcgatgtttgggggcaaggaacaaccgtgacagtctcttccgccagcaccaaaggcccgtctgtgttccccctggctccttccagcaagtctacatccgggggaaccgccgcgctgggctgcctcgtgaaggactattttcccgagcctgtcacggttagctggaactccggggccctgacctctggagtgcatacattccccgctgtgcttcagagctccggcctgtacagcctctcttccgtcgtgaccgttcctagctctagcctgggcacacagacctatatctgtaatgtgaatcacaaaccgtccaacacgaaggtcgataaaaaggtggaacccaaatcttgcgacaagacacatacctgtcctccctgccctgcccccgagcttctcgggggaccgagcgtttttctgttccctcccaagcctaaagatacactgatgatttccagaacccccgaggtgacctgtgtcgtggtcgacgtgagccacgaagatcccgaggttaagtttaattggtacgtggacggcgtcgaagtgcataacgctaaaacaaagcctcgggaggagcagtataattctacgtaccgcgttgtgtccgtcctgaccgtgctccaccaagactggctgaacgggaaagaatataagtgcaaagtgagcaataaggcccttccggcgcccatcgagaagacaatttctaaagccaagggacagcctagagaaccccaggtttacaccctgcctccctcccgggatgagctcaccaaaaaccaggtcagcctgacatgtcttgtgaagggcttctacccgtccgacatcgctgtggaatgggagtctaatgggcaacctgagaacaattataaaacgacaccccctgtcctggatagcgacggatcctttttcctctactctaagctgaccgtggataagagccgctggcagcagggcaacgtgttttcctgcagcgttatgcacgaagccctgcataaccactatacccaaaaatctctctccctgagccccggc

SEQ ID NO: 39032 - RNA, 642 nt, synthetic construct
  misc_feature 1..642: note = derived and/or modified sequence opt5 from Suptavumab_LightChain1
  source 1..642: mol_type = other RNA
gagatcgtgatgacccagagccccgccacactgtccgtctctcctggcgaaagagctacgctcagctgccgggcctcccaaaccattctgtctaaccttgcgtggtacctgcagaaaccggggcaggctccccgcctcctgatctatggagccagcacaagagccaccggccttcctgctcggttctccgggtctggaagcggcacagagtttaccctgacaatttccagcctccagtctgaagacttcgccgtttactattgtcaacagtacaataactggcccctgacctttgggggaggcacgaaagtggagatcaagcgcaccgtggctgccccttccgtcttcatttttccccctagcgatgaacagctgaaatctggcacagcgtccgtggtttgcctcctgaataacttctatccgagagaggccaaggtgcagtggaaagtcgacaatgcccttcaaagcgggaactctcaggagtccgtgaccgaacaggatagcaaggactccacatactctctgagctccaccctcacgctgagcaaggctgattatgagaaacacaaggtttacgcttgtgaagtgacacatcagggactttcttcccccgtcaccaagagctttaatcggggcgagtgc

SEQ ID NO: 39033 - RNA, 1344 nt, synthetic construct
  misc_feature 1..1344: note = derived and/or modified sequence opt5 from Suvizumab_HeavyChain1
  source 1..1344: mol_type = other RNA
caggtgcaactggtccagagcggcgccgaggttaagaaacccggggcttccgtgaaggtgtcttgcaaagccagcggatacaccttcacaaactcctggatcggctggtttagacaggcgcctgggcagggactcgaatggattggcgacatctatcccgggggaggctacacgaattataacgagattttcaagggcaaagctaccatgacagccgatacctctacaaataccgcctacatggaactgagctcccttcggtctgaggacacagctgtctattactgtagccgcgggatccccggatatgccatggattactggggccaagggaccctggtgacggtttccagcgcttctaccaagggaccttccgtgtttcccctcgcccctagctctaagtccacaagcggcgggaccgcggccctgggatgccttgtcaaagactacttccccgaacctgtgacagtttcttggaactccggcgctctgaccagcggcgtgcacacgtttccggccgtcctccagtcctctgggctgtatagcctgtccagcgtggtgacagtcccctcttccagcctcggaacccagacatacatttgtaatgttaaccataagccttctaataccaaagtggataagaaagtggagcccaagagctgcgacaagacccacacatgtcctccctgcccggctcctgagctgcttggcgggccctccgtcttcctgtttcctcccaaacccaaggatacgctcatgatctctagaacccctgaagtgacatgtgttgtggtcgacgtgagccatgaggatccggaagttaaattcaactggtatgtggacggagtcgaggtgcacaatgccaagaccaaaccccgggaggaacagtacaactccacatatcgcgtcgtgagcgttctgaccgtgcttcatcaagattggctgaatggcaaggagtacaaatgcaaggtctctaacaaggcgctccctgcccccatcgagaaaacgatttccaaggctaaagggcagcctagagaaccccaggtgtatacactgccgcctagccgggacgaactgaccaagaatcaggtttctctcacctgtctggtgaaaggattttacccctccgatatcgccgtcgagtgggagagcaacggccaacctgaaaataactacaagacaaccccgcctgtgcttgactccgacggctctttctttctgtatagcaagctcacagtggataaatcccgctggcagcaggggaacgttttctcttgcagcgtcatgcacgaggctctgcacaatcattacacgcaaaagtcccttagcctgtctcccggaaaa

SEQ ID NO: 39034 - RNA, 660 nt, synthetic construct
  misc_feature 1..660: note = derived and/or modified sequence opt5 from Suvizumab_LightChain1
  source 1..660: mol_type = other RNA
gacatccagatgacccaaagacccgatagcctgtccgcctctgtgggcgaccgggtcacaatgagctgcaagtcctctcagagcctcctgaactccggggatcagaaaaattaccttacgtggtatcagcaaaagcctggacagccgcccaaactgctcatttactgggcttctaccggcgagagcggggttcctgaccgcttctccggaagcggctctgggacagattttaccttcacaatctccagcctgcagcccgaagacattgccacctattactgtcagaacgattattcttacccttggacatttggacaaggcaccaaggtggagatcaaaagaacggtggcggctccctccgtcttcatttttcctccgagcgacgaacagcttaagtctggcaccgcctccgtggtttgcctgctcaataacttctatccccgggaggccaaggtgcagtggaaagtcgataatgctctgcagagcgggaactcccaagaatctgtgacagagcaggacagcaaggattccacctacagcctgtcttccacactcaccctgagcaaagccgactacgagaagcacaaagtttatgcttgtgaagtgacgcatcagggactttctagccctgtcacaaagtcctttaatcgcggcgagtgc

SEQ ID NO: 39035 - RNA, 1350 nt, synthetic construct
  misc_feature 1..1350: note = derived and/or modified sequence opt5 from Tabalumab_HeavyChain1
  source 1..1350: mol_type = other RNA
caggtgcaactgcagcagtggggcgccgggctcctgaagcccagcgagaccctttccctgacatgcgctgtctacggaggctctttcagcgggtattactggtcctggatcagacagcctccgggaaaaggcctcgaatggattggggagatcaaccactctggaagcacgaattataacccctccctgaagtctcgggttaccattagcgtggacacatccaaaaatcaatttagccttaagctgtcttccgtgaccgccgcggatacagctgtctactattgtgcccgcggctactatgacatcctcaccggctactactattacttcgattattgggggcagggaacactggtgaccgttagctctgcctccacgaaaggccctagcgtgtttcccctggctccttgctctagatccaccagcgaatccacagccgctctcgggtgtctggtcaaggactacttccccgagcctgtgaccgtttcttggaacagcggagcccttacatccggcgtgcatacctttccggcggtcctgcagagctctgggctctattccctgagctctgtggtgacggtccccagctcctctcttggaacaaagacctacacatgcaatgttgatcacaaacctagcaacaccaaggtggacaaacgggtggaatccaagtatggacccccttgtcccccgtgccctgcccccgagttcctgggcgggcctagcgtctttctcttccctcccaaacccaaggataccctgatgatttctcgcacaccggaggtgacgtgtgttgtggtcgacgtgtcccaggaagatcccgaggttcaatttaattggtacgtggacggagtcgaagtgcataacgctaagaccaaacctagagaggagcagttcaatagcacataccgggtcgtgtctgttctgaccgtgctccaccaggattggctgaacggcaaggaatataaatgcaaggtctccaataaagggcttcccagctccatcgagaagacaatctctaaagccaagggacagcctcgcgaaccccaagtgtacaccctgccgcctagccaggaggaaatgacgaagaaccaggtttccctcacatgtctggtgaaaggcttttatccctctgacattgctgtcgagtgggagagcaatgggcaacctgaaaacaattacaagaccacaccccctgtgcttgattccgacggcagcttctttctgtattctagactcaccgtggacaaatcccggtggcaggagggcaacgttttcagctgctctgtcatgcatgaagccctgcacaaccactacacccagaagtccctgagcctctctctgggcaaa

SEQ ID NO: 39036 - RNA, 642 nt, synthetic construct
  misc_feature 1..642: note = derived and/or modified sequence opt5 from Tabalumab_LightChain1
  source 1..642: mol_type = other RNA
gagatcgtgctgacccagagccccgccacactctccctgtctcctggcgaacgggctacgcttagctgccgggcctcccaatctgtcagccgctacctggcgtggtatcagcagaagccggggcaggctcccagactcctgatttacgacgcctccaaccgggccaccggaatccctgctcgcttctctggcagcgggtccggaacagatagcacccttacaatttcttccctggagcccgaagactttgccgtttattactgtcaacagagaagcaattggcctcggaccttcggccaggggacaaaagtggagatcaagcgcaccgtggctgccccctctgtctttattttccctccgtccgatgaacagctcaaaagcggaacggcgtctgtggtttgcctgctgaacaatttttatcccagagaggccaaggtgcaatggaaagtcgacaacgctctccagtccggcaatagccaggagtccgtgaccgaacaggattctaaggacagcacatactccctgagcaacacccttacactgtctaaggccgattatgagaaacacaaggtttacgcttgtgaagtgacccatcaaggcctctccagccctgtcacgaaatctttcaatagaggggagtgc

SEQ ID NO: 39037 - RNA, 1332 nt, synthetic construct
  misc_feature 1..1332: note = derived and/or modified sequence opt5 from Tacatuzuab_HeavyChain1
  source 1..1332: mol_type = other RNA
caggtgcaactgcagcagagcggcgccgaggtcaagaaacccgggtcctctgttaaggtgagctgcaaggcttccggatacgccttcacctcttatgtgatccactgggtcagacaggcgcctggccaagggctctactggattggatatatccatccgtacaacggcgggacaaaatataatgaaaaatttaagggaaaggctacgattaccgccgacgagagcacaaacaccgcctacgaactgtcctctcttcggagcgaggatacagctttctatttttgtgcccgctccggcggcggggaccccttcgcttactggggacagggcagcctggtgaccgtttcttccgccagcacaaaagggccttctgtgtttcccctcgcgccttccagcaagtctacctccggaggcacggccgctctggggtgccttgtcaaagattacttccccgaacctgtgaccgttagctggaactccggagccctgacatctggcgtgcacacctttccggctgtcctccagagctccggcctgtatagcctgtcttccgtggtgacagtccccagctctagcctcgggacccagacgtacatctgtaatgttaatcataagccttccaacacaaaagtggacaagagagtggagcccaagtcttgcgataaaacccacacatgtcctccctgcccggcccctgagctgcttggaggccccagcgtcttcctgtttcctcccaagcccaaagacaccctcatttcccggacccctgaagtgacatgtgttgtggtcgatgtgagccatgaggacccggaagttaagttcaattggtatgtggatggggtcgaggtgcacaacgcgaaaacgaagccccgcgaggaacaatacaattctacctatagagtcgtgtccgttctgacagtgcttcaccaggactggctgaacggaaaagagtacaagtgcaaggtcagcaataaagccctccctgctcccatcgaaaagaccatctctaaagccaagggccagcctcgggagccccaggtgtatacactgccgccttcccgcgaagagaccaaaaaccaagttagcctgacgtgtctcgtgaaggggttttacccctccgatattgctgtcgagtgggaatctaatggacagcctgagaacaattacaagacaacaccccctgtgctggacagcgatggctccttctttctttattctaaactgaccgtggacaagagcagatggcagcaaggcaacgttttctcctgcagcgtccatgaagccctccacaaccattacacccagaaatctctgtcccttagccccgggaag

SEQ ID NO: 39038 - RNA, 636 nt, synthetic construct
  misc_feature 1..636: note = derived and/or modified sequence opt5 from Tacatuzuab_LightChain1
  source 1..636: mol_type = other RNA
gacatccagctgacgcaaagcccctcctctctcagcgcctccgtgggcgatagagtcacaattacgtgcaaggcttctcaggacatcaacaaatacattgggtggtatcagcagaagcctggaaaagccccgaagctgcttcactacaccagcgcgctgctccccggcatcccttcccggttctctgggagcggatccggccgcgattatacatttaccattagctctctgcaacccgaggacatcgctacatactattgtcttcagtacgatgacctgtggaccttcgggggaggcacaaaactccagatcaagagaaccgttgccgccccttccgtgtttatttttccccctagcgatgaacagctgaagtctggcacggcttccgtggtctgcctgctcaataacttctatccgcgggaggccaaagtgcaatggaaggttgacaatgctctgcagagcgggaactctcaggaatccgtgaccgagcaggatagcaaagactccacatactctcttagctccaccctgacactcagcaaggccgattacgaaaaacataaggtctatgcgtgtgaggtgacccaccaaggactgtcttcccccgttaccaagagcttcaatcgcggcgagtgc

SEQ ID NO: 39039 - RNA, 678 nt, synthetic construct
  misc_feature 1..678: note = derived and/or modified sequence opt5 from Tadocizumab_fab_fragment_HeavyChain
  source 1..678: mol_type = other RNA
caggtgcaactggtccagagcggcgccgaggttaagaaacccgggtcctctgtgaaggtgagctgcaaggcttccggatacgccttcaccaactatctcatcgaatgggtcagacaggcgcctggccaggggctggagtggattggagtgatctacccgggctctgggggaacaaattataacgaaaaatttaaaggccgggttacgcttaccgtggacgagagcacaaataccgcttacatggaactgtcctctctccgcagcgaggatacagccgtctatttctgtgccagacgggacggcaactacgggtggtttgcttattggggacaaggcaccctggtgacagtttccagcgcctctaccaaggggccctccgtgttccctcttgctcccagctctaagtccacgagcggaggcaccgccgcgctggggtgcctcgtcaaagattactttcctgagcccgtgacagtgtcttggaactccggagccctgaccagcggcgtccacacattccctgctgttctgcagtcctctggcctctacagcctgtccagcgtggtgaccgtcccgtcttccagccttgggacgcagacatatatttgtaatgtgaatcataagccctctaacaccaaagttgacaagaaagtggaacctaagagctgcgataagacacac

SEQ ID NO: 39040 - RNA, 582 nt, synthetic construct
  misc_feature 1..582: note = derived and/or modified sequence opt5 from Tadocizumab_fab_fragment_LightChain
  source 1..582: mol_type = other RNA
gacatccagatgacccaaacacccagcacgctgtccgcctctgtgggcgatcgggtcaccattagctgccgggcttcccaggacatcaacaattacctcaactggtatcagcagaagcctgggaaagccccgaagctgcttatttactatacatctaccctgcacagcggagttccctcccgcttctctggcagcgggtccggaacagattacaccctcacaatcagctctctgcaacctgacgattttgcgacctatttctgtcagcagggcaatacgcttccctggacctttgggcagggaacaaaagtggaggtgaagagaaccgtcgctgccccttccgtgttcatttttccccctagcgacgaacaactgaaatctggcacagcctccgttgtgtgcctcctgaacaatttctacgagagcgtcaccgaacaggattctaaggactccacgtatagcctgtcctctacactcaccctgagcaaggctgattacgagaaacataaggtgtacgcctgtgaagttacacaccagggcctttccagcccggtgaccaaatcttttaacagaggggagtgc

SEQ ID NO: 39041 - RNA, 1359 nt, synthetic construct
  misc_feature 1..1359: note = derived and/or modified sequence opt5 from Talizumab_HeavyChain1
  source 1..1359: mol_type = other RNA
caggtgcaactggtccagagcggcgccgaggttaagaaacccggggcttccgtgaaggtgtcttgcaaagccagcggatacaccttctccatgtattggctcgaatgggtcagacaggcgcctggccacgggctggagtgggtgggagaaatctctccgggcacatttacgaccaactacaatgagaagttcaaagctcgggccacatttaccgccgacacaagcaccaacacagcttatatggaactttcctctctgcgcagcgaggataccgccgtttactattgtgctagattctcccattttagcgggtctaattacgactatttcgattactggggacagggcacgctcgtgaccgtctccagcgcctctacaaagggcccctccgtgtttcctctggcgcccagctctaagtccaccagcgggggaacagccgctcttggctgcctggttaaagactacttccctgagcccgtgaccgtctcctggaactctggggccctcacgagcggagtgcacacatttcctgctgtgctgcaatccagcggcctgtattctctctccagcgtcgttaccgtgccgtctagctccctggggacacagacctacatttgtaatgtgaaccataagccctctaataccaaagtcgataagaaagtggaacctaagagctgcgacaagacacacacgtgtcccccttgccccgccccggagcttctgggaggcccttccgttttcctctttccccctaaacccaaggataccctgatgatcagccggacacccgaagtgacctgtgtcgtggttgacgtgtctcatgaggatcctgaggtcaaattcaactggtatgtggacggcgtcgaagtgcacaatgcgaagacaaaaccgcgcgaggaacagtacaactccacctatagagttgtgagcgtccttacggtgctgcaccaggattggctcaatgggaaggagtacaaatgcaaggtttctaacaaggccctgcccgctcctattgagaaaacaatctccaaggccaaaggacaaccccgggaacctcaggtgtataccctgcccccgagccgcgacgagctcaccaagaatcaggtctccctgacatgtcttgtgaaaggcttttacccttctgatattgctgtggaatgggagagcaacgggcagcccgaaaataactacaagaccacacctcccgttctggactccgacggatctttcttcctctatagcaagctgacggtcgataaatccagatggcaacagggcaacgtgtttagctgctctgtgatgcatgaggcccttcacaatcattacacccagaagtccctgagcctctctcctgggaaa

SEQ ID NO: 39042 - RNA, 642 nt, synthetic construct
  misc_feature 1..642: note = derived and/or modified sequence opt5 from Talizumab_LightChain1
  source 1..642: mol_type = other RNA
gacatcctgctcacccagagccccggcacactgtccctttctcctggggagagagccacgctgagctgccgggcttcccaatctattggaaccaacatccactggtaccagcagaagccgggccaggcgccccgcctcctgattaaatatgccagcgaatccatctctgggattcctagcagattctccggaagcggctctgggacagattttacccttacaatctcccggctggagcccgaagacttcgctatgtactattgtcaacagagcgattcttggcctaccacatttggacagggcaccaaggtggagatcaaacgcacggtcgccgccccctccgttttcatttttcctccgagcgacgaacagctcaagtctggcaccgcttccgtggtgtgcctgctgaataacttctaccccagagaggccaaagtccaatggaaggtggataatgctctccagagcgggaactcccaggagtctgttacagaacaggacagcaaggattccacctatagcctgtcttccacacttaccctgagcaaagccgactacgagaagcataaagtgtatgcgtgtgaagtcacgcaccaaggactctctagccctgtgacaaagtcctttaatcggggcgagtgc

SEQ ID NO: 39043 - RNA, 1368 nt, synthetic construct
  misc_feature 1..1368: note = derived and/or modified sequence opt5 from Tamtuvetmab_HeavyChain1
  source 1..1368: mol_type = other RNA
gaggtgaagctgctcgaaagcggcgggggactggtccagcccggcgggtccatgagactttcttgcgccggaagcggcttcacctttacagacttctacatgaactggatccggcaacctgctgggaaagccccggagtggctgggatttattcgcgataaggcgaaaggctatacgaccgaatacaatccctccgttaagggcagattcacaatctctcgggacaacacccagaatatgctctatctgcagatgaacacacttcgcgctgaggataccgccacatactattgtgccagagaagggcacaccgctgccccttttgactactggggacagggcacgctggtgaccgtgagctccgcttctacaaccgcccccagcgtcttccctctcgcgccctcctgcgggagcacatctggatccaccgtggccctggcttgtctggttagcggctattttcctgagccggtgacggtctcttggaatagcgggagcctcacatctggagtgcataccttcccctccgttctgcaaagctccggcctttactctctgagctccatggtgacagtccctagctctcggtggccctccgagacctttacctgcaacgtggcccaccctgctagcaaaacaaaggtggataagcccgtcccgaaacgcgaaaatggcagagttcctcggccccctgactgtcccaagtgccccgcccctgagatgctcgggggaccgtctgtgttcatttttccccctaaacccaaggatacgctgcttatcgcgcgcacccctgaagtgacatgtgtcgtggttgacctggatcccgaggacccggaggtgcagattagctggttcgtcgatggcaaacagatgcagaccgccaagacacaacctagagaggaacagtttaacgggacctaccgggtggtttccgtgctccccatcggacatcaggactggctgaagggcaaacagttcacgtgcaaggtcaataacaaagctctgccttctcccatcgaacgcacaattagcaaggccagagggcaagctcaccagccttccgtgtatgtccttcccccgagccgggaggaactgtctaaaaataccgtgtcccttacctgtctgatcaaggatttctttcctcccgacattgacgttgagtggcagagcaacggacaacaggagcccgaatctaaataccgcacaacccctccgcagctcgatgaggacggctcctatttcctgtacagcaagctctccgtggataagtctagatggcagcggggcgacacatttatctgcgccgtcatgcatgaagccctgcacaatcactatacgcaaaaatccctctcccattctcccgggaag

SEQ ID NO: 39044 - RNA, 639 nt, synthetic construct
  misc_feature 1..639: note = derived and/or modified sequence opt5 from Tamtuvetmab_LightChain1
  source 1..639: mol_type = other RNA
gacatcaagatgacccagagcccctccttcctgtctgccagcgtgggcgatagagtcacactcaactgcaaggcttcccaaaatattgacaaatacctgaactggtatcagcagaaacttggggagtctcctaagctgctcatctacaatacgaacaatctgcagaccggcattccgagccggttttccggatctgggagcggaacagatttcacccttacaatctccagcctgcaacccgaagacgttgccacctatttttgtctccagcacatttctcgccctagaacattcggcgggggaacccatctgacggtgctgggccagcccaaagcgtcccctagcgtgaccctctttcccccttcttccgaggaactgggcgctaacaaggccacacttgtctgcctgatcagcgatttctacccgtctggggtgaccgttgcctggaaggctgacggatcccccatcacacagggcgtggagaccacgaaacctagcaagcaatccaataacaaatatgccgcttctagctacctctccctgacacccgataagtggaaaagccactcttcctttagctgtcttgtcacccatgaagggtctacagtggagaagaaggttgcccctgcggagtgcagc

SEQ ID NO: 39045 - RNA, 360 nt, synthetic construct
  misc_feature 1..360: note = derived and/or modified sequence opt5 from Tanezumab_HeavyChain
  source 1..360: mol_type = other RNA
caggtgcaactgcaggagagcggccccgggctcgtcaagccttccgaaaccctgtctcttacatgcacggttagcggattctccctgatcggctacgacctcaactggattagacagccgcccgggaaaggactggagtggatcggcattatctggggagatgggaccacagactataattctgccgtcaagagccgggtgaccatttccaaagatacatctaagaaccagtttagccttaaactgtccagcgtgaccgctgccgacacagcggtgtactattgtgctcgcggcggctactggtatgccacctcttactatttcgattactgggggcaaggaacgctcgttaccgtgtcc

SEQ ID NO: 39046 - RNA, 327 nt, synthetic construct
  misc_feature 1..327: note = derived and/or modified sequence opt5 from Tanezumab_LightChain
  source 1..327: mol_type = other RNA
gacatccagatgacccaaagcccctcctctctgagcgcctccgtgggcgatagagtcacaattacgtgccgggcttctcagagcatctccaacaatctcaactggtaccagcagaagcctgggaaagccccgaagctgcttatttattacacctctcgcttccacagcggagttccctccagatttagcggctctgggtccggaacagacttcacctttacaatcagctctctgcaacctgaggatattgcgacctattactgtcagcaggaacatacactcccctataccttcggccaggggacgaaactggagatcaagcggacc

SEQ ID NO: 39047 - RNA, 1323 nt, synthetic construct
  misc_feature 1..1323: note = derived and/or modified sequence opt5 from Tarextumab_HeavyChain1
  source 1..1323: mol_type = other RNA
gaggtgcagctggtcgaaagcggcgggggactcgttcaacccggcgggtccctgagactttcttgcgccgctagcggattcaccttttcctctagcggcatgtcctgggtgcggcaggcccctgggaagggactggagtgggtgtctgtcatcgcgagctccggcagcaacacatactatgctgactctgtgaaaggccgcttcacgatttccagagataatagcaagaacaccctctacctgcagatgaactctcttcgggccgaagacacagccgtttattactgtgctcgctccatcttttataccacatgggggcagggaaccctggtgacagtcagctctgcctccaccaaaggcccgagcgtgttccccctcgctccttgctccagatctacgagcgagtccaccgccgcgctggggtgtctggttaaggattactttcccgaacctgtgacagtcagctggaactctggagccctcacctccggcgtgcacacattccccgctgtgctgcaaagctctgggctttatagcctgtcctctgtcgttaccgtgcctagctccaattttggaacgcagacatatacctgcaatgtggaccataaaccgagcaatacaaaggtcgataagaccgtggagcggaaatgttgcgttgagtgtcccccttgccccgcccctcccgtggctggcccgtctgtcttcctctttcctcccaagcctaaagacaccctgatgatttcccgcacacccgaagtgacgtgtgttgtggtcgatgtgagccacgaggaccccgaagtccagttcaactggtacgtggatggcgttgaggtgcataatgccaagaccaaacctagagaggaacagtttaactctacattccgggtcgtgtccgttcttaccgtggtccaccaagactggctgaatgggaaggagtacaagtgcaaagtgagcaacaagggactcccggcgcccatcgagaaaacaatttccaagaccaaaggccagcctcgcgaaccccaggtgtacacgctgcctccctctagagaagagatgacaaagaatcaggttagcctgacctgtctcgtcaaagggttttatccgtccgatatcgccgtggagtgggaatctaacggacaacctgagaataactacaagaccacaccccctatgctggacagcgatggctccttcttcctttatagcaagctgaccgtggacaaatctcggtggcagcaggggaacgtcttttcctgcagcgtgatgcatgaagctctccacaatcactacacacaaaagtctctgtcccttagccccggaaaa

SEQ ID NO: 39048 - RNA, 645 nt, synthetic construct
  misc_feature 1..645: note = derived and/or modified sequence opt5 from Tarextumab_LightChain1
  source 1..645: mol_type = other RNA
gacatcgtgctgacccagagccccgccacactcagcctgtctcctggcgagagagctacgcttagctgccgggcctcccaatctgtccgcagcaactacctggcgtggtatcagcagaagccggggcaggctcccagactcctgatttacggagcctcctctcgggccaccggcgttcctgctcgcttcagcgggtccggaagcggcacagattttacccttacaatctcttccctggaacccgaggacttcgccgtgtattactgtcaacagtatagcaattttcctattaccttcgggcagggaacaaaagtggaaatcaagagaaccgtcgctgccccctctgtgtttattttccctccgtccgatgagcagctcaaaagcggcacggcgtctgttgtgtgcctgctgaacaatttttacccccgggaagccaaggtccaatggaaagtggacaacgctctccagtccggcaatagccaggagtccgttaccgagcaggattctaaggacagcacatattccctgagctctacccttacactgtccaaggccgattacgaaaaacacaaggtgtacgcttgtgaggtcacccatcaagggctcagctctcctgtgacgaaatccttcaaccgcggagaatgc

SEQ ID NO: 39049 - RNA, 363 nt, synthetic construct
  misc_feature 1..363: note = derived and/or modified sequence opt5 from Tefibazumab_HeavyChain1
  source 1..363: mol_type = other RNA
caggtgcaactgaaggagagcggccccgggctcgtcaaaccttcccagaccctgtctatcacatgcacgattagcggattctccctttctagatacagcgttcactgggtgcggcagccgcccggcaaggggctggaatggctcggaatgatctggggcgggggaaacaccgactataattccgccctgaaatctcgccttagcatttccaaggataacagcaaaaatcaggtgtttctgaagatgaactctctcacagctgccgacaccgcggtctactattgtgctagaaagggcgagttctactatggctacgatgggtttgtgtattggggacaaggcacactggttaccgtgtccagc

SEQ ID NO: 39050 - RNA, 336 nt, synthetic construct
  misc_feature 1..336: note = derived and/or modified sequence opt5 from Tefibazumab_LightChain1
  source 1..336: mol_type = other RNA
gacatcgtgatgacccagagccccgattccctggccgtctctctcggcgagagagttacaatgaactgcaagagctcccaatctgtgctgtacagctccaatcagaaaaactatcttgcttggtaccagcagaagcctgggcaatctccgaaactgctcatttattgggccagcacgcgggaatccggagtgcccgaccgcttcagcggctctgggtccggaaccgattttacactgaccatcagctctgtccaggcggaggaccttgctgtgtactattgtcaccagtacctgtccagctatacattcggcgggggaaccaagctcgaaattaaa

SEQ ID NO: 39051 - RNA, 1368 nt, synthetic construct
  misc_feature 1..1368: note = derived and/or modified sequence opt5 from Tenatumomab_HeavyChain1
  source 1..1368: mol_type = other RNA
gagatccagctgcaacagagcggccccgaactcgtgaagcctggggcctccgtcaaagtttcttgcaaggctagcggatacgccttcacctcctataacatgtactgggtgaaacagtctcacggcaagagcctggagtggattgggtatatcgacccgtacaatggagtgacatcctataaccagaaatttaagggcaaggcgacgcttaccgtcgataaatctagctccacagcttacatgcatctgaatagcctcacctctgaagactccgccgtgtattactgtgccagagggggaggcagcatttactatgctatggattactggggccaagggacatctgttaccgtgtccagcgccaagacaacgcccccttctgtctatcccctggctcctggatgcggcgacaccaccgggtccagcgtgacacttggatgtctggttaaaggctacttccccgagtccgtgaccgtcacatggaactctgggagcctctccagctctgtgcacacctttcctgccctgctgcagtccggactctatacgatgagctctagcgtgacagtcccgtcctctacctggcccagccagacagttacctgctccgtggcgcatcctgccagctctaccacagtggataagaaactggaaccctccggccctatcagcacgattaatccctgtccgccttgcaaggagtgtcacaagtgccccgctcctaaccttgagggcgggccctctgtcttcatctttccccctaatatcaaagacgtgctgatgatttccctcaccccgaaggttacatgtgtggtcgtggatgttagcgaagacgatcccgacgtgcagatctcctggttcgtcaacaatgtggaggtccataccgcccaaacacagacccaccgggaagattacaactctacgattcgcgtggttagcacactgcctatccagcaccaggactggatgtccggaaaagagtttaagtgcaaagtgaataacaaggatcttccctctcctattgagagaaccatcagcaaaattaagggcctggtccgggctccccaagtgtatatcctcccgcctcccgccgaacagctgtcccgcaaggacgttagcctgacctgtctcgtggtcgggttcaatcctggagacatctctgtggagtggacatccaacggccataccgaagagaattacaaagatacagcgcccgtgctggacagcgatgggtcttactttatttattccaaacttaacatgaaaacgagcaagtgggaaaagaccgactctttcagctgcaacgttagacacgagggactgaagaattactatctcaagaaaacaatctcccggagccctggcaag

SEQ ID NO: 39052 - RNA, 657 nt, synthetic construct
  misc_feature 1..657: note = derived and/or modified sequence opt5 from Tenatumomab_LightChain1
  source 1..657: mol_type = other RNA
gacatcgtgatgacccaggccgctcccagcgtccctgttacaccgggcgagtccgtgtctattagctgcagatcctctaagagcctgctccactccaacgggaatacgtacctgtattggttccttcaacggcccggacagtctcctcagctgctcatctaccgcatgagcaacctggcctccggcgtgcccgatagatttagcgggtctggatccggcaccgcgttcacacttcggattagccgcgtcgaagctgaggacgtgggggtttattactgtatgcagcatctggaatatcctctcacctttggagccggcacaaaactggagctgaagagagccgatgctgcccccaccgtgtctatcttccctccgtccagcgaacaactcacatctggcggggcttccgtcgtgtgctttctgaataacttctaccccaaagacattaatgttaagtggaaaatcgatggaagcgagcggcagaacggcgtgcttaattcctggaccgaccaggattctaaggacagcacgtattccatgagctctaccctgacactcaccaaggatgagtacgaacgccacaactcctacacatgtgaggccacccataaaacgagcacatctcctatcgtcaagagctttaatagaaacgaatgc

SEQ ID NO: 39053 - RNA, 1356 nt, synthetic construct
  misc_feature 1..1356: note = derived and/or modified sequence opt5 from Teneliximab_HeavyChain1
  source 1..1356: mol_type = other RNA
cagatccaactggtgcagagcggccccgagctcaagaaacctggggaaaccgtcagaatttcctgcaaggcctctggatacgctttcacaacgaccggcatgcagtgggttcaggagatgccggggaaaggactgaagtggatcggctggattaacacacacagcggggtgcccaaatatgtggaagactttaagggacggttcgccttttcccttgagacctctgcgaatacagcttacctgcaaatcagcaacctcaagaatgaagataccgccacatatttctgtgtccgctccggcaacggcaattacgacctggcctattttgcttactgggggcagggaacccttgtgacggtttctgccgctagcaccaaaggcccttccgtgttccccctggcccctagctctaagtccacaagcgggggaaccgcggccctcggctgcctggtcaaagattattttcccgagcctgtgacagtttcttggaactccggggctctgaccagcggagtgcatacgttcccggccgtcctccagtcttccggcctgtacagcctttcctctgtggtgacagtccccagctccagcctgggcacccagacatacatttgtaatgttaaccacaagccttctaataccaaagtggacaagaaggtggagcccaaatcctgcgataagacccatacatgtcctccctgcccggctcctgaactccttgggggacccagcgtctttctgttccctcccaaacccaaggacacgctgatgatctctagaacccctgaggtgacatgtgttgtggtcgatgtgagccacgaagacccggaggttaaatttaactggtatgtggatggcgtcgaggtgcataatgccaagaccaaaccccgggaggaacaatacaactccacatatcgcgtcgtgtctgttctcaccgtgctgcaccaggactggctgaatgggaaggaatacaagtgcaaagtcagcaacaaggcgctccctgcccccatcgagaaaacgatttccaaggctaaaggacagcctagagaaccccaggtgtatacactgccgcctagccgggatgagcttaccaagaatcaagtttctctgacctgtctcgtgaagggcttctacccctccgacatcgccgtcgagtgggaaagcaacgggcagcctgagaacaattataaaacaacaccccctgtgctggattctgacggatcctttttcctttacagcaagctgaccgtggacaaatcccgctggcagcaaggcaacgttttctcttgcagcgtcatgcacgaagctctccataatcactacacgcagaagtccctgtctctgagccccggcaaa

SEQ ID NO: 39054 - RNA, 642 nt, synthetic construct
  misc_feature 1..642: note = derived and/or modified sequence opt5 from Teneliximab_LightChain1
  source 1..642: mol_type = other RNA
gacatcgtgctgacccagagccccgccacactctccgtcacgcctggcgatagagtttctctgagctgccgggcttcccaatctattagcgactaccttcactggtatcagcagaagtcccatgagtctccgcgcctgctcatcaaatacgccagccactccattagcgggatcccctctagattctccggaagcggctctgggtccgattttaccctgagcattaactctgtggaacctgaggacgtgggaatctattactgtcagcatggccactccttcccctggacatttgggggaggcaccaaacttgaaatcaagcggacagtcgcggctcctagcgtgttcatttttcccccttccgatgagcaactgaagtctggcaccgccagcgttgtgtgcctcctgaataacttctatccgcgcgaagccaaagtccagtggaaggtggacaatgctctgcagtccgggaacagccaggagtctgttacagagcaagattccaaggacagcacctactctctcagctccacgctgaccctttctaaagccgattatgaaaagcataaagtgtacgcttgtgaggtcacacaccagggactgagctcccccgtgaccaagagctttaatagaggcgaatgc

SEQ ID NO: 39055 - RNA, 1347 nt, synthetic construct
  misc_feature 1..1347: note = derived and/or modified sequence opt5 from Teplizumab_HeavyChain1
  source 1..1347: mol_type = other RNA
caggtgcaactggtccagagcggcgggggagttgtgcagcccggcagatccctccggctgtcttgcaaggccagcgggtacaccttcacacgctatacgatgcactgggtgagacaggctcctggaaaaggccttgagtggatcgggtacattaacccgtcccggggatataccaattacaaccaaaaggtcaaagaccgctttacaatctctagagataatagcaagaacaccgccttcctgcagatggactccctccggcccgaagatacaggcgtgtatttttgtgcgcgctactatgacgatcattactgcctggactactggggccaggggacccctgttacagtgtctagcgcttccaccaaaggacccagcgtcttccctcttgccccctcttccaagagcacgtctggcgggaccgccgctctgggatgtctcgtgaaggattattttcctgagccggttacagtgtcctggaatagcggcgccctgacctctggggtccacacattccccgctgtgctgcagtccagcggactctactccctgtctagcgtggtcaccgttccttccagctctcttggcacgcaaacatatatttgcaacgtgaatcataaaccctccaacaccaaggtggacaaaaaggtcgaacctaaaagctgtgataagacacacacctgtcccccgtgccctgcccccgaggcggccggcgggccttctgtgtttctgttccctcccaagcccaaagacaccctcatgatcagcagaacaccggaagttacgtgcgtggtcgtggatgtttcccatgaggaccccgaggtgaagtttaattggtacgtcgatggagtggaagtccacaacgctaaaaccaagcctcgggaggaacagtataattctacataccgcgtggttagcgtgctgaccgtccttcaccaggactggctgaacggcaaagagtataagtgtaaagtgtccaataaggccctccccgctcctattgagaagacaatcagcaaagccaaggggcagcccagagaaccgcaagtttacaccctgcctccctctcgggacgagctgacgaaaaaccaggtgtccctcacatgcctggtcaagggattctaccctagcgatatcgcggtggaatgggagtctaatggccagcccgaaaacaactataaaaccacccctcccgtgcttgactccgatgggagctttttcctgtactccaagctcacagttgacaagtctcgctggcaacagggaaatgtctttagctgttccgtgatgcatgaggccctgcacaaccattatacccagaaatctcttagcctgtccccgggcaag

SEQ ID NO: 39056 - RNA, 639 nt, synthetic construct
  misc_feature 1..639: note = derived and/or modified sequence opt5 from Teplizumab_LightChain1
  source 1..639: mol_type = other RNA
gacatccagatgacccaaagcccctcctctctgagcgcctccgtgggcgatagagtcacaattacgtgctctgctagctcctctgttagctacatgaactggtatcagcagacccctgggaaggccccgaaacggtggatctacgacacatccaagctcgcgagcggagtgccctctcgcttctccggcagcgggtctggaaccgattatacatttaccatttccagcctgcagcctgaggacatcgctacatactattgtcaacagtggtcttccaatcccttcacctttggccaggggacgaaacttcagattaccagaacagtggccgcccctagcgtcttcatctttcccccttccgatgaacaactgaagtctggaaccgctagcgtggtttgcctcctgaacaatttctacccgcgggaggccaaagtgcagtggaaggtcgacaacgcccttcagtccggcaatagccaggaatctgtgacagagcaagattccaaggacagcacctattctctgagctccacgctcacactgtctaaagctgattacgaaaagcacaaagtttacgcgtgtgaggtgacccatcagggcctgagctcccccgtcacaaagagctttaaccgcggggagtgc

SEQ ID NO: 39057 - RNA, 1344 nt, synthetic construct
  misc_feature 1..1344: note = derived and/or modified sequence opt5 from Teprotumumab_HeavyChain1
  source 1..1344: mol_type = other RNA
caggtggagctggtcgaaagcggcgggggagttgtgcaacccggcagatcccagcggctctcttgcgccgctagcgggttcaccttttcctcttacggaatgcactgggtgcgccaggcccctggcaaggggctggagtgggtcgcgatcatttggttcgacggaagctccacatattacgctgattctgtgagaggccggtttacgatcagccgcgacaactccaaaaataccctttatctgcagatgaacagcctcagagccgaagatacagccgtttacttctgtgctcgggagctgggccgcagatattttgacctttgggggcggggaaccctggtgtctgtctccagcgcctctacaaagggcccgtccgtgttccccctcgctcctagctctaaatccaccagcgggggaacagccgcgctgggctgcctggttaaggattactttcccgaacctgtgaccgtctcctggaactctggggccctcacgagcggagtgcataccttccccgctgtgctgcaatccagcggcctttattctctgtccagcgtcgttacagtgccttctagctccctcggcacccagacatacatttgtaatgtgaatcacaaaccgtctaacaccaaggtcgacaagaaagtggagcccaagagctgcgataaaacgcatacatgtcctccctgccctgcccccgagctgcttgggggaccgtccgtttttctgttccctcccaagcctaaagacaccctcatgatcagccgcacacccgaagtgacctgtgtcgtggttgatgtgtctcacgaggaccccgaagtcaagtttaattggtacgtggatggcgtcgaggtgcataacgctaagaccaaacctagagaggaacagtataattccacataccgggttgtgagcgtcctgacggtgctgcaccaggactggctcaacgggaaggagtataaatgcaaggtttctaataaagccctgccggcgcccattgaaaagaccatctccaaagccaagggacaacctcgcgagccccaggtgtacacacttcctcccagcagagatgaactgaccaagaaccaggtctccctcacatgtctggtgaaaggcttctatccgtctgacatcgctgtggagtgggagagcaatgggcagcctgaaaacaattacaagaccacgccccctgttcttgactccgatggatctttctttctgtatagcaaactcacagtcgacaagtcccggtggcaacagggcaacgtgttcagctgctctgtgatgcacgaggccctgcataaccactacacccagaaatccctgagcctctctcccggcaag

SEQ ID NO: 39058 - RNA, 645 nt, synthetic construct
  misc_feature 1..645: note = derived and/or modified sequence opt5 from Teprotumumab_LightChain1
  source 1..645: mol_type = other RNA
gagatcgtgctgacccagagccccgccacactctccctgtctcctggcgaaagagctacgcttagctgccgggcctcccaatctgtcagctcctacctggcgtggtatcagcagaagccggggcaggctccccgcctcctgatttacgacgcctctaaaagagccaccggaatccctgctcggttcagcggctccgggagcggaacagattttacccttacaatttcttccctggagcccgaagacttcgccgtttattactgtcaacagcgcagcaagtggcctccctggacctttggccaggggacaaaagtggagtctaagagaaccgtggctgccccttccgtcttcatctttccgcccagcgatgaacagctcaaatctggaacggcgtccgtggtttgcctgctgaacaatttctatcctcgggaggccaaggtgcaatggaaggtcgacaacgctctccagagcggcaattcccaggagtctgtgaccgaacaggatagcaaagactccacatacagcctgtcttccacccttacactgagcaaggccgattatgagaaacacaaggtttacgcttgtgaagtgacccatcaaggcctctctagccccgtcacgaaatcctttaaccgcggggagtgc

SEQ ID NO: 39059 - RNA, 1338 nt, synthetic construct
  misc_feature 1..1338: note = derived and/or modified sequence opt5 from Tesidolumab_HeavyChain1
  source 1..1338: mol_type = other RNA
gaggtgcagctggtccaaagcggcgctgaagttaagaaacccgggtcctctgtgaaggtgagctgcaaggcttccggaggcaccttctctagctacgccatctcctgggtcagacaggcgcctgggcagggactcgagtggatgggcgggattggaccgtttttcggcacagctaactatgcccagaaatttcaaggccgggtgacgatcaccgccgacgaatctacaagcaccgcttacatggagctgtccagccttcgctctgaagatacagccgtttattactgtgctagagacaccccctatttcgattactgggggcagggaacactggtgaccgtctccagcgcctctacgaaaggcccttccgtgtttcccctcgcgcctagctctaagtccaccagcgggggaacagccgctctgggctgccttgttaaggactatttccccgagcctgtgaccgtctcctggaactctggggccctgacaagcggagtgcacacctttccggctgtgctccagtccagcggcctgtactctctgtccagcgtcgttacggtgccctctagctccctcggcacacagacctacatttgtaatgtgaatcataaaccttctaacacaaaggtcgataaacgggtggagcccaagagctgcgacaaaacccacacctgtcctccctgcccggcccctgaagcggccgggggaccctccgttttcctgtttcctcccaagcccaaggatacacttatgatcagccgcacgcctgaggtgacctgtgtcgtggttgacgtgtctcatgaagatccggaggtcaaattcaattggtatgtggacggcgtcgaggtgcacaacgctaagacaaaacccagagaggaacaatacaattccacctatcgggttgtgagcgtcctgacagtgctccatcaggattggctgaacgggaaggaatacaaatgcaaggtttctaataaagcccttcctgctcccattgagaagaccatctccaaggccaaaggacagcctcgcgaaccccaggtgtatacgctgccgcctagcagagaggagatgacaaagaaccaagtctccctcacctgtctggtgaaaggcttttacccctctgacatcgccgtggaatgggagagcaatgggcagcctgaaaacaattataagaccacaccccctgttctggattccgacggatctttctttctctacagcaaactgaccgtcgacaagtcccggtggcagcaaggcaacgtgttcagctgctctgtgatgcacgaggcccttcacaatcattacacacagaagtccctgagcctctctcccggcaaa

SEQ ID NO: 39060 - RNA, 642 nt, synthetic construct
  misc_feature 1..642: note = derived and/or modified sequence opt5 from Tesidolumab_LightChain1
  source 1..642: mol_type = other RNA
agctacgagctgacccagcccctctccgtgtctgtcgccctgggccaaacagctagaatcacgtgcagcggggactccattcctaactattacgtttattggtaccagcagaagccgggacaggcccccgtgcttgtgatctatgatgactctaatcggcctagcggcattcccgaacgcttctccgggtctaacagcggaaataccgcgacactgaccatctccagagctcaagccggcgatgaggccgactactattgtcagagctttgattcttccctcaacgctgaagtcttcgggggaggcacaaaactgaccgtgcttggccagcctaaggccgctcccagcgttacactgtttcctccgtcttccgaggaactccaggccaataaagcgaccctggtgtgcctgattagcgacttctaccccggggccgtcacggtggcttggaaggccgattcttcccctgttaaagctggagtggagaccacaacccccagcaagcaatccaacaataagtacgccgcgtctagctatctctccctgacacctgagcagtggaaaagccaccggtcttactcctgtcaggtcacccatgaaggcagcacggtggagaagacagtggcccccaccgaatgctct

SEQ ID NO: 39061 - RNA, 1344 nt, synthetic construct
  misc_feature 1..1344: note = derived and/or modified sequence opt5 from Tezepelumab_HeavyChain1
  source 1..1344: mol_type = other RNA
cagatgcaactggtggagagcggcgggggagtcgttcagcccggcagatccctccggctgtcttgcgccgctagcgggttcacctttcgcacatacggaatgcactgggtgagacaggcccctggcaaggggcttgaatgggtggcggtcatctggtatgacggatccaacaaacattacgctgattctgtgaagggccggttcacgattacccgcgacaatagcaaaaacacactgaatctccagatgaactccctgagagccgaggataccgccgtttattactgtgctcgggccccgcaatgggaacttgtgcacgaggcttttgacatctggggccaggggacaatggtcaccgtgtctagcgcctccacaaagggacccagcgttttccctctggcgccctgctctcgctccaccagcgaatctacggccgctctcggctgtctggtgaaagattattttcctgagcccgtcaccgtgtcctggaatagcggggccctgacatctggagtgcataccttccctgctgtcctccagtccagcggcctgtactccctttctagcgttgtgacagtgccgtccagcaactttgggacccagacgtatacatgcaatgtcgaccacaagccctctaacaccaaggtggataaaacagttgagagaaagtgttgcgtggaatgtcctccctgccctgcgcccccggtcgccggaccttccgtgttcctgtttccccctaaacccaaggacaccctcatgattagccggacccccgaggttacatgtgtggtcgtggatgtctctcatgaagaccctgaggtgcaattcaattggtacgttgatggcgtggaggtccacaacgccaaaacgaagccgcgcgaggaacagtttaatagcaccttcagagtggtttccgtgctgacagtcgtgcaccaggactggcttaacggcaaggaatacaaatgcaaggtgtctaataaagggctgcccgctcctatcgagaagaccattagcaaaacaaagggacagccccgggaacctcaagtttataccctgcccccgtcccgcgaggagatgacgaaaaaccaggtcagcctcacatgtctggtgaagggcttttacccttctgatatcgccgtggaatgggagtccaatgggcagcccgaaaacaactataagaccacccctcccatgctcgacagcgacggatctttcttcctgtactccaaacttacagtcgataagagcagatggcaacagggcaatgtgttttcctgctctgttatgcatgaggctctgcacaaccattatacccagaaaagcctctccctgtctcctgggaag

SEQ ID NO: 39062 - RNA, 642 nt, synthetic construct
  misc_feature 1..642: note = derived and/or modified sequence opt5 from Tezepelumab_LightChain1
  source 1..642: mol_type = other RNA
agctacgtgctgacccagcccccttccgtctctgttgccccgggccaaacagctagaatcacgtgcgggggaaacaatctcggcagcaagtccgtgcactggtatcagcagaaacccgggcaggcccctgtgctggtcgtgtacgacgattctgaccggcccagctggattcctgagcgcttctccggatctaacagcggcaataccgcgacacttaccatctccagaggggaagctggagatgaggccgactattactgtcaagtttgggatagcagctccgaccatgtggtctttggcggcgggacaaagctgaccgtgctcggacagcccaaagccgctcctagcgttacactgttcccgccctcttccgaagaacttcaggccaacaaggctaccctggtgtgcctcattagcgatttttatcctggcgccgtcacggtggcgtggaaagccgactcttcccccgtgaaggctggggtcgaaaccacaacccctagcaagcagtccaataacaaatacgccgcttctagctatctgtccctgacacccgagcaatggaagtctcaccggtcttactcctgtcaggttacccatgagggaagcacggtggagaaaacagtggccccgaccgagtgctct

SEQ ID NO: 39063 - RNA, 1338 nt, synthetic construct
  misc_feature 1..1338: note = derived and/or modified sequence opt5 from ThioMAb-chMA79b-HC(A118C)_HeavyChain
  source 1..1338: mol_type = other RNA
gaggtgcagctgcaacagagcggcgccgaactcatgaagcccggggcttccgtcaaaatctcttgcaaggccaccggatacacattcagctcctattggattgagtgggttaaacagagacctggccacgggctggaatggatcggagagattcttccgggcgggggagacacgaactacaatgaaatctttaagggcaaagcgaccttcacagctgatacctctagcaacacagcctatatgcagctgtcctctctcaccagcgaggactccgccgtgtactattgtacacggcgcgtgcccgtctactttgattattggggccaagggaccagcgtgacggtttcttcctgcagcaccaagggaccttctgtgttccccctggctccttccagcaagtctacatccggcgggaccgccgctcttggatgtctggtcaaagactactttcccgagcctgtgacagttagctggaactccggcgccctcacctctggggtgcatacgttcccggcggtcctgcagagctccggactgtacagcctctcttccgtggtgacagtccccagctctagcctgggcacccagacatatatttgcaatgttaatcacaagccttccaacaccaaagtggataagaaagtggaacccaagtcttgtgacaagacccatacatgccctccctgtccggcccctgagcttctgggcgggcccagcgtctttctcttccctcccaaacccaaggatacgctgatgatctccagaacccctgaagtgacatgcgttgtggtcgacgtgagccacgaggatccggaggttaaatttaattggtacgtggacggagtcgaagtgcataacgctaagaccaaaccccgggaggaacagtataattctacataccgcgtcgtgtccgttcttaccgtgctgcaccaagattggctcaacggcaaggagtataaatgtaaggtcagcaataaggccctgcctgctcccatcgagaaaacgatttctaaggccaaagggcagcctagagaaccccaggtgtacacactgccgccttcccgggaggaaatgaccaagaaccaggttagcctgacctgcctcgtgaaaggattctatccctccgacatcgcggtcgagtgggaatctaatggccaacctgagaacaattacaagacaacaccccctgtgcttgatagcgacgggtcctttttcctgtactctaagctcaccgtggacaaaagccgctggcagcagggaaacgtcttttcctgtagcgttatgcacgaagccctgcataaccactatacgcaaaagtctctttccctgagccccggc

SEQ ID NO: 39064 - RNA, 1347 nt, synthetic construct
  misc_feature 1..1347: note = derived and/or modified sequence opt5 from ThioMab-hu10A8.v1-HC(A118C)_HeavyChain
  source 1..1347: mol_type = other RNA
gaggtgcagctggtcgaaagcggcgggggactcgttcaacccggcgggtccctgagactttcttgcgccgctagcggattcaccttttcctcttacgccgtgagctgggtgcggcaggcgcctggcaaggggctggagtgggtcgctacaatctcctctggaggcagcctcacgttctatctggactccgtgcgcggcagatttaccattagccgggataactctaaaaatacactttacctgcagatgaactccctccgcgccgaagacaccgccgtttattactgtgctagaccgatccccgattattacgccctggactattgggggcagggaacactggtgaccgtcagctcttgctccacaaagggccctagcgtgttccccctcgctccttcttccaaaagcacctccgggggaacggccgcgctgggctgtcttgttaaggattactttcccgagcctgtgaccgtctcttggaatagcggggccctgacatccggagtgcacaccttcccggctgtgctccaaagctctggcctgtactcccttagctctgtcgttacagtgcccagctcctctctgggcacccagacgtatatttgcaacgtgaatcataaacctagcaacacaaaggtcgacaagaaagtggaacccaagtcctgtgataaaacccacacatgccctccctgtccggcccctgagctcctgggaggacccagcgtttttctgttccctcccaagcccaaagacaccctcatgatctctcggacccctgaggtgacatgcgtcgtggttgatgtgtcccatgaagacccggaggtcaagtttaattggtacgtggatggcgtcgaagtgcacaacgctaagacgaaaccccgcgaggagcagtataatagcacctacagagttgtgtctgtcctgacagtgcttcatcaggactggctgaacgggaaggaatataaatgtaaggtttccaataaagccctccctgcgcccattgagaagaccatcagcaaagccaagggacaacctcgggaaccccaggtgtacacactgccgccttcccgcgaggaaatgaccaagaaccaggtctctcttacgtgcctggtgaaaggcttctatcccagcgatatcgctgtggagtgggagtccaatgggcagcctgaaaacaattacaagacaacaccccctgttctcgactctgacgggagctttttcctgtactccaaactgaccgtcgataagagcagatggcaacagggcaacgtgttttcttgttccgtgatgcacgaggccctccacaaccattatacccagaaaagcctgtctctttcccccggcaag

SEQ ID NO: 39065 - RNA, 1347 nt, synthetic construct
  misc_feature 1..1347: note = derived and/or modified sequence opt5 from ThioMab-hu10A8.v1-HC(V205C)_HeavyChain
  source 1..1347: mol_type = other RNA
gaggtgcagctggtcgaaagcggcgggggactcgttcaacccggcgggtccctgagactttcttgcgccgctagcggattcaccttttcctcttacgccgtgagctgggtgcggcaggcgcctggcaaggggctggagtgggtcgctacaatctcctctggaggcagcctcacgttctatctggactccgtgcgcggcagatttaccattagccgggataactctaaaaatacactttacctgcagatgaactccctccgcgccgaagacaccgccgtttattactgtgctagaccgatccccgattattacgccctggactattgggggcagggaacactggtgaccgtcagctctgcttccacaaagggccctagcgtgttccccctcgccccttcttccaaaagcacctccgggggaacggcggccctgggctgccttgttaaggattactttcccgagcctgtgaccgtctcttggaatagcggggctctgacatccggagtgcacaccttcccggccgtgctccaaagctctggcctgtactcccttagctctgtcgttacagtgcccagctcctctctgggcacccagacgtatatttgtaacgtgaatcataaacctagcaacacaaaggtcgacaagaaagtggaacccaagtcctgcgataaaacccacacatgtcctccctgcccggctcctgagctcctgggaggacccagcgtttttctgttccctcccaagcccaaagacaccctcatgatctctcggacccctgaggtgacatgtgtcgtggttgatgtgtcccatgaagacccggaggtcaagtttaattggtacgtggatggcgtcgaagtgcacaacgccaagacgaaaccccgcgaggagcagtataatagcacctacagagttgtgtctgtcctgacagtgcttcatcaggactggctgaacgggaaggaatataaatgcaaggtttccaataaagcgctccctgcccccattgagaagaccatcagcaaagctaagggacaacctcgggaaccccaggtgtacacactgccgccttcccgcgaggaaatgaccaagaaccaggtctctcttacgtgtctggtgaaaggcttctatcccagcgatatcgccgtggagtgggagtccaatgggcagcctgaaaacaattacaagacaacaccccctgttctcgactctgacgggagctttttcctgtactccaaactgaccgtcgataagagcagatggcaacagggcaacgtgttttcttgctccgtgatgcacgaggctctccacaaccattatacccagaaaagcctgtctctttcccccggcaag

SEQ ID NO: 39066 - RNA, 642 nt, synthetic construct
  misc_feature 1..642: note = derived and/or modified sequence opt5 from ThioMab-hu10A8.v1-LC(A118C)_LightChain
  source 1..642: mol_type = other RNA
gacatccagatgacccaaagcccctcctctctgagcgcctccgtgggcgatagagtcacaattacgtgcaaggcttctcaggacgttagcaccgccgtggcgtggtaccagcagaaacctgggaaggctccgaaactcctgatctattccgcctcttaccggtatacaggagtgcccagccgcttctccggcagcgggtctggaaccgattttacacttaccatttccagcctgcaacctgaggacttcgccacatactattgtcagcagcacttttcttcccccagaaccttcggccaggggacgaaggtcgaaatcaaacggaccgtggctgcccctagcgtttttatttttcccccttctgatgagcaactcaagtccggaacagctagcgtggtctgcctgcttaacaatttctacccgcgcgaagccaaggtgcagtggaaagttgacaacgcgctgcagtccggcaattctcaggagagcgtgaccgaacaagattccaaggacagcacatattctctctccagcaccctgacgctgtctaaagccgattacgagaagcataaagtctacgcttgtgaggtgacacaccagggcctcagctcccccgtgaccaagtctttcaacagaggggaatgc

SEQ ID NO: 39067 - RNA, 642 nt, synthetic construct
  misc_feature 1..642: note = derived and/or modified sequence opt5 from ThioMab-hu10A8.v1-LC(V205C)_LightChain
  source 1..642: mol_type = other RNA
gacatccagatgacccaaagcccctcctctctgagcgcctccgtgggcgatagagtcacaattacgtgcaaggcttctcaggacgttagcaccgccgtggcgtggtaccagcagaaacctgggaaggctccgaaactcctgatctattccgcctcttaccggtatacaggagtgcccagccgcttctccggcagcgggtctggaaccgattttacacttaccatttccagcctgcaacctgaggacttcgccacatactattgtcagcagcacttttcttcccccagaaccttcggccaggggacgaaggtcgaaatcaaacggaccgtggctgcccctagcgtttttatttttcccccttctgatgagcaactcaagtccggaacagctagcgtggtctgcctgcttaacaatttctacccgcgcgaagccaaggtgcagtggaaagttgacaacgcgctgcagtccggcaattctcaggagagcgtgaccgaacaagattccaaggacagcacatattctctctccagcaccctgacgctgtctaaagccgattacgagaagcataaagtctacgcttgtgaggtgacacaccagggcctcagctccccctgcaccaagtctttcaacagaggggaatgt

SEQ ID NO: 39068 - RNA, 1338 nt, synthetic construct
  misc_feature 1..1338: note = derived and/or modified sequence opt5 from ThioMAb-huMA79b.v17-HC(A118C)_HeavyChain
  source 1..1338: mol_type = other RNA
gaggtgcagctggtcgaaagcggcgggggactcgttcaacccggcgggtccctgagactttcttgcgccgctagcggatacaccttctcctcttattggatcgagtgggtgcggcaggcccctggcaaggggctggaatggattggagagatcctcccgggcggcggggacacaaactacaatgaaatttttaaaggacgcgcgacgttcagcgctgatacctccaagaacacagcctatctgcagatgaatagccttagagccgaggacaccgctgtgtactattgtacacggcgcgtccccgtgtactttgattattggggccaggggaccctggttacagtgagctcctgcagcaccaaaggaccttctgtcttccccctcgccccttccagcaagtctacgtccggcgggaccgctgccctgggatgtctggtgaaagactactttcccgagcctgttacagtgagctggaactctggcgcgctcacctccggcgtccacacattcccggccgtgctgcaaagctccgggctttactctctgagctccgtggtcaccgttccctcttcttccctcggaacgcagacatatatctgcaatgtgaaccataagcctagcaataccaaggtggataaaaaggtcgaacccaaatcttgtgacaagacacatacctgccctccctgtccggctcctgagctgcttggcgggcccagcgtgtttctgttccctcccaaacccaaggataccctcatgatttccagaacacctgaagttacgtgcgtggtcgtggacgtttctcacgaggatccggaggtgaagtttaactggtacgtcgacggagtggaagtccacaatgccaaaaccaagccccgggaggaacagtataacagcacataccgcgtggtttccgtgctgaccgtcctgcatcaggattggctcaatggcaaagagtataagtgtaaagtgagcaacaaggctctgcctgcccccatcgaaaagacaatctctaaggcgaaggggcaacctagagagccccaggtttacacccttccgccttcccgggaggaaatgacgaaaaatcaggtgagcctgacatgcctcgtcaagggattctatccctctgacattgccgtggagtgggaatccaacggccagcctgagaataactacaaaaccacaccccctgtgctggatagcgacggctcctttttcctttactctaagctgaccgttgacaaaagccgctggcaacaggggaacgtcttttcctgttctgtgatgcacgaagctctccacaatcattatacccagaaaagcctgtccctgagccccgga

SEQ ID NO: 39069 - RNA, 654 nt, synthetic construct
  misc_feature 1..654: note = derived and/or modified sequence opt5 from ThioMAb-huMA79b.v17-HC(A118C)_LightChain
  source 1..654: mol_type = other RNA
gacatccagctgacccaaagcccctcctctctcagcgcctccgtgggcgatagagtcacaattacgtgcaaggcttctcagagcgttgactacgatggggactccttcctgaactggtatcagcagaaacctggaaaggccccgaaacttctgatctacgcggcttctaatctcgagagcggcgtgccctcccggtttagcgggtctggatccggcaccgatttcacactgaccattagctctcttcaacctgaagactttgccacatattactgtcagcagtccaacgaggatcccctgaccttcgggcagggaacaaaggtggaaatcaaacgcaccgtcgccgctcctagcgtgtttatttttcccccttctgacgagcaactcaagtccggcacggccagcgttgtgtgcctgctgaataacttctatccgagagaagctaaggtccagtggaaagtggataatgccctccagtccggcaactctcaggagagcgttaccgagcaagactccaaggatagcacatactctctgtccagcacccttacactgtctaaagcggactatgaaaagcacaaagtgtacgcctgtgaggtcacccatcaggggctcagctcccccgtgacgaagtctttcaatcggggagaatgc

SEQ ID NO: 39070 - RNA, 1338 nt, synthetic construct
  misc_feature 1..1338: note = derived and/or modified sequence opt5 from ThioMAb-huMA79b.v18-HC(A118C)_HeavyChain
  source 1..1338: mol_type = other RNA
gaggtgcagctggtcgaaagcggcgggggactcgttcaacccggcgggtccctgagactttcttgcgccgctagcggatacaccttctcctcttattggatcgagtgggtgcggcaggcccctggcaaggggctggaatggattggagagatcctcccgggcggcggggacacaaactacaatgaaatttttaaaggacgcgcgacgttcagcgctgatacctccaagaacacagcctatctgcagatgaatagccttagagccgaggacaccgctgtgtactattgtacacggcgcgtccccatcagactggattactggggccaggggaccctcgtgacagttagctcctgcagcaccaaaggaccttctgtgtttcccctggccccttccagcaagtctacgtccggcgggaccgctgccctgggatgtctcgtcaaagactatttccccgagcctgtgacagttagctggaactctggcgcgctgacctccggcgtgcacacatttccggccgtccttcaaagctccgggctgtactctctcagctccgtggtgaccgtcccctcttcttccctgggaacgcagacatacatttgcaatgttaaccataagcctagcaataccaaggtggataaaaaggtggaacccaaatcttgtgacaagacacatacctgccctccctgtccggctcctgagcttctgggcgggcccagcgtcttcctctttcctcccaaacccaaggataccctgatgatctcccggacacctgaagtgacgtgcgttgtggtcgacgtgtctcacgaggatccggaggttaagttcaactggtatgtggacggagtcgaagtgcacaatgccaaaaccaagccccgcgaggaacagtacaacagcacatatagagtcgtgtccgttctgaccgtgctccatcaggattggctgaatggcaaagagtacaagtgtaaagtcagcaacaaggcccttcctgctcccatcgaaaagacaatttctaaggcgaaggggcaacctcgggagccccaggtgtataccctgccgccttcccgcgaggaaatgacgaaaaatcaggttagcctcacatgcctggtgaagggattttacccctctgacatcgccgtcgagtgggaatccaacggccagcctgagaataactataaaaccacaccccctgtgcttgatagcgacggctccttctttctgtactctaagctcaccgtggacaaaagcagatggcaacaggggaacgttttctcctgttctgtcatgcacgaagctctgcacaatcattacacccagaaaagcctgtccctcagccccgga

SEQ ID NO: 39071 - RNA, 654 nt, synthetic construct; identical to SEQ ID NO: 38915
  misc_feature 1..654: note = derived and/or modified sequence opt5 from ThioMAb-huMA79b.v28-HC(A118C)_LightChain
  source 1..654: mol_type = other RNA

SEQ ID NO: 39072 - RNA, 654 nt, synthetic construct
  misc_feature 1..654: note = derived and/or modified sequence opt5 from ThioMAb-huMA79b.v28-LC(V205C)_LightChain
  source 1..654: mol_type = other RNA
gacatcgtgctgacccagagccccgcctccctcgctgtctctctgggccaaagagccacaattagctgcaaggcgtcccagtctgttgattacgacggggatagcttccttaactggtatcagcagaaacctggacaaccgcccaagctgtttatctacgctgcctccaatctcgagtctggcattcctgcccggttcagcgggtccggaagcggcacggactttaccctgaacatccaccccgtggaagaggaagatgctgccacatattactgtcagcagtctaatgaggaccctcttaccttcggggctggaacagaactggagctcaaacgcaccgtggccgcgccctccgtctttattttccctccgagcgatgagcagctgaagtctggcacagcctccgtggtttgcctgctcaacaatttttatcccagagaagctaaagtgcaatggaaggtcgacaacgccctgcagagcggcaattctcaggagtccgtgaccgaacaggatagcaaggactccacgtactctcttagctccaccctgacactcagcaaagctgattatgagaagcataaagtttacgcctgtgaggtgacccaccaagggctgtcttccccttgcacaaagagcttcaaccggggagaatgt

SEQ ID NO: 39073 - RNA, 1332 nt, synthetic construct
  misc_feature 1..1332: note = derived and/or modified sequence opt5 from Ticiliuab_HeavyChain1
  source 1..1332: mol_type = other RNA
caggtgcaactggtcgagagcggcgggggagttgtgcagcccggcagatccctccggctgtcttgcgccgctagcgggttcaccttttcctcttacggacactgggtgcgccaggcccctggcaaggggcttgaatgggtcgcggtgatctggtatgacggaagcaacaaatactatgctgattccgttaagggcagattcacaatttctcgggacaatagcaaaaacacgctgtacctccaaaattccctgcgcgccgaggataccgccgtgtattactgtgctagagacccgcggggcgccacactttattactactattacggggatgtctggggacagggcaccacagtgaccgttagctctgcttccacaaaggggcccagcgtgtttcctctggccccctgctctcgctccaccagcgaatctacggcggccctcggatgtctggtcaaagactatttccctgagcccgtgaccgtgtcctggaacagcggcgctctgacatccggggtccatacctttcctgccgttctccagtctagcggactgtactcccttagctctgtggtgacagtcccgtccagcaatttcggcacccagacgtatacatgcaacgtggatcacaagccctctaataccaaggttgacaaaacagtggaaagaaagtgttgcgtcgagtgtcctccctgccctgctcccccggtggccggccctagcgtttttctgtttccccctaaacccaaggataccctcatctcccggacccccgaggtgacatgtgtcgtggtcgacgtgtctcatgaagatcctgaggttcagttcaactggtacgtggacggggtcgaagtgcacaatgcgaaaacgaagccgcgcgaggagcaattcaacagcacctttagagttgtgtccgtcctgacagtggtgcatcaggattggcttaatggaaaggaatataaatgcaaggttagcaacaaaggcctgcccgcccctattgagaagaccatctctaaaacaaaggggcagccccgggaacctcaggtctacaccctgcccccgtcccgcgaggaaacgaaaaatcaagtgagcctcacatgtctggtgaagggattctacccttctgacattgctgtcgagtgggagtccaacggccagcccgaaaataactataagaccacccctcccctcgacagcgatgggtcctttttcctgtactctaaacttacagtggacaagagcagatggcagcaaggaaacgttttctcctgctctgtgcacgaggccctgcacaatcattatacccagaaaagcctctccctgagccctggcaag

SEQ ID NO: 39074 - RNA, 639 nt, synthetic construct
  misc_feature 1..639: note = derived and/or modified sequence opt5 from Ticiliuab_LightChain1
  source 1..639: mol_type = other RNA
gacatccagacccaaagcccctcctctctgagcgcctccgtgggcgatagagtcacaattacgtgccgggcttctcagagcatcaactcctacctcgactggtatcagcagaaacctgggaaagccccgaagctgcttatttacgcggcttctagcctgcaatccggagttcccagccgcttctctggctccgggagcggaaccgattttacactcaccatctcttccctgcagcctgaggacttcgccacatattactgtcagcagtattacagcaccccctttacattcggccctgggaccaaagtggaaattaagagaacggtggccgctccctctgtctttatcttccctccgtccgatgagcaacttaaaagcggaaccgcctccgtggtttgcctgctcaataacttttatccccgggaagctaaggtgcagtggaaggtcgacaatgccctgcagtctggcaacagccaggagtccgtgacagaacaagatagcaaagactctacctactccctgagctctacactcaccctgagcaaggcggattacgagaaacacaaggtttatgcctgtgaggtgacgcatcagggcctttcctctcctgtcacaaagagcttcaatcgcggggaatgc

SEQ ID NO: 39075 - RNA, 1347 nt, synthetic construct
  misc_feature 1..1347: note = derived and/or modified sequence opt5 from Tigatuzumab_HeavyChain1
  source 1..1347: mol_type = other RNA
gaggtgcagctggtcgaaagcggcgggggactcgttcaacccggcgggtccctgagactttcttgcgccgctagcggattcaccttttcctcttacgtgatgagctgggtgcggcaggcccctggcaaggggctggagtgggtcgcgacaatctcctctggaggcagctatacgtactatccggactccgtgaaaggccgcttcaccattagcagagataacgctaagaatacactctacctgcagatgaactctcttcgggccgaagacaccgccgtttattactgtgctcgcagaggggattccatgatcacaaccgactattggggacagggcacactggtgaccgtcagctctgcctccacgaaagggcccagcgtgtttcctctcgctccctcttccaagagcacctccggaggcacagccgcgctggggtgcctggttaaagattacttccctgagcccgtgaccgtctcttggaatagcggagccctcacatccggcgtgcacacctttcctgctgtgctgcaaagctctggcctttactccctgagctctgtcgttacggtgccgagctcctctctcgggacacagacctatatttgtaacgtgaatcataagcccagcaacacaaaggtcgacaaacgggtggaacctaagtcctgcgataaaacccacacctgtcccccttgccccgccccggagctgcttggaggccctagcgttttcctgtttccccctaagcccaaagacacactcatgatctctcgcacgcccgaggtgacctgtgtcgtggttgatgtgtcccatgaagaccctgaggtcaagttcaattggtacgtggatggggtcgaagtgcacaacgctaagacaaaaccgagagaggagcagtataatagcacctaccgggttgtgtctgtcctgacagtgctgcatcaggactggctcaacggaaaggaatataaatgcaaggtttccaataaagccctgcccgcgcctattgagaagaccatcagcaaagccaagggccaaccccgcgaacctcaggtgtacacgcttcccccgtccagagaggaaatgacaaagaaccaggtctctctgacctgtctcgtgaaagggttttatcctagcgatatcgctgtggagtgggagtccaatggacagcccgaaaacaattacaagaccacacctcccgttctggactctgacggcagcttctttctttactccaaactgaccgtcgataagagccggtggcaacagggcaacgtgttctcttgctccgtgatgcacgaggccctccacaaccattatacacagaaaagcctgtctctgtcccctgggaag

SEQ ID NO: 39076 - RNA, 1347 nt, synthetic construct; identical to SEQ ID NO: 39075
  misc_feature 1..1347: note = derived and/or modified sequence opt5 from Tigatuzumab_HeavyChain
  source 1..1347: mol_type = other RNA

SEQ ID NO: 39077 - RNA, 639 nt, synthetic construct
  misc_feature 1..639: note = derived and/or modified sequence opt5 from Tigatuzumab_LightChain1
  source 1..639: mol_type = other RNA
gacatccagatgacccaaagcccctcctctctgagcgcctccgtgggcgatagagtcacaattacgtgcaaggcttctcaggacgttgggaccgccgtggcgtggtaccagcagaaacctggaaaggctccgaaactcctgatctattgggccagcacacggcacaccggcgtgccctcccgcttctctgggagcggatccggcacagattttacccttacaattagctctctgcaacctgaggacttcgccacctactattgtcagcagtactccagctatagaacgtttgggcagggaaccaaggtcgaaatcaaacggacagtggctgccccctctgttttcatttttcctccctccgatgagcaactcaagagcggcaccgcttctgtggtctgcctgcttaacaatttctaccctcgcgaagccaaggtgcagtggaaagttgacaacgcgctgcagtccggcaatagccaggagtccgtgacagaacaagattctaaggacagcacctattccctcagctctacgctgacactgtccaaagccgattacgagaagcataaagtctacgcttgtgaggtgacccaccaggggctcagctctccggtgacaaagagctttaacagaggagaatgc

SEQ ID NO: 39078 - RNA, 639 nt, synthetic construct; identical to SEQ ID NO: 39077
  misc_feature 1..639: note = derived and/or modified sequence opt5 from Tigatuzumab_LightChain
  source 1..639: mol_type = other RNA

SEQ ID NO: 39079 - RNA, 1338 nt, synthetic construct
  misc_feature 1..1338: note = derived and/or modified sequence opt5 from Tildrakizumab_HeavyChain1
  source 1..1338: mol_type = other RNA
caggtgcaactggtccagagcggcgccgaggttaagaaacccggggcttccgtgaaggtgtcttgcaaagccagcggatacatcttcattacctattggatgacatgggtcagacaggcgcctggccaggggctcgaatggatgggacaaatctttccggcttccggctctgccgactacaacgagaagttcgaagggcgggtgacgatgaccacagataccagcacatccaccgcctatatggagctgcgctctcttagaagcgacgatacagctgtttactattgtgcccggggaggcggcgggtttgcttactggggacagggcaccctggtgacggtctccagcgcctctaccaaagggccctccgtgttccctctcgcgcccagctctaagtccacaagcggaggcaccgccgctctggggtgccttgttaaggactattttcctgaacccgtgacagtctcttggaactccggagccctgaccagcggcgtgcacacgttccctgctgtgctccagtcctctggcctgtacagcctgtccagcgtcgttacagtgccgtcttccagcctcgggacccagacatacatttgtaatgtgaatcataaaccctctaacaccaaggtcgataaaaaggtggagcctaaaagctgcgacaagacccacacatgtcccccttgccccgccccggagctgcttggaggcccttccgtttttctgtttccccctaagcccaaagatacgctcatgatctctcgcacccccgaagtgacatgtgtcgtggttgacgtgagccatgaggatcctgaagtcaagtttaattggtatgtggacggggtcgaggtgcacaacgcgaaaaccaagccgagagaggaacaatacaattccacatatcgggttgtgagcgtcctgaccgtgcttcatcaggattggctgaacggaaaagagtacaagtgcaaagtttctaataaggccctccccgctcctattgaaaagacgatctccaaagccaagggccagccccgcgagcctcaggtgtatacactgcccccgagcagagacgaactgaccaaaaaccaagtctctctcacctgtctggtgaaggggttctacccttccgatatcgctgtggagtgggagagcaatggacagcccgaaaacaattataaaacaacccctcccgttcttgactccgacggctctttcttcctgtacagcaagctcacagtcgataagtcccggtggcagcaaggcaacgtgttttcttgcagcgtgatgcacgaggccctgcacaatcattacacgcagaaatcccttagcctgtctcctgggaag

SEQ ID NO: 39080 - RNA, 642 nt, synthetic construct
  misc_feature 1..642: note = derived and/or modified sequence opt5 from Tildrakizumab_LightChain1
  source 1..642: mol_type = other RNA
gacatccagatgacccaaagcccctcctctctgagcgcctccgtgggcgatagagtcacaattacgtgccggacctctgagaacatctacagctatctcgcttggtaccagcagaagcctgggaaagccccgaagctgcttatttataatgcgaaaacactggctgaaggagttccctcccgcttctctggcagcgggtccggaaccgactttacactcaccatcagctctctgcagcctgaggatttcgccacatactattgtcaacaccattacggcattccctttaccttcgggcagggaacgaaggtggaaatcaaaagaaccgtggccgctccttccgtctttatctttccccctagcgacgagcagcttaagtctggcacagcctccgtggtttgcctgctcaacaatttctatccgcgggaagctaaggtgcagtggaaagtcgataacgccctgcaaagcggcaattctcaggagtccgtgaccgagcaggacagcaaggattccacatactctctgagctccaccctcacgctgagcaaagcggactacgaaaagcacaaagtttatgcctgtgaggtgacacatcaggggctttcttcccccgtcaccaagagcttcaaccgcggagaatgc

SEQ ID NO: 39081 - RNA, 1344 nt, synthetic construct
  misc_feature 1..1344: note = derived and/or modified sequence opt5 from Tisotumab_vedotin_HeavyChain1
  source 1..1344: mol_type = other RNA
gaggtgcagctgctcgaaagcggcgggggactggtccaacccggcgggtcccttagactgtcttgcgccgctagcggattcaccttttccaactacgccatgtcttgggttcggcaggcgcctggcaaggggctcgagtgggtgagctccatctctggaagcggcgactatacatactatacggattccgtgaaaggccgcttcaccattagcagagacaattctaagaacacactgtaccttcagatgaactccctgcgggctgaagataccgccgtctattactgtgcccgcagcccgtgggggtattacctcgactcttggggacagggcacactggtgaccgtttccagcgcttctacaaaagggccctccgtgtttcctctggcccccagctccaagtctaccagcggaggcacggctgccctcgggtgcctggtcaaagattacttccctgagcccgtgaccgtttcctggaatagcggagcgcttacatctggcgtgcacacctttcctgccgtcctgcaatccagcggcctctattctctgagctccgtggtgacagtcccgtctagctcccttgggacccagacgtacatctgtaatgttaaccataagcccagcaatacaaaggtggacaaaagagtggaacctaagtcttgcgataaaacccacacatgtcccccttgccccgctccggagctgctcggaggcccttccgtcttcctgtttccccctaagcccaaagacaccctgatgattagccggacccccgaggtgacatgtgttgtggtcgatgtgtctcatgaagaccctgaggttaagttcaactggtatgtggatggggtcgaagtgcacaatgccaagacgaaaccgcgcgaggagcagtacaactccacctatagagtcgtgagcgttctcacagtgctgcatcaggactggcttaatggaaaggaatacaaatgcaaggtctccaacaaagctctgcccgcccctatcgagaagaccatttctaaagcgaagggccaaccccgggaacctcaggtgtatacactgcccccgagccgcgaggaaatgaccaagaatcaggtttccctcacgtgtcttgtgaaagggttttacccttctgatatcgccgtcgagtgggagagcaacggacagcccgaaaataactacaagacaacccctcccgtgctggactccgacggcagcttctttctctattctaaactgaccgtggataagtccagatggcaacagggcaacgttttcagctgctctgtcatgcacgaggctctgcacaatcattacacacagaaatccctcagcctgtctcctgggaag

SEQ ID NO: 39082 - RNA, 642 nt, synthetic construct
  misc_feature 1..642: note = derived and/or modified sequence opt5 from Tisotumab_vedotin_LightChain1
  source 1..642: mol_type = other RNA
gacatccagatgacccaaagccctcccagcctgtctgccagcgctggcgatagagtgacaattacgtgccgggcctcccaggggatctctagccgcctcgcgtggtaccagcagaagccggagaaagctcccaagtccctgatttatgccgcctctagccttcaatccggagtccctagcagattctctggctccgggagcggaaccgactttacactgaccatctcttccctccagcccgaagatttcgctacatactattgtcagcagtacaacagctatccttacacctttggccaagggacaaaactggagattaagcggaccgttgccgctccctctgtgttcatctttcctccgtccgacgaacagcttaaaagcggaacggcctccgtggtctgcctgctcaataacttctatccccgcgaggcgaaggtgcagtggaaggttgataatgccctgcagtctggcaacagccaagaatccgtgaccgagcaggacagcaaagattctacatactccctgagctctaccctcacactgagcaaggctgactacgagaaacacaaggtctatgcctgtgaagtgacccatcagggcctttcctctcctgttacgaaatcctttaatagaggggagtgc

SEQ ID NO: 39083 - RNA, 1341 nt, synthetic construct
  misc_feature 1..1341: note = derived and/or modified sequence opt5 from Tocilizumab_HeavyChain1
  source 1..1341: mol_type = other RNA
gtgcaactgcaagagagcggccccgggctcgtcagaccttcccagaccctgtctcttacatgcacggttagcggatactccatcacctctgaccacgcctggagctgggtgcggcagccgcccggccgcgggctggaatggattggatatatctcctactctggcattacaacctataaccctagcctcaagtccagagtgacaatgctgcgggataccagcaaaaatcagttctctcttcgcctgtccagcgtcacagctgccgacaccgcggtgtactattgtgctagatctctcgcccggacgaccgccatggattactgggggcaaggatccctggttacagtgagctctgcttccaccaagggccccagcgtctttcctctggccccctcctctaaaagcacatccggcgggaccgctgccctcggatgcctggtgaaggactatttccctgagccggttacggtgagctggaactctggcgcgcttacatccggggtccatacctttcccgccgtgctgcagagctctggactctacagcctgtcctctgtggtcacagttcctagctccagccttggcacccagacctacatctgtaatgtgaaccacaaaccctctaatacaaaggtggataagaaagtcgaacctaagtcctgcgacaaaacgcatacctgtcccccgtgccctgctcccgagctgctcgggggacctagcgtgttcctgtttcctcccaagcccaaagatacactgatgatttctcgcaccccggaagttacatgtgtggtcgtggacgtttcccacgaggatcccgaggtgaagttcaactggtatgtcgacggcgtggaagtccataatgccaagaccaaacctagagaggaacagtacaacagcacgtatcgggtggtttccgtgctcacagtcctgcaccaagattggcttaatggcaaggagtacaaatgcaaggtgtctaacaaagctctgcccgcccctatcgagaagaccatcagcaaagcgaaggggcagccccgcgaaccgcaggtttataccctccctccctccagagacgagctgacaaagaatcaggtgtctcttacctgtctggtcaaaggattttaccctagcgatattgccgtggaatgggagtccaacggccaacccgaaaataactataagacaacgcctcccgtgctcgacagcgacgggtctttctttctgtactccaaactgaccgttgataagagccggtggcagcagggaaatgtcttctcttgctccgtgatgcacgaggctctccataaccactacacacagaaaagcctgtctcttagcccgggc

SEQ ID NO: 39084 - RNA, 642 nt, synthetic construct
  misc_feature 1..642: note = derived and/or modified sequence opt5 from Tocilizumab_LightChain1
  source 1..642: mol_type = other RNA
gacatccagatgacccaaagcccctcctctctgagcgcctccgtgggcgatagagtcacaattacgtgccgggcttctcaggacatcagctcctacctcaactggtatcagcagaagcctgggaaagccccgaagctgcttatttactatacctctcgcctgcacagcggagttccctccagattcagcggctctgggtccggaacagattttaccttcacaatcagctctctccaacctgaggacattgcgacctactattgtcagcagggcaatacactgccctacacctttgggcagggaacgaaagtggaaatcaagcggaccgtggctgccccttccgtcttcatctttccccctagcgatgagcaacttaaatctggcacagcctccgtggtttgcctgctcaacaatttctatccgcgcgaagctaaggtgcagtggaaggtcgacaacgccctgcagagcggcaattcccaggagtctgtgaccgaacaagatagcaaagactccacatacagcctgtcttccaccctcacgctgagcaaggctgattacgagaaacataaggtttatgcctgtgaggtgacacaccaggggctttctagccccgtcaccaaatcctttaacagaggagaatgc

SEQ ID NO: 39085 - RNA, 1353 nt, synthetic construct
  misc_feature 1..1353: note = derived and/or modified sequence opt5 from Tosatoxumab_HeavyChain1
  source 1..1353: mol_type = other RNA
gaggtgcagatggtccaaagcggcgccgaagttaagaaacccggggagcctctgaagatctcctgcaaaggatctggctacaagttcgggacccactggattggatgggtgagacagcggccgggcaaagggctcgaatggatgggaatcattcatcccgctgacagcgagacaaagtattccccttcttttcagggccaggtgagcttctccgccgataagtctagcaacacggcgtacctgcactggtccacccttcgcgctagcgacacagccatgtattactgtgccagacggtctggctccagctcttggtatgctctggatttttgggggcaaggaaccatggtcacagtgtccagcgcctctaccaaaggcccctccgttttccctctcgctcccagctccaagtctacaagcgggggaaccgccgcgctgggctgccttgtgaaagactactttcctgaaccggtcacggtgtcctggaatagcggggccctgacctctggagttcatacattccccgctgtgctccagtccagcggcctgtattctctgagctccgtcgtgaccgtgccttctagctccctcggcacacagacctacatctgtaacgtcaatcacaagcccagcaacacgaaagttgataagcgcgtggagcctaagtcttgcgacaaaacacatacctgtcccccgtgccctgcccccgagctgcttgggggaccttccgtgtttctgttccctcccaagcccaaagatacactcatgattagcagaaccccggaagtcacctgtgtggttgtggacgtctctcacgaggatcccgaagtgaagtttaattggtacgttgacggcgtggaggtccacaacgctaaaacaaagcctcgggaggaacagtataattccacgtaccgcgtggtcagcgtgctgaccgttcttcatcaagattggctgaacgggaaagagtataagtgcaaggtgtccaataaagccctccccgcgcctatcgaaaagacaatctctaaagccaagggacagcccagagagccgcaggtctacaccctgcctcccagccgggaagagatgaccaaaaaccaggtgtccctgacatgtctcgttaagggcttctatccttctgacattgctgtggagtgggaaagcaatgggcaacccgagaacaattacaagacgacacctcccgtcctggattccgacggcagctttttcctttattctaaactgaccgtggacaagtcccgctggcagcagggaaacgtgtttagctgctctgttatgcacgaagccctccataatcactacacccaaaaatccctgagcctttctccgggcaag

SEQ ID NO: 39086 - RNA, 651 nt, synthetic construct
  misc_feature 1..651: note = derived and/or modified sequence opt5 from Tosatoxumab_LightChain1
  source 1..651: mol_type = other RNA
cagagcgtgctgacccaatccccctctgccagcggcacacctgggcagagagtcacgatctcctgctctggaggcagctccaacattgggtctaataccgttaactggtaccagcagttcccgggagctgcccccaagctcctgatctatacaaataaccaacggcctagcggcgtgcccgaccgcttttccgggagcaaatctggaacctccgcgagccttgctatttctggcctgcagtccgaggatgaagccgactactattgtgccacatgggatgacagcctcaatggcctgtacgtgttcgggaccggaacaaaggtcaccgtgcttggccagcctaaagctaaccccacggttaccctgtttcctccgtcttccgaggaactccaggccaataaggctacactggtgtgcctgatcagcgatttctatcccggggccgtcaccgtggcgtggaaagccgacggatcccctgttaaggctggcgtggagacaaccaagccctctaaacaaagcaacaataagtacgccgcttccagctatctctctctgacgcctgaacagtggaaatcccacagaagctactcttgtcaggtcacacatgaggggagcaccgtggagaagacagtggcccccaccgaatgctcc

SEQ ID NO: 39087 - RNA, 1341 nt, synthetic construct
  misc_feature 1..1341: note = derived and/or modified sequence opt5 from Tositumomab_HeavyChain
  source 1..1341: mol_type = other RNA
caggcttacctgcaacagagcggcgctgagctcgtgagacccggggcctccgtcaagatgtcttgcaaagcgagcggatataccttcacatcctacaacatgcactgggttaagcagacgcctcggcagggcctggaatggatcggggctatttatccgggaaatggcgacacctcttacaaccaaaaatttaaggggaaagccacacttaccgtggataagagctcctctacagcctatatgcagctgagctccctcaccagcgaggactctgctgtgtacttctgtgcccgcgtcgtgtattactccaatagctactggtattttgatgtttggggaacaggcaccacggtgaccgtctctggcccctccgtgttccctctggctcccagctctaagtccacaagcgggggaaccgccgcgcttggctgcctggttaaagactactttcctgaacccgtgacagtctcctggaactctggggccctcaccagcggagtgcatacgttccctgctgtgctgcagtccagcggcctgtattctctctccagcgtcgttacagtgccgtctagctccctggggacccagacatacatctgtaatgtgaaccacaagccctctaataccaaagtcgataagaaagccgagcctaagagctgcgacaagacccatacatgtcccccttgccccgctccggaacttctgggaggcccttccgtgtttctctttccccctaaacccaaggatacgctgatgattagcagaacccccgaggttacatgtgtggtcgtggacgtttctcacgaggatcctgaagtgaaatttaactggtatgtcgacggcgtggaggtccataatgccaagaccaaaccgcgggaagaacaatacaactccacatatcgcgtggttagcgtgcttaccgtcctgcaccaggattggctcaatgggaaggagtacaaatgcaaggtgtctaacaaggcgctgcccgcccctatcgagaaaacgatttccaaggctaaaggacagcccagagagcctcaggtttacacactgcccccgagccgggacgaactcaccaagaatcaagtgtccctgacctgtcttgtcaaaggcttctatccttctgatatcgccgtggagtgggaaagcaacgggcagcccgagaataactacaagacaacccctcccgtgctggactccgacggatctttcttcctctatagcaagctgacagttgataaatcccgctggcagcaaggcaacgtctttagctgctctgtgatgcacgaggcccttcataatcactacacgcagaagtccctgagcctctctcctgggaaa

SEQ ID NO: 39088 - RNA, 630 nt, synthetic construct
  misc_feature 1..630: note = derived and/or modified sequence opt5 from Tositumomab_LightChain
  source 1..630: mol_type = other RNA
cagatcgtgctgagccaatcccccgccattctctctgctagccctggcgagaaggtcaccatgacatgcagagcctcctctagcgtttcctacatgcactggtatcagcagaaaccggggtctagccccaagccttggatctacgcgccctccaacctggctagcggagtgcctgcccggttctctggctccgggagcggaacgtcttattcccttaccattagccgcgtggaagccgaggacgctgccacatactattgtcagcaatggtcttttaatccccctaccttcggcgctgggacaaaactggaactcaagagaaccgtcgccgcgccgtccgtgtttatctttccccctagcgatgagcagctgaaatccggaacagcctctgttgtgtgccttctgaacaatttctacccccgggaagctaaggtccagtggaaggtggacaacgccctccagagcggcaattcccaagagagcgttaccgagcaggattctaaagactccacgtatagcctgtctagcaccctgacactctccaaggctgattacgaaaaacataaggtgtacgcctgtgaggtcacccaccagggcctgtctagccctgtgacaaaatccttcaaccgc

SEQ ID NO: 39089 - RNA, 1338 nt, synthetic construct
  misc_feature 1..1338: note = derived and/or modified sequence opt5 from Tovetumab_HeavyChain1
  source 1..1338: mol_type = other RNA
caggtgcaactggtcgagagcggcgggggactcgttaagcccggcgggtccctgagactttcttgcgccgctagcggattcaccttttccgactactatatgaactggatccggcaggcccctggcaaagggctggaatgggtgtcttacattagctcctctggaagcatcatttattacgcggattccgtgaagggccgcttcacaatcagcagagacaatgctaaaaactctctctatctgcagatgaactcccttcgggccgaggatacggccgtctactattgtgctcgcgaaggcagaattgccgctcgggggatggacgtgtggggacagggcaccacagttaccgtgagctctgcctccacaaaggggccgagcgtctttcccctggcgccttgctctcgctccaccagcgagtccacagccgctctcggatgtctggtgaaagattacttccccgaacctgttaccgtgtcttggaatagcggcgccctgacgtccggggtccacacctttcccgctgtgctccaaagctctggactgtactcccttagctctgtggtcacagttcctagctccaatttcggcacccagacatatacctgcaacgtggaccataagccgtctaatacgaaggtggataaaacagtcgagagaaagtgttgcgtggagtgtcccccttgccccgcccctcccgttgcgggcccgagcgtgtttctgttccctcccaaacctaaggacaccctcatgatctcccggacacccgaagtcacctgtgtggttgtggatgtcagccacgaggaccccgaagtgcagtttaactggtacgtcgatggggtggaggttcataatgccaaaaccaagcctcgcgaggaacagttcaactctacatttagagtggtctccgtgctgacggttgtgcaccaagactggcttaatggaaaggagtataaatgcaaggtcagcaacaaaggcctgccggctcccatcgaaaagaccatttctaaaacaaaggggcagcctcgggagccccaggtgtacaccctccctccctcccgcgaagagatgaccaaaaatcaggtgagcctgacatgtctggttaagggattctatccgtccgatatcgccgtcgagtgggaatctaacggccaacctgagaataactacaagacgacaccccctatgctcgacagcgacgggtcctttttcctgtattctaaacttaccgtggataagagcagatggcagcagggaaacgtgttctcctgcagcgtcatgcatgaagctctgcacaatcactacacccaaaaatctctctccctgagccccggcaag

SEQ ID NO: 39090 - RNA, 645 nt, synthetic construct
  misc_feature 1..645: note = derived and/or modified sequence opt5 from Tovetumab_LightChain1
  source 1..645: mol_type = other RNA
gacatccagatgacgcaaagcccctcctctctgagcgcctccgtgggcgatagagtctctattacatgccggcctagccagtccttctctcgctacatcaactggtatcagcagaagccggggaaagctcccaagctcctgattcacgccgcgagctcccttgttggaggcgtgcctagcagattttctgggtccggaagcggcacggacttcaccctgacaatctcttccctccaacccgaggattttgctacctactattgtcagcagacatacagcaatcctcccattaccttcgggcagggaacacggctggaaatgaaacgcaccgtggccgccccttctgtctttatcttcccgccctccgacgagcaacttaagagcggcacggcttccgtggtttgcctgctcaacaatttttatcctagagaagccaaagtgcagtggaaggtcgataacgctctgcagtctggcaatagccaggagtccgtgaccgaacaagacagcaaggattctacatactccctgagctctaccctcacactgagcaaagccgactatgagaagcataaagtttacgcgtgtgaggtgacccaccaggggctttcctctcccgtcaccaagagcttcaaccggggagaatgc

SEQ ID NO: 39091 - RNA, 1347 nt, synthetic construct
  misc_feature 1..1347: note = derived and/or modified sequence opt5 from Tralokinumab_HeavyChain1
  source 1..1347: mol_type = other RNA
caggtgcaactggtccagagcggcgccgaggttaagaaacccggggcttccgtgaaggtgtcttgcaaagccagcggatacaccttcacaaactatggcctctcctgggtcagacaggcgcctgggcagggactggaatggatgggctggatctctgctaataacggggacacgaattacggacaagagtttcagggccgggtgaccatgacaaccgatacaagcacctccacagcctatatggaacttcgctctctgagaagcgacgataccgccgtttactattgtgctcgggactcctcttcttcctgggcccgctggttctttgatctctggggcagagggacgctggtgaccgtcagctctgcttccacaaagggaccgagcgtgttcccccttgccccttgctctcggtccaccagcgagtccacagcggccctgggctgtctcgttaaagactactttcccgaacctgtgaccgtctcttggaacagcggggctctgacgtccggagtgcacacattccccgccgtgctgcagagctctggcctctattccctgagctctgtcgttaccgtgcctagctcctctcttgggacaaagacctatacctgcaatgtggatcataagccgagcaacacaaaagtcgacaagcgcgtggagtccaaatacggacccccttgtcccagctgccctgctcccgagtttctgggcggcccgtctgttttcctctttcctcccaagcctaaagatacgctgatgatttccagaacccccgaagtgacatgtgtcgtggttgacgtgagccaggaggatcccgaagtccaattcaattggtacgtggacggggtcgaggtgcacaacgccaagaccaagcctcgggaggaacagtttaattctacataccgcgttgtgtccgtccttaccgtgctgcatcaggattggctcaacggaaaagagtataagtgcaaagttagcaataagggcctgccgtcctctatcgagaaaacgattagcaaggcgaaagggcagcccagagaacctcaagtgtacacactgcccccttcccaggaagagatgaccaagaaccaggtctctctcacctgtctggtgaagggattctatcccagcgacatcgccgtggagtgggaatccaatggccaaccggagaacaattacaaaacaacccctcccgttcttgacagcgatgggagctttttcctgtattcccggctcacagtcgacaagagccgctggcaggaaggaaacgtgttctcttgctccgtgatgcacgaggctctgcataaccactacacgcagaaaagcctttctctgagcctcggcaag

SEQ ID NO: 39092 - RNA, 642 nt, synthetic construct
  misc_feature 1..642: note = derived and/or modified sequence opt5 from Tralokinumab_LightChain1
  source 1..642: mol_type = other RNA
agctacgtgctgacccagcccccttccgtctctgttgccccgggcaagacagctagaatcacgtgcgggggaaacattatcggcagcaaactcgtgcactggtatcaacagaagcccgggcaggcccctgtgctggtcatttacgacgatggagaccggccctccggcatccctgagcgcttctctgggagcaattccggaaacaccgcgacacttaccatttctagagtggaagctggcgatgaggccgactattactgtcaggtttgggatacaggcagcgaccccgtggtctttgggggaggcaccaaactgacagtgctcgggcaacctaaggccgctccgtccgttaccctgtttccccctagctctgaggaacttcaggccaataaagctacgctggtgtgcctcatctccgatttctatcccggagccgtcaccgtggcgtggaaggccgacagctctcctgtgaaggctggcgtcgaaacaaccacaccctccaaacagagcaacaataagtacgccgcttcttcctatctgagcctgaccccggagcagtggaaatcccatcggtcttacagctgtcaagttacgcacgaggggtccacagtggaaaagaccgtggcccctacagagtgcagc

SEQ ID NO: 39093 - RNA, 1332 nt, synthetic construct
  misc_feature 1..1332: note = derived and/or modified sequence opt5 from Trastuzuab_HeavyChain1
  source 1..1332: mol_type = other RNA
gaggtgcagctggtcgaaagcggcgggggactcgttcagcccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagaatagcctgcgcgctgaagatacagccgtgtattactgttctagatggggcggggacggattctatgctgattactggggccaggggacccttgttacagtgagctccgccagcaccaagggaccctctgtctttcctctggcgccctccagcaaatctacgtccggcgggaccgccgctctcggatgcctggtgaaggactacttccctgagcccgttacagtgagctggaactctggcgccctgacctccggcgtccatacatttcctgctgtgctccaaagctccgggctgtattctcttagctccgtggtcaccgttccgtcctcttccctgggaacgcagacatacatctgtaatgtgaaccacaagcccagcaataccaaagtggataagaaagtcgaacctaagtcttgcgacaaaacacatacctgtcccccttgccccgccccggagctcctgggcgggcctagcgtgttcctttttccccctaagcccaaggataccctgatttcccggacacccgaggttacgtgtgtggtcgtggacgtttctcacgaagatcctgaggtgaaattcaactggtatgtcgacggagtggaagtccataatgcgaagaccaaaccgcgcgaggagcagtacaacagcacatatagagtggtttccgtgctcaccgtcctgcaccaggattggctgaatggcaaggaatacaaatgcaaggtgagcaacaaagccctccccgctcctatcgagaagacaatctctaaggccaaagggcaaccccgggaacctcaggtttataccctgcccccgtcccgcgaggaaacgaagaatcaggtgagccttacatgtctggtcaaaggattttacccttctgacattgctgtggagtgggagtccaacggccagcccgaaaataactacaagaccacccctcccgtgctcgacagcgatggctccttctttctgtattctaaacttacagttgacaagagcagatggcaacaggggaacgtcttctcctgctctgtgcacgaggccctgcataatcactacacccaaaagagcctctccctgagccctgga

SEQ ID NO: 39094 - RNA, 639 nt, synthetic construct
  misc_feature 1..639: note = derived and/or modified sequence opt5 from Trastuzuab_LightChain1
  source 1..639: mol_type = other RNA
gacatccagacccaaagcccctcctctctgagcgcctccgtgggcgatagagtcacaattacgtgccgggcttctcaggacgttaacaccgccgtggcgtggtaccagcagaaacctgggaaagctccgaagctcctgatctatagcgcctccttcctttactctggagtgcccagccgcttttccggcagcagatctgggacagatttcaccctgacaatttccagcctccaacctgaggactttgccacctattactgtcagcagcactatacaacgccccctaccttcggacagggcaccaaagtcgaaatcaagcggacagtggctgccccctctgtttttattttccctccgtccgatgagcaactgaaaagcgggaccgcttctgtggtctgccttctgaataacttttacccccgcgaagccaaggtgcagtggaaggttgacaatgcgctccagtccggaaacagccaggagtccgtgacagaacaagattctaaagacagcacctattccctgagctctacgctgacactctccaaggccgattacgagaaacataaggtctacgcttgtgaggtgacccaccagggcctgagctctcctgtgacaaagagcttcaatagaggcgaatgc

SEQ ID NO: 39095 - RNA, 1347 nt, synthetic construct
  misc_feature 1..1347: note = derived and/or modified sequence opt5 from Trastuzumab_emtansine_HeavyChain1
  source 1..1347: mol_type = other RNA
gaggtgcagctggtcgaaagcggcgggggactcgttcagcccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaatagcctgcgcgctgaagatacagccgtgtattactgttctagatggggcggggacggattctatgctatggattactggggccaggggacccttgttacagtgagctccgccagcaccaagggaccctctgtctttcctctggcgccctccagcaaatctacgtccggcgggaccgccgctctcggatgcctggtgaaggactacttccctgagcccgttacagtgagctggaactctggcgccctgacctccggcgtccatacatttcctgctgtgctccaaagctccgggctgtattctcttagctccgtggtcaccgttccgtcctcttccctgggaacgcagacatacatctgtaatgtgaaccacaagcccagcaataccaaagtggataagaaagtcgaacctaagtcttgcgacaaaacacatacctgtcccccttgccccgccccggagctcctgggcgggcctagcgtgttcctttttccccctaagcccaaggataccctgatgatttcccggacacccgaggttacgtgtgtggtcgtggacgtttctcacgaagatcctgaggtgaaattcaactggtatgtcgacggagtggaagtccataatgcgaagaccaaaccgcgcgaggagcagtacaacagcacatatagagtggtttccgtgctcaccgtcctgcaccaggattggctgaatggcaaggaatacaaatgcaaggtgagcaacaaagccctccccgctcctatcgagaagacaatctctaaggccaaagggcaaccccgggaacctcaggtttataccctgcccccgtcccgcgaggaaatgacgaagaatcaggtgagccttacatgtctggtcaaaggattttacccttctgacattgctgtggagtgggagtccaacggccagcccgaaaataactacaagaccacccctcccgtgctcgacagcgatggctccttctttctgtattctaaacttacagttgacaagagcagatggcaacaggggaacgtcttctcctgctctgtgatgcacgaggccctgcataatcactacacccaaaagagcctctccctgagccctgga

SEQ ID NO: 39096 - RNA, 642 nt, synthetic construct; identical to SEQ ID NO: 38952
  misc_feature 1..642: note = derived and/or modified sequence opt5 from Trastuzumab_emtansine_LightChain1
  source 1..642: mol_type = other RNA

SEQ ID NO: 39097 - RNA, 1347 nt, synthetic construct; identical to SEQ ID NO: 39095
  misc_feature 1..1347: note = derived and/or modified sequence opt5 from Trastuzumab_HeavyChain1
  source 1..1347: mol_type = other RNA

SEQ ID NO: 39098 - RNA, 1353 nt, synthetic construct
  misc_feature 1..1353: note = derived and/or modified sequence opt5 from Trastuzumab_HeavyChain
  source 1..1353: mol_type = other RNA
gaggtgcagctggtcgaaagcggcgggggactcgttcagcccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaatagcctgcgcgctgaagatacagccgtgtattactgttctagatggggcggggacggattctatgctatggattactggggccaggggacccttgttacagtgagctccgccagcaccaagggaccctctgtctttcctctggcgccctccagcaaatctacgtccggcgggaccgccgctctcggatgcctggtgaaggactacttccctgagcccgttacagtgagctggaactctggcgccctgacctccggcgtccatacatttcctgctgtgctccaaagctccgggctgtattctcttagctccgtggtcaccgttccgtcctcttccctgggaacgcagacatacatctgtaatgtgaaccacaagcccagcaataccaaagtggataagaaagtcgaacctcccaagtcttgcgacaaaacacatacctgtcctccctgcccggcccctgagctcctgggcgggcccagcgtgttcctttttcctcccaagcccaaggataccctgatgatttcccggacacctgaggttacgtgtgtggtcgtggacgtttctcacgaagatccggaggtgaaattcaactggtatgtcgacggagtggaagtccataatgcgaagaccaaaccccgcgaggagcagtacaacagcacatatagagtggtttccgtgctcaccgtcctgcaccaggattggctgaatggcaaggaatacaaatgcaaggtgagcaacaaagccctccctgctcccatcgagaagacaatctctaaggccaaagggcaacctcgggaaccccaggtttataccctgccgccttcccgcgacgagcttacgaagaatcaggtgagcctgacatgtctcgtcaaaggattttacccctctgacattgctgtggaatgggagtccaacggccagcctgagaataactacaagaccacaccccctgtgctggatagcgacggctccttctttctttattctaaactgaccgttgataagagcagatggcaacaggggaacgtcttctcctgctctgtgatgcacgaagccctccataatcactacacccaaaagagcctgtccctgagccccggaaaa

SEQ ID NO: 39099 - RNA, 660 nt, synthetic construct
  misc_feature 1..660: note = derived and/or modified sequence opt5 from Trastuzumab_HeavyChain_variant_1n8z_B
  source 1..660: mol_type = other RNA
gaggtgcagctggtcgaaagcggcgggggactcgttcaacccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaatagcctgcgcgctgaagatacagccgtgtattactgttctagatggggcggggacggattctatgctatggattactggggccaggggacccttgttacagtgagctccgccagcaccaagggaccctctgtctttcctctggcgccctccagcaaatctacgtccggcgggaccgccgctctcggatgcctggtgaaggactacttccctgagcccgttacagtgagctggaactctggcgccctgacctccggcgtccatacatttcctgctgtgctccaaagctccgggctgtattctcttagctccgtggtcaccgttccgtcctcttccctgggaacgcagacatacatctgtaatgtgaaccacaagcccagcaataccaaagtggataagaaagtcgaacct

SEQ ID NO: 39100 - RNA, 45 nt, synthetic construct
  misc_feature 1..45: note = derived and/or modified sequence opt5 from Trastuzumab_HeavyChain_variant_7637_H
  source 1..45: mol_type = other RNA
gagcccaagagctgcgacaaaacccacacatgtcctccgtgcccc

SEQ ID NO: 39101 - RNA, 642 nt, synthetic construct; identical to SEQ ID NO: 38952
  misc_feature 1..642: note = derived and/or modified sequence opt5 from Trastuzumab_LightChain1
  source 1..642: mol_type = other RNA

SEQ ID NO: 39102 - RNA, 642 nt, synthetic construct; identical to SEQ ID NO: 38952
  misc_feature 1..642: note = derived and/or modified sequence opt5 from Trastuzumab_LightChain_variant_1n8z_A
  source 1..642: mol_type = other RNA

SEQ ID NO: 39103 - RNA, 642 nt, synthetic construct; identical to SEQ ID NO: 38952
  misc_feature 1..642: note = derived and/or modified sequence opt5 from Trastuzumab_LightChain_variant_7637_L
  source 1..642: mol_type = other RNA

SEQ ID NO: 39104 - RNA, 1344 nt, synthetic construct
  misc_feature 1..1344: note = derived and/or modified sequence opt5 from TRC-105_HeavyChain1
  source 1..1344: mol_type = other RNA
gaggtgaagctggaagagagcggcgggggactcgtccagcccggcgggtccatgaaactgtcttgcgccgctagcggattcaccttttccgacgcctggatggattgggttagacaatctcctgaaaagggccttgagtgggtggcggaaatccggagcaaggcttccaaccacgccacatactatgccgagtctgtgaaggggcgcttcacgattagcagagacgattccaaaagctctgtctacctgcagatgaatagcctccgggctgaggacaccggaatctattactgtacacgctggagacggtttttcgattcctggggccagggcaccacactgaccgtgtcttccgccagcacaaaggggccgtctgtttttccccttgctccttccagcaagtccacctctggaggcacggccgcgctggggtgcctcgtgaaagactatttccccgaacctgtcaccgtgagctggaactccggagccctgacaagcggcgttcatacctttcccgctgtgctgcagtcttccgggctctacagcctgtctagcgtcgtgacagtgccttcctctagccttggaacccaaacgtatatttgtaatgtcaaccacaagccgtccaatacaaaagttgataagaaagtggagcccaagagctgcgacaagacccatacatgtcctccctgccctgcccccgaactgctcggcggcccgtctgtgttcctgtttcctcccaaacctaaggatacccttatgatctcccgcacccccgaggtcacatgtgtggttgtggacgtcagccacgaggatcccgaagtgaaattcaactggtacgttgacggggtggaggtccataatgctaagacgaaacctagagaggaacagtacaactctacctatcgggtggtctccgtgctgacagttctccaccaggattggctgaatggaaaggaatacaaatgcaaggtgagcaacaaggccctgccggcgcccattgagaaaaccatctccaaggccaaaggccagcctcgcgagccccaagtctatacactccctccctctagagacgaactgaccaagaatcaggtgagccttacgtgtctggttaaagggttttacccgtccgacatcgctgtggagtgggaatctaacggacagcctgagaataactataagacaacaccccctgtcctcgatagcgacggctccttctttctgtacagcaaacttaccgtggataaatctcggtggcagcaagggaatgtgttctcctgcagcgttatgcacgaagccctgcataaccactatacccagaagtctctctccctgagccccggaaaa

SEQ ID NO: 39105 - RNA, 639 nt, synthetic construct
  misc_feature 1..639: note = derived and/or modified sequence opt5 from TRC-105_LightChain1
  source 1..639: mol_type = other RNA
cagatcgtgctgagccaatcccccgccattctctctgctagccctggcgagaaagtcaccatgacatgcagagcctcctctagcgtttcctacatgcactggtatcagcagaaaccggggtctagccccaagccttggatctacgcgacgtccaacctggctagcggagtgcccgtgcggttctctggctccgggagcggaacctcttattcccttacaattagccgcgtcgaagccgaggacgccgctacctactattgtcagcaatggtcttccaatcctctgacatttggcgccgggaccaaactcgaactgaagagaacagtggctgcccccagcgttttcatctttcctccgtccgatgagcagcttaaatctggaaccgcgagcgtggtctgcctgctcaacaatttctacccccgggaagccaaggtgcagtggaaggttgacaacgctctgcagtccggcaatagccaagagtctgtgacggagcaggattccaaagacagcacctattctctgagctccacactcaccctgtctaaggccgattacgaaaaacataaggtctacgcttgtgaggtgacacaccagggccttagctcccctgtgaccaagagctttaaccgcggggaatgc

SEQ ID NO: 39106 - RNA, 1362 nt, synthetic construct
  misc_feature 1..1362: note = derived and/or modified sequence opt5 from Tregalizumab_HeavyChain1
  source 1..1362: mol_type = other RNA
gaggaacagctggtggagagcggcgggggactcgtcaagcccggcgggtccctgagactttcttgcgccgctagcggattctccttttctgactgtcggatgtactggctgcgccaagcccctggcaaagggctcgaatggatcggagttattagcgtgaagtccgagaactatggcgcgaattacgctgaatctgtgagaggccggttcaccatcagccgcgatgactccaaaaacacagtctatctgcagatgaatagccttaagacggaggataccgccgtgtactattgctctgcctcctactatagatacgacgttggggcttggtttgcctactggggacagggcacactggtgaccgtcagctctgcttccacaaaagggccgagcgtgttccccctcgccccttcttccaagagcacctccggaggcacagcggccctggggtgtctggttaaggattattttcccgagcctgtgaccgtctcttggaacagcggagctctcacgtccggcgtgcacaccttccccgccgtgctgcagagctctggcctttactccctgagctctgtcgttacagtgcctagctcctctctcgggacccaaacatatatttgcaatgtgaaccataaaccgagcaataccaaggtcgacaaaaaggtggaacccaaatcctgtgataagacgcacacatgccctccctgtcctgctcccgagctgcttggaggcccgagcgtttttctgttccctcccaagcctaaagacaccctcatgatctctcggacacccgaagtgacctgcgtcgtggttgatgtgtcccatgaggaccccgaggtcaagtttaactggtacgtggatggggtcgaagtgcacaatgccaaaaccaagcctcgcgaggaacagtataacagcacatacagagttgtgtctgtcctgacggtgctgcatcaggactggctcaatggaaaagagtataagtgtaaagtttccaacaaggcgctgccggcccccattgaaaagaccatcagcaaagctaagggccagcctcgggagccccaagtgtacacacttcctccctcccgcgatgagctgaccaaaaatcaggtctctctcacatgcctggtgaaggggttctacccgagcgacatcgccgtggaatgggagtccaacggacagcctgaaaataactataaaaccacgccccctgttcttgactctgatggcagctttttcctgtactccaagctcacagtcgacaagagcagatggcagcaaggcaacgtgttttcttgttccgtgatgcacgaggctctgcacaatcattatacccagaaaagcctgtctctctcccccgggaag

SEQ ID NO: 39107 - RNA, 654 nt, synthetic construct
  misc_feature 1..654: note = derived and/or modified sequence opt5 from Tregalizumab_LightChain1
  source 1..654: mol_type = other RNA
gacatcgtgatgacccagagccccgattccctggccgtctctctcggcgagagagctacaattaactgccgggccagcaagtccgtttctacgagcgggtactcctatatctactggtatcaacagaaacctggacagccgcccaagctgcttatttacctggcgtctatcctcgaaagcggcgtgcctgaccgcttctccgggagcggatctggcaccgattttacactgaccatttccagccttcaggctgaggacgtggccgtctattactgtcaacactctagagaactgccctggacattcgggcagggaaccaaagtggagatcaagcggacagttgccgctccttccgtgtttatctttccccctagcgatgaacagctcaaatctggcaccgcctccgtcgtgtgcctgctgaataacttctatccgcgcgaggctaaggttcagtggaaggtggacaatgccctccaaagcggcaactcccaggagtctgtcacggaacaggatagcaaagactccacctacagcctgtcttccacacttaccctgagcaaggcggattacgagaaacataaggtgtatgcctgtgaagtgacacaccaggggctctctagccccgtcaccaaatccttcaatagaggagagtgc

SEQ ID NO: 39108 - RNA, 1353 nt, synthetic construct
  misc_feature 1..1353: note = derived and/or modified sequence opt5 from Tremelimumab_HeavyChain1
  source 1..1353: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatctggtatgacggaagcaacaaatactatgctgattccgttaagggcagattcacaatttctcgggacaatagcaaaaacacgctgtacctccagatgaactccctgcgcgccgaggataccgccgtgtattactgtgctagagacccgcggggcgccacactttattactactattacgggatggatgtctggggacaaggcaccacagtgaccgttagctctgcttccacaaaggggcccagcgtgtttcctctggccccctgctctcgctccaccagcgaatctacggcggccctcggatgtctggtcaaagactatttccctgagcccgtgaccgtgtcctggaatagcggcgctctgacatccggggtccatacctttcctgccgttctccagtctagcggactgtactcccttagctctgtggtgacagtcccgtccagcaatttcggcacccagacgtatacatgcaacgtggatcacaagccctctaataccaaggttgacaaaacagtggaaagaaagtgttgcgtcgagtgtcctccctgccctgctcccccggtggccggccctagcgtttttctgtttccccctaaacccaaggataccctcatgatctcccggacccccgaggtgacatgtgtcgtggtcgacgtgtctcatgaagatcctgaggttcagttcaactggtacgtggacggggtcgaagtgcacaatgcgaaaacgaagccgcgcgaggagcaattcaacagcacctttagagttgtgtccgtcctgacagtggtgcatcaggattggcttaatggaaaggaatataaatgcaaggttagcaacaaaggcctgcccgcccctattgagaagaccatctctaaaacaaaggggcagccccgggaacctcaggtctacaccctgcccccgtcccgcgaggaaatgacgaaaaatcaagtgagcctcacatgtctggtgaagggattctacccttctgacattgctgtcgagtgggagtccaacggccagcccgaaaataactataagaccacccctcccatgctcgacagcgatgggtcctttttcctgtactctaaacttacagtggacaagagcagatggcagcaaggaaacgttttctcctgctctgtgatgcacgaggccctgcacaatcattatacccagaaaagcctctccctgagccctggcaag

SEQ ID NO: 39109 - RNA, 642 nt, synthetic construct
  misc_feature 1..642: note = derived and/or modified sequence opt5 from Tremelimumab_LightChain1
  source 1..642: mol_type = other RNA
gacatccagatgacccaaagcccctcctctctgagcgcctccgtgggcgatagagtcacaattacgtgccgggcttctcagagcatcaactcctacctcgactggtatcagcagaaacctgggaaagccccgaagctgcttatttacgcggcttctagcctgcaatccggagttcccagccgcttctctggctccgggagcggaaccgattttacactcaccatctcttccctgcagcctgaggacttcgccacatattactgtcagcagtattacagcaccccctttacattcggccctgggaccaaagtggaaattaagagaacggtggccgctccctctgtctttatcttccctccgtccgatgagcaacttaaaagcggaaccgcctccgtggtttgcctgctcaataacttttatccccgggaagctaaggtgcagtggaaggtcgacaatgccctgcagtctggcaacagccaggagtccgtgacagaacaagatagcaaagactctacctactccctgagctctacactcaccctgagcaaggcggattacgagaaacacaaggtttatgcctgtgaggtgacgcatcagggcctttcctctcctgtcacaaagagcttcaatcgcggggaatgc

SEQ ID NO: 39110 - RNA, 1341 nt, synthetic construct
  misc_feature 1..1341: note = derived and/or modified sequence opt5 from Trevogrumab_HeavyChain1
  source 1..1341: mol_type = other RNA
gaggtgcaggtcctggaaagcggcggggacctcgttcaacccggaggctccctgagactttcttgcgccgctagcgggttcaccttttccgcctacgcgatgacatgggtgcggcaggctcctggaaagggcctggagtgggtgtctgccatcagcgggtccggaggctctgcctattacgctgatagcgtcaaaggccgcttcacgatttccagagacaacagcaagaataccgtgtatctccagatgaactctctgcgggccgaagatacagctgtttactattgtgccaaagacggggcgtggaagatgtccggacttgatgtgtggggccaggggaccacagtcatcgtgagctctgcctccaccaaaggaccgagcgtttttcccctggctccttgctctcgctccacaagcgagtccaccgccgctctcggctgtctggtgaaggactacttccccgaacctgtcacggtgtcttggaatagcggggccctgacctccggagtgcacacatttcccgcggtcctccaaagctctggcctgtattcccttagctctgttgtgaccgtgcctagctcctctctgggcacaaagacctacacgtgcaacgtcgatcataaaccgagcaatacaaaggtggacaaaagagttgagtccaagtacgggcccccttgtcccccttgccccgccccggagttcctcggaggccctagcgtgtttctgtttccccctaaacccaaggatacccttatgatttctcggacacccgaagtcacctgtgtggttgtggacgtctcccaggaggatcctgaagtgcagttcaactggtatgtcgacggggtggaggttcacaatgctaagaccaaaccgcgcgaggaacagttcaacagcacatacagagtggtctctgtgctgacggttctccatcaagattggctgaatggaaaggagtataaatgcaaggtgtccaacaaaggcctgcccagctccatcgaaaagaccatttctaaagccaaggggcagcctcgggagccccaggtctacacactccctcccagccaggaagagatgaccaagaatcaagtgtccctgacatgtcttgtgaaaggattttatccgtctgacatcgctgttgagtgggaaagcaacggccagcctgagaataactacaagaccacgccccctgtcctggactccgatggcagcttctttctctattctcgcctgacagtggacaaatccagatggcaggaagggaatgtgttcagctgctctgtcatgcacgaggcccttcataaccactacacccaaaagtccctgagcctctctctgggaaaa

SEQ ID NO: 39111 - RNA, 642 nt, synthetic construct
  misc_feature 1..642: note = derived and/or modified sequence opt5 from Trevogrumab_LightChain1
  source 1..642: mol_type = other RNA
gacatccagatgacccaaagccccgcctccctgtctgctagcgtgggcgatagagtcacaattacgtgccgggcctcccaggacatctctgattacctcgcgtggtatcagcagaagcctgggaaaattccgcgcctgcttatctacaccacaagcaccctgcaatccggagttccctctagattccggggcagcgggtccggaacagactttaccctcacaattagctctctgcagcctgaggatgtggctacctattactgtcagaagtatgactccgctccccttacgttcggcgggggaaccaaagtggaaatcaagcgcacagtcgccgcccctagcgtgtttatctttcccccttctgatgagcagctgaaatccggcaccgccagcgttgtgtgcctcctgaacaatttctacccgagagaagctaaggtccaatggaaggtggacaacgccctgcagtctggcaattcccaggagagcgttacagaacaggattccaaagactctacctatagcctctccagcacgctgacactttctaaggcggattacgagaaacacaaggtgtacgcctgtgaggtcacccatcaagggctgtccagccccgtgacaaaatctttcaaccggggagaatgc

SEQ ID NO: 39112 - RNA, 1737 nt, synthetic construct
  misc_feature 1..1737: note = derived and/or modified sequence opt5 from Tucotuzumab_celmoleukin_HeavyChain1
  source 1..1737: mol_type = other RNA
cagatccaactggtgcagagcggcgccgaagtcaagaaacccggggaaaccgttaagatttcctgcaaagctagcggatacacattcacgaactatggcatgaattgggtgaagcagacccctgggaaaggactcaagtggatgggctggatcaacacatacaccggggagccgacatatgccgacgattttaagggaagattcgcgtttagcctggaaacctccacatctaccgctttccttcagattaataacctgcggagcgaggacacggccacctacttttgtgtgcgcttcatctccaaaggcgattattggggccaagggacatctgtcaccgtgagctccgccagcacaaagggaccctctgtttttcctctcgctccctccagcaaatctacctccggcgggacggccgctctgggatgccttgtgaaggactacttccctgaacccgtcacagtgagctggaactctggcgccctgacctccggggttcacacatttcctgcggtgctccagagctccggactgtattctctgagctccgtcgtgaccgtgccgtcttcttccctcggcacccagacatacatttgtaatgtcaatcacaaacccagcaacacgaaggttgataagagagtggagcctaaatcttgcgacaagacccacacatgtcccccttgccccgccccggagctgcttggcgggcctagcgtgttcctgtttccccctaaacccaaggataccctcatgatctcccggacacccgaagtcacctgtgtggttgtggacgtctctcatgaggatcctgaagtgaaattcaattggtacgttgacggagtggaggtccacaacgctaagacgaaaccgcgcgaggaacagtataatagcacatacagagtggtctccgtgctgaccgttcttcatcaagattggctgaacggcaaggagtataagtgcaaagtgagcaataaggccctccccgctcctatcgagaaaaccatttctaaggccaaagggcagccccgggaacctcaggtctacacactgcccccgtcccgcgaagagatgaccaagaaccaggtgagcctgacatgtctcgttaagggattttatccttctgacatcgcggtggagtgggaatccaatggccaacccgagaacaactacaaaacgacccctcccgtcctggatagcgacgggtccttcttcctttattctaagctgacagtggacaaaagcagatggcagcagggaaatgtgttttcctgctctgttatgcacgaagccctccacaaccattacacccaaaagagcctgtcccttagccctggcaaagctcccacatcttccagcaccaagaagacgcagctgcagctcgagcatctgctgctcgatctgcagatgattcttaatggcatcaacaattacaaaaacccgaagctgacccggatgctcacattcaaattttatatgcctaagaaagccaccgaactgaagcaccttcaatgtctggaggaggaactcaagcccctggaggaagtcctgaatctcgctcagtctaaaaacttccatctgcgccccagagaccttatttccaatatcaacgtgattgtgctggagctcaaggggagcgaaacaacctttatgtgcgagtacgccgatgagacggccacaatcgtcgagttcctgaatcggtggatcaccttttgccagtctattatcagcacactgacc

SEQ ID NO: 39113 - RNA, 639 nt, synthetic construct
  misc_feature 1..639: note = derived and/or modified sequence opt5 from Tucotuzumab_celmoleukin_LightChain1
  source 1..639: mol_type = other RNA
gagatcgtgctgacgcagagccccgccacactctccctgtctcctggcgaaagagtcacgcttacctgcagcgcttcctctagcgtttcctacatgctgtggtatcaacagaagccggggtctagccccaaaccttggattttcgacacatccaacctcgccagcggatttcccgcgcggttctctggctccgggagcggaacctcttactccctgatcattagctctatggaggctgaagatgccgccacatattactgtcaccagcgctccggctatccttacacctttgggggaggcacaaaacttgagatcaagagaaccgtggctgcccccagcgtgttcatttttcctccgtccgacgaacagctgaagtctggcacggctagcgtcgtgtgcctcctgaataacttctatccccgggaggccaaagttcaatggaaggtggataatgcgctgcagtccgggaacagccaggagtctgtcaccgaacaggactccaaggatagcacatactctctcagctccaccctgacactttctaaagccgactacgagaagcataaagtgtatgcttgtgaagttacccaccaaggactgagctcccctgtgaccaagagctttaatcgcggcgagtgc

SEQ ID NO: 39114 - RNA, 1344 nt, synthetic construct
  misc_feature 1..1344: note = derived and/or modified sequence opt5 from Ublituximab_HeavyChain1
  source 1..1344: mol_type = other RNA
caggcttacctgcaacagagcggcgctgagctcgtgagacccggggcctccgtcaagatgtcttgcaaagcgagcggatataccttcacatcctacaacatgcactgggttaagcagacgcctcggcagggcctggaatggatcgggggaatttatccgggcaatggggacacctcttacaaccaaaaatttaagggaaaagctacacttaccgtgggcaagagctcctctacagcctatatgcagctgagctccctcaccagcgaggattctgccgtgtacttctgtgctcgctatgactacaattacgccatggattattggggccaggggacatccgtcaccgtgagctctgcttccacgaagggacccagcgtttttcctctggccccctcttccaaaagcacctccggcgggacagcggcccttggatgcctggtgaaggactacttccctgaacccgtcaccgtgtcttggaacagcggcgctctcacatccggggttcatacctttcctgccgtgctgcagagctctggactgtattccctcagctctgtcgtgacggtgccgagctcctctctgggcacacaaacctacatctgtaatgtcaaccacaaacccagcaatacaaaggttgataaaaaggtggagcctaagtcctgcgacaaaacccatacctgtcccccttgccccgctccggaacttctgggcgggcctagcgtgttcctctttccccctaagcccaaagatacactgatgatttctagaacgcccgaggtcacctgtgtggttgtggacgtctcccacgaggatcctgaagtgaagttcaactggtatgttgacggagtggaggtccataatgccaaaacaaagccgcgggaggaacagtacaacagcacctatcgcgtggtctctgtgcttacagttctgcaccaggattggctcaatggcaaagagtacaagtgcaaggtgtccaacaaagcgctgcccgcccctatcgaaaagaccattagcaaagctaaggggcagcccagagagcctcaagtctacacgctgcccccgtcccgggacgaactcaccaaaaatcaggtgtctctgacatgtcttgttaagggattttatcctagcgatatcgccgtggagtgggaatccaacggccagcccgagaataactacaagaccacacctcccgtcctggactctgacgggagcttctttctctattccaaactgaccgtggataagagccgctggcaacagggaaacgtgttctcttgctccgttatgcacgaggcccttcataatcactacacacagaaaagcctgtctctctcccctggcaag

SEQ ID NO: 39115 - RNA, 639 nt, synthetic construct
  misc_feature 1..639: note = derived and/or modified sequence opt5 from Ublituximab_LightChain1
  source 1..639: mol_type = other RNA
cagatcgtgctgagccaatcccccgccattctctctgctagccctggcgagaaggtcacgatgacatgcagagcctcctctagcgtttcctacatgcactggtatcagcagaaaccggggtctagccccaagccttggatctacgcgacgtccaacctggctagcggagtgcccgcccggttctctggctccgggagcggaacctcttattcctttacaattagccgcgtggaagccgaggacgctgccacctactattgtcagcaatggacattcaatcctcccacctttggcgggggaacaagacttgaaatcaaacggaccgtcgctgccccttctgtgttcatttttccgccctccgatgagcagcttaagagcggcacggcgtccgttgtgtgcctcctgaacaatttctaccctcgcgaagccaaagtccagtggaaggtggacaacgctctgcagtctggcaatagccaagagtccgttaccgagcaggatagcaaggactctacatattccctgagctctaccctcacactgagcaaagccgattacgaaaagcataaagtgtacgcttgtgaggtcacccaccaggggctgtcctctcccgtgaccaagagctttaacagaggagaatgc

SEQ ID NO: 39116 - RNA, 1353 nt, synthetic construct
  misc_feature 1..1353: note = derived and/or modified sequence opt5 from Ulocuplumab_HeavyChain1
  source 1..1353: mol_type = other RNA
gaggtgcagctggtcgaaagcggcgggggactcgttcaacccggcgggtccctgagactttcttgcgccgctgccggattcacctttagctcctactctatgaactgggtgcggcaggcgcctggcaaggggctggagtgggtgagctatatctcctctcgcagcagaacaatttactatgctgactccgtcaaaggacggttcacgatcagccgcgataatgccaagaactctctctacctgcagatgaactcccttagagacgaagataccgccgtgtattactgtgctcgggactatggcggccagccgccctactactattactatgggatggatgtttggggacaaggcacaaccgtgacagtcagctctgcctccaccaaagggcctagcgtgtttcccctggctccttgctctcgctccacaagcgagtccaccgccgcgctcggatgtctggttaaggactacttccccgaacctgtgacggtctcttggaatagcggcgccctgacctccggggtgcacacatttccggctgtgctccagagctctggactgtattcccttagctctgtcgttaccgtgcccagctcctctctgggcacaaaaacctacacgtgcaatgtggatcataagcctagcaacacaaaggtcgacaaaagagtggagtccaagtatgggcccccttgtcccccgtgccctgcccccgagttcctcggcggacctagcgtttttctgttccctcccaaacccaaggatacccttatgatttctcggacaccggaagtgacctgtgtcgtggttgacgtgtcccaggaggatcccgaagtccagtttaattggtacgtggacggcgtcgaggtgcacaacgctaaaaccaagcctcgcgaggaacaattcaatagcacatacagagttgtgtctgtcctgacggtgctccatcaggattggctgaacgggaaggagtataaatgcaaggtttccaataaaggactgcccagctccatcgaaaagaccatttctaaagccaagggccagcctcgggagccccaggtgtacacactcccgcctagccaagaagagatgaccaaaaaccaggtctccctgacatgtcttgtgaaggggttttatccctctgacatcgcggtggagtgggaaagcaatggacagcctgagaacaattacaagaccacgccccctgttctggactccgatggcagcttctttctctattctcgcctgacagtcgacaaatccagatggcaagaaggcaacgtgttcagctgctctgtgatgcacgaggcccttcataaccactacacccagaagtccctgagcctctctctgggg

SEQ ID NO: 39117 - RNA, 642 nt, synthetic construct
  misc_feature 1..642: note = derived and/or modified sequence opt5 from Ulocuplumab_LightChain1
  source 1..642: mol_type = other RNA
gacatccagatgacccaaagcccctcctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgtgacatactattgtcagcagtacaactcttatcccagaacctttggccaagggacaaaagtggagattaagcggaccgtcgccgctccttccgtgttcatctttccccctagcgacgaacagctgaaatccggaacggcctctgttgtgtgccttctgaataacttctacccgcgcgaggctaaggtccagtggaaggtggataatgccctccagagcggcaactcccaagaaagcgttaccgagcaggactctaaagattccacatatagcctgtctagcaccctgacactctccaaggcggactacgagaaacacaaggtgtacgcctgtgaagtcacccatcagggcctgtctagccccgtgacgaaatcctttaatagaggggagtgc

SEQ ID NO: 39118 - RNA, 1344 nt, synthetic construct
  misc_feature 1..1344: note = derived and/or modified sequence opt5 from Urelumab_HeavyChain1
  source 1..1344: mol_type = other RNA
caggtgcaactgcagcagtggggcgccgggctcctgaagcccagcgagaccctttccctgacatgcgctgtctacggaggctctttcagcgggtattactggtcctggatcagacagtctcctgaaaaaggactcgagtggattggcgaaatcaaccacgggggatatgttacgtacaatccgagcctggagtcccgggtgaccatttctgtggacacaagcaagaaccaattttcccttaaactgagctctgtcaccgccgcggatacagctgtgtattactgtgcccgcgactatggccccggcaattacgattggtacttcgacctctgggggagaggaaccctggttacagtgtccagcgcctctaccaagggcccttccgtctttcccctggctccttgcagccggtctacgtccgaaagcaccgccgctctcgggtgtctggtgaaagattatttccccgagcctgttacagtgtcctggaactctggagcccttaccagcggcgtccatacatttccggcggtgctgcagtccagcgggctctactctctgtccagcgtggtcaccgttccctctagctcccttggaacgaagacatatacctgcaatgtggaccacaagccttctaacacaaaagtggataagcgcgtcgagagcaaatacgggcccccttgtcccccgtgccctgcccccgagttcctgggcggcccttccgtgtttctcttccctcccaagcccaaagacaccctgatgatcagcagaaccccggaggttacatgtgtggtcgtggatgtttctcaggaagaccccgaggtgcagtttaattggtatgtcgatggagtggaggtccataacgctaagacgaagcctcgggaagaacaattcaattccacctaccgcgtggttagcgtgctgacagtcctccaccaggactggctgaacggcaaagaatataagtgcaaagtgtctaataaggggcttccctccagcattgagaaaaccatctccaaggccaaaggacagcctagagaaccccaggtttacacactgccgccttctcaagaggagatgaccaagaaccaggtgagcctcacgtgtctggtcaagggcttttacccctccgatatcgctgtggaatgggagtctaatgggcagcctgaaaacaattataaaacaacaccccctgtgcttgacagcgacggatccttctttctgtacagccggctcaccgttgataagtctcgctggcaagagggcaacgtcttctcctgcagcgtgatgcatgaagccctgcacaaccactatacccagaaatctctgtccctcagcctgggcaag

SEQ ID NO: 39119 - RNA, 648 nt, synthetic construct
  misc_feature 1..648: note = derived and/or modified sequence opt5 from Urelumab_LightChain1
  source 1..648: mol_type = other RNA
gagatcgtgctgacccagagccccgccacactcagcctgtctcctggcgaaagagctacgcttagctgccgggcctcccaatctgtcagctcctacctggcgtggtatcagcagaagccggggcaggctccccgcctcctgatttacgacgcctctaacagagccaccggaatccctgctcggttcagcggctccgggagcggaacagattttacccttacaatttcttccctggagcccgaagacttcgccgtttattactgtcaacagcgcagcaattggcctcccgctctcaccttttgcggcgggacaaaagtggagatcaagagaaccgtggccgcgccttctgtcttcatttttccgccctccgatgaacagctgaaaagcggaacggcctctgtggtttgtctgctcaacaatttctatcctcgggaggctaaggtgcagtggaaagtcgacaacgccctgcaatccggcaatagccaggagtccgtgaccgaacaggattctaaggacagcacatactcccttagctctaccctgacactctccaaggctgattatgagaaacacaaggtttacgcctgcgaagtgacccatcagggcctgagctctcccgtcacgaaatcctttaaccgcggggagtgt

SEQ ID NO: 39120 - RNA, 1347 nt, synthetic construct
  misc_feature 1..1347: note = derived and/or modified sequence opt5 from Urtoxazumab_HeavyChain1
  source 1..1347: mol_type = other RNA
gaggtgcagctggtcgaaagcggcgggggactcgttcaacccggcgggtccctgagactttcttgcgccgctagcggattcaccttttcctcttacggcatgagctgggtgcggcaggcccctgggaagggactggagtgggtggcgacaatctccacgggcggctcttatacctactatccggacagcgtcaaagggcgcttcacaatttccagagataacgctaagaataccctctacctgcagatgaacagccttcgggccgaagacacagccgtgtattactgtgctcgcagaggagatgcctggggcaatctggactattgggggcagggaaccctcgttacagtgtcttccgctagcaccaaaggcccctctgtctttcctctggccccctccagcaagtctacgtccgggggaaccgcggccctgggctgcctcgtgaaagattacttccctgagcccgttacagtgagctggaactccggcgctctgacctctggggtccacacatttcctgccgtgcttcaaagctccggactgtacagcctctcttccgtggtcaccgttccgagctctagcctgggcacgcagacatatatctgtaatgtgaaccataagccctccaataccaaggtggacaaaaaggtcgaacctaaatcttgcgataagacacacacctgtcccccttgccccgctccggagcttctcgggggacctagcgtgttcctgtttccccctaaacccaaggacaccctgatgatttcccggacacccgaggttacgtgtgtggtcgtggatgttagccatgaagaccctgaggtgaagttcaactggtacgtcgatggcgtggaagtccacaatgccaaaaccaagccgcgcgaggagcagtataactctacatacagagtggtttccgtgctgaccgtcctccatcaggactggctgaatgggaaagaatataagtgcaaagtgagcaacaaggcgcttcccgcccctatcgagaaaacaatttctaaggctaagggacaaccccgggaacctcaggtttacaccctgcccccgtcccgcgatgagctcacgaaaaatcaggtgagcctgacatgtcttgtcaagggcttttatccttccgacatcgccgtggaatgggagtctaacggccagcccgagaataactacaaaaccacccctcccgtgctggacagcgatgggtccttctttctctactctaagctgacagttgacaaaagcagatggcaacagggaaacgtcttctcctgcagcgtgatgcacgaagctctgcacaatcattatacccagaagtctctctccctgagccctggcaag

SEQ ID NO: 39121 - RNA, 642 nt, synthetic construct
  misc_feature 1..642: note = derived and/or modified sequence opt5 from Urtoxazumab_LightChain1
  source 1..642: mol_type = other RNA
gagatcgtgctgacgcagagccccgccacactctccgtctctcctggcgaaagagctacgctgagctgccgggcctcccaaaccatttctaacaatcttcactggtaccagcagaagccggggcaggcgccccgcctgctcatcaaaagcgcttcccaatctattagcggaatccctgccagattctccggcagcgggtctggaacagactttaccctgacaatttccagccttgagtctgaagatttcgccgtttattactgtcagcagtcctatagctggcccctgacctttggccaggggacaaaggtggagatcaaacggaccgtggctgccccttctgtcttcatctttcccccttccgacgaacaactcaagagcggaacggcttccgtggtttgcctgctgaacaatttctacccgcgcgaggccaaagtgcagtggaaggtcgataacgcgctccagtctggcaatagccaggagtccgtgaccgaacaagacagcaaggattctacatattccctgagctctacccttacactgagcaaagccgactacgagaagcataaagtttatgcttgtgaagtgacccaccagggcctctcctctcccgtcaccaagagctttaacagaggggagtgc

SEQ ID NO: 39122 - RNA, 1347 nt, synthetic construct
  misc_feature 1..1347: note = derived and/or modified sequence opt5 from Ustekinumab_HeavyChain1
  source 1..1347: mol_type = other RNA
gaggtgcagctggtccagagcggcgccgaagttaagaaacccggggagtccctcaagatctcttgcaaaggaagcggctactccttcaccacatattggctggggtgggtgagacagatgcctggaaagggccttgactggattgggatcatgtctccggtggatagcgacattcggtactccccctcttttcagggacaggtcacgatgagcgtggataaatccatcaccacagcttatctgcaatggaacagcctcaaggcctctgacaccgcgatgtactattgtgctcgcagacggcctggccagggctacttcgatttttgggggcagggaacactggttaccgtgtccagctctagcacaaagggccccagcgtcttccctcttgccccctcttccaaaagcacctccgggggaacggccgctctgggctgcctcgtgaaggactattttcctgaaccggttaccgtgtcttggaatagcggggccctgacatccggagtccacaccttccccgctgtgctgcagagctctggcctctactccctgagctctgtggtcacagttcctagctcctctcttggcacccaaacgtacatttgtaacgtgaatcataaacccagcaacacaaaggtggataaacgcgtcgagcctaagtcctgcgacaagacccacacatgtcccccgtgccctgcccccgaactgctcgggggacctagcgtgtttctgttccctcccaaacccaaggatacccttatgatctctagaaccccggaggttacatgtgtggtcgtggacgtttcccatgaggatcccgaagtgaaatttaattggtatgtcgacggcgtggaggtccacaacgcgaagacgaaacctcgggaggaacagtacaatagcacctatcgcgtggtttctgtgctgacagtcctccatcaggattggctgaacgggaaggagtacaaatgcaaggtgtccaataaggccctgcccgctcctatcgaaaagaccattagcaaggccaaaggacagcccagagagccgcaagtttatacactccctccctcccgggacgaactgaccaagaaccaggtgtctcttacgtgtctggtcaaaggcttctaccctagcgacatcgctgtggagtgggaatccaatgggcagcccgagaacaattataagacaacccctcccgtgctcgattctgacggatcctttttcctgtactccaaacttaccgttgataaaagccgctggcaacagggcaacgtcttttcttgctccgtgatgcacgaggccctgcacaatcattacacacaaaagagcctctctctgtccccgggcaaa

SEQ ID NO: 39123 - RNA, 642 nt, synthetic construct
  misc_feature 1..642: note = derived and/or modified sequence opt5 from Ustekinumab_LightChain1
  source 1..642: mol_type = other RNA
gacatccagatgacccaaagccccagctctctgagcgcctccgtgggcgatagagtcacaattacgtgccgggcttctcaggggatcagctcctggctcgcctggtaccagcagaagcctgagaaagcgccgaagtctctgatttatgctgccagctcccttcaaagcggagttccctctcgcttctccggcagcgggtctggaaccgactttacactgaccatctccagcctccagcctgaagatttcgccacatactattgtcagcagtacaacatttatccctacacctttggccaagggacaaaactggagatcaagagaaccgtggctgccccttctgtgttcatctttcccccttccgacgaacagcttaaaagcggaacggcttccgtcgtgtgcctgctcaataacttctatccgcgggaggccaaggttcagtggaaggtggataatgcgctgcagtctggcaacagccaagaatccgtcaccgagcaggacagcaaagattctacatactccctgagctctaccctcacactgagcaaggccgactacgagaaacacaaggtgtatgcttgtgaagttacccatcagggcctttcctctcccgtgacgaaatcctttaatcgcggggagtgc

SEQ ID NO: 39124 - RNA, 1341 nt, synthetic construct
  misc_feature 1..1341: note = derived and/or modified sequence opt5 from Vadastuximab_talirine_HeavyChain1
  source 1..1341: mol_type = other RNA
caggtgcaactggtccagagcggcgccgaggttaagaaacccggggcttccgtgaaggtgtcttgcaaagccagcggatacaccttcacaaactatgacatcaattgggtcagacaggcgcctggccaggggctcgaatggattggatggatctacccgggcgatgggtccacgaagtataacgagaaatttaaggctaaggccaccctgacagccgacacctctacaagcaccgcttacatggaacttcggtccctgcgctctgatgacacagccgtgtattactgtgctagcggatatgaggatgccatggactactggggccaaggcaccacggttaccgtgtccagcgcgtctacaaaagggccctccgtcttccctctcgcccccagctctaagtccaccagcggaggcacagctgccctggggtgccttgtgaaagattactttcctgaacccgttaccgtgtcttggaactccggagctctgacgagcggcgtccacacattccctgccgtgctccagtcctctgggctgtatagcctgtccagcgtggtcaccgttccgtcttccagcctcggaacacagacctacatttgtaatgtgaatcataagccctctaacaccaaagtggacaagaaggtcgagcctaaaagctgcgataagacacacacgtgtcccccttgccccgcgccggagctgcttggcggcccttgtgtgtttctgtttccccctaaacccaaggacaccctcatgatctccagaacacccgaagttacctgcgtggtcgtggatgtttctcatgaggaccctgaagtgaaattcaattggtatgtcgatggggtggaggtccacaacgccaagacaaaaccgcgggaggaacagtacaatagcacctatcgcgtggtttccgtgctgacggtccttcatcaagactggctgaacggaaaggagtacaagtgtaaagtgagcaataaggctctccccgcccctattgagaaaacaatctctaaggctaaaggccagcccagagaacctcaggtttataccctgcccccgtcccgggacgaactgaccaagaaccaggtgagcctcacatgcctggtcaaggggttctacccttctgatatcgccgtggagtgggagtccaatggacaacccgaaaacaattacaaaaccacacctcccgtgcttgacagcgatggctcctttttcctgtattctaagctcacggttgacaaaagccgctggcagcaggggaacgtcttttcctgttctgtgatgcacgaggccctgcacaaccattacacccaaaagagcctttccctgagccctggaaaa

SEQ ID NO: 39125 - RNA, 642 nt, synthetic construct
  misc_feature 1..642: note = derived and/or modified sequence opt5 from Vadastuximab_talirine_LightChain1
  source 1..642: mol_type = other RNA
gacatccagatgacccaaagcccctcctctctgagcgcctccgtgggcgatagagtcacaattaactgcaaggcttctcaggacatcaatagctacctctcctggttccagcagaaacctgggaaggccccgaaaacgctgatttatcgggcgaaccgccttgttgatggagtgccctctagatttagcggctccgggagcggacaagactacaccctgacaatctcttccctccagcctgaggatttcgctacctattactgtctgcagtatgacgaatttccccttacattcggcgggggaaccaaggtggagattaaacggacagtcgccgcccctagcgtgtttatctttcccccttctgatgaacagctgaagtccggcaccgctagcgttgtgtgcctcctgaataacttctacccgcgcgaggccaaggtccaatggaaagtggacaatgctctgcagtctggcaactcccaggaaagcgttacggagcaggattccaaggactctacctatagcctctccagcacactgaccctttctaaagccgattacgagaagcacaaagtgtacgcgtgtgaagtcacacatcaagggctgtccagccccgtgaccaagtctttcaatagaggagagtgc

SEQ ID NO: 39126 - RNA, 1362 nt, synthetic construct
  misc_feature 1..1362: note = derived and/or modified sequence opt5 from Vandortuzumab_vedotin_HeavyChain1
  source 1..1362: mol_type = other RNA
gaggtgcagctggtcgaaagcggcgggggactcgttcaacccggcgggtccctgagactttcttgcgccgtgagcggatactccatcacctctgactatgcttggaactgggtgcggcaggcccctggcaaggggctggagtgggtcggatacattagcaattccggctctacaagctataacccgtccctcaaaagccgcttcacgatctctagagatacctccaagaatacactgtaccttcagatgaacagcctgcgggcggaagacaccgctgtgtattactgtgcccgcgagagaaattatgattacgacgattactattacgccatggactattggggccaggggacactcgttaccgtgtcttccgctagcacaaaaggaccctctgtctttcctctggccccctccagcaagtccacctctggcgggacggctgccctgggatgcctcgtgaaagattacttccctgaacccgttaccgtgagctggaactccggcgcgctgacaagcggggtccacacctttcctgccgtgcttcaatcttccggactgtatagcctctctagcgtggtcacagttccgtcctctagcctgggcacccagacgtacatttgtaatgtgaaccataagccctccaatacaaaggtggacaaaaaggtcgagcctaaaagctgcgataagacccacacatgtcccccttgccccgctccggagcttctgggcgggccttctgtgttcctctttccccctaaacccaaggacaccctgatgatctcccggacccccgaagttacatgtgtggtcgtggatgttagccatgaggaccctgaagtgaagttcaactggtatgtcgatggagtggaggtccacaatgccaaaacgaagccgcgcgaggaacagtacaactctacctacagagtggtttccgtgctgacagtcctccatcaggactggctgaatggcaaagagtataagtgcaaagtgagcaacaaggcccttcccgctcctattgagaaaaccatctccaaggcgaaggggcaaccccgggaacctcaggtttacacactgcccccgtctcgcgaagagatgaccaaaaatcaggtgagcctcacgtgtctggtcaagggattttatccttccgacatcgccgtggagtgggaatctaacggccagcccgagaacaattacaaaacaacccctcccgtgcttgatagcgacgggtccttctttctgtatagcaagctcaccgttgataaatctagatggcaacagggaaacgtcttctcctgcagcgtgatgcacgaagctctgcacaatcattacacacagaagtctctgtccctcagccctggcaag

SEQ ID NO: 39127 - RNA, 660 nt, synthetic construct
  misc_feature 1..660: note = derived and/or modified sequence opt5 from Vandortuzumab_vedotin_LightChain1
  source 1..660: mol_type = other RNA
gacatccagatgacccaaagcccctcctctctgagcgcctccgtgggcgatcgggtcacaattacgtgcaagtctagccagtccctcctgtaccggtctaaccagaaaaattatcttgcttggtaccagcaaaagcctgggaaagccccgaagctgctcatctattgggcgagcacccgcgagtccggagttcccagcagattctctggctccgggagcggaacagactttaccctgacaatttcttcccttcagcctgaagatttcgctacctactattgtcagcagtactataactacccccggacatttggccaagggaccaaagtggagatcaagcgcacggtggccgcccctagcgtcttcatttttcccccttctgacgaacagctgaagtccggaaccgctagcgtggtttgcctcctgaataacttctacccgagagaggccaaagtgcagtggaaggtcgataatgctctgcagtccggcaactctcaagaaagcgtgacagagcaggactccaaagatagcacctattctctctccagcacactgaccctttctaaggccgactacgagaaacacaaggtttatgcgtgtgaagtgacgcatcagggcctgagctcccccgtcacaaagtcttttaatagaggggagtgc

SEQ ID NO: 39128 - RNA, 1329 nt, synthetic construct
  misc_feature 1..1329: note = derived and/or modified sequence opt5 from Vantictumab_HeavyChain1
  source 1..1329: mol_type = other RNA
gaggtgcagctggtcgaaagcggcgggggactcgttcaacccggcgggtccctgagactttcttgcgccgctagcggattcaccttttcccactacacactgtcttgggtgcggcaggcccctggcaaggggctcgagtgggtgagcgtcatctccggagacggctcttatacgtactatgcggatagcgtgaaaggccgcttcaccatttccagcgacaactctaagaatacactgtaccttcagatgaactccctgagagctgaagataccgccgtttattactgtgcccggaattttatcaaatatgtgttcgctaactgggggcagggaacactcgtcaccgtgagctctgcctccacaaagggcccgagcgtttttcccctggctccttgctctcgctccaccagcgagtccacggccgcgctggggtgtctcgtgaaagactacttccccgaacctgtcaccgtgtcttggaatagcggagccctgacatccggcgtgcatacctttcccgctgtccttcaaagctctgggctgtactccctcagctctgttgtgacagtgcctagctccaacttcggaacccagacgtatacatgcaatgtcgatcacaagccgtctaacaccaaggtggacaaaacagttgagagaaagtgttgcgtggagtgtcccccttgccccgcccctcccgtcgctggcccgagcgtgtttctgttccctcccaaacctaaggatacccttatgatttcccggacccccgaagttacatgtgtggtcgtggacgtcagccatgaggatcccgaagtgcagtttaattggtacgttgacggcgtggaggtccacaacgccaaaacgaagcctcgcgaggaacagttcaattctacctttagagtggtttccgtgctgacagtcgtgcatcaagattggctcaacgggaaggagtataaatgcaaggtgagcaataaaggactgccggcgcccatcgaaaagaccatttctaaaacaaagggccagcctcgggagccccaggtttacaccctgcctccctcccgcgaagagatgacgaaaaaccaggtcagcctcacatgtctggtgaaggggttctatccgtccgacatcgccgtggagtgggaatctaatggacaacctgagaacaactacaagaccacaccccctatgcttgatagcgacggctccttctttctgtattctaaactcaccgtcgacaagagcagatggcagcaggggaatgtgttctcctgcagcgttatgcacgaagctctgcacaaccattacacccaaaaatctctttccctgagccccgga

SEQ ID NO: 39129 - RNA, 639 nt, synthetic construct
  misc_feature 1..639: note = derived and/or modified sequence opt5 from Vantictumab_LightChain1
  source 1..639: mol_type = other RNA
gacatcgagctgacccagccccctagcgtgtccgtcgccccgggccaaacagctagaatttcttgcagcggggataacatcggatccttctacgttcactggtatcagcagaagcccggccaggcccctgtgctcgtgatttacgacaaatctaatcggcccagcgggatccctgaacgcttttccggatctaacagcggcaatacggcgaccctgacaatttccgggacccaagctgaggatgaagccgactattactgtcagagctatgccaacacactttctctggtcttcggaggcggcaccaagctcacagtgctggggcagcccaaagctgccccttccgttaccctttttccgcccagctctgaggaactgcaggctaataaggccacgctcgtgtgcctgatctccgatttctaccctggagcggtcaccgtggcctggaaagctgacagctctcccgttaaggccggcgtggagacaaccacaccttccaagcaaagcaacaataaatatgctgcctcctcttacctgagcctcacccccgagcagtggaagtcccatagaagctactcttgtcaggtcacgcacgaagggtccacagtggagaaaaccgtggcgccgacagaatgcagc

SEQ ID NO: 39130 - RNA, 1389 nt, synthetic construct
  misc_feature 1..1389: note = derived and/or modified sequence opt5 from Vanucizumab_HeavyChain1
  source 1..1389: mol_type = other RNA
caggtgcaactggtccagagcggcgccgaggttaagaaacccggggcttccgtgaaggtgtcttgcaaagccagcggatacaccttcacaggctattacatgcactgggtcagacaggcgcctgggcagggactcgaatggatgggctggatcaaccccaattccgggggaacgaactatgctcaaaagtttcagggccgggtgaccatgacacgcgacacctctattagcacagcctacatggagctgtccagacttcggtctgatgacaccgccgtttattactgtgctcgcagccccaatccttattactacgattccagcggctattactatcccggggccttcgacatctggggacagggcacaatggtgaccgtctcttccgctagcgtggccgcgccttctgtttttattttcccgccttccgatgaacagctgaaaagcgggacggcctctgtggtctgcctcctgaacaatttttacccgagagaggctaaggtgcaatggaaggtggacaacgcccttcagtccggaaatagccaggaatccgtcaccgagcaggattctaaagacagcacatattccctgagctctaccctcacactgtccaaggctgattacgagaaacataaggtttatgcctgtgaagtgacccaccaaggcctgagctctcccgtgacgaaatccttcaaccggggagagtgcgacaagacacatacctgtcctccctgccctgcgcccgaactcctgggaggcccgagcgtctttcttttccctcccaagcctaaagatacactgatgatctctcgcacccccgaggtgacctgtgttgtggtcgacgtgagccacgaggatcccgaagttaagtttaattggtacgtggacggcgtcgaggtgcataacgccaaaacaaagcctagagaggaacagtacaattccacgtatcgggtcgtgagcgttctcaccgtgctgcaccaggactggcttaacgggaaagaatacaagtgcaaagtctctaataaggctctgccggcccccattgagaagacaatctccaaagctaagggacaacctcgcgagccccaggtgtgtaccctccctcccagcagagatgaactgacaaagaaccaggtttctctgtcctgcgccgtgaagggcttctatccgagcgacatcgccgtcgagtgggaatccaatgggcagcctgagaacaactacaaaaccacgccccctgtgctcgattctgacgggagctttttcctggtgtccaaacttacagttgataagtctcggtggcaacagggcaatgtctttagctgttccgtgatgcacgaagctctgcataaccactatacccagaaaagcctctctctgtcccccgggaag

SEQ ID NO: 39131 - RNA, 1359 nt, synthetic construct
  misc_feature 1..1359: note = derived and/or modified sequence opt5 from Vanucizumab_HeavyChain2
  source 1..1359: mol_type = other RNA
gaggtgcagctggtcgaaagcggcgggggactcgttcaacccggcgggtccctgagactttcttgcgccgctagcggatacaccttcacaaactatggcatgaattgggtgcggcaggcccctgggaagggactggagtgggtgggctggatcaacacgtacaccggcgaaccgacatatgcggctgactttaaacgcagattcaccttttccctcgatacatctaagagcaccgcctacctgcagatgaatagccttcgggccgaggacacagctgtctattactgtgccaaatatccccactactacgggtctagccattggtatttcgatgtgtggggacagggcaccctggttacggtgtccagcgcttctaccaaggggccttccgtctttcccctcgcccctagctctaaatccacaagcggaggcaccgcggccctggggtgcctggtgaaggactacttccccgaacctgttacagtgtcttggaactccggagctctcaccagcggcgtccacacgtttccggccgtgctgcaatcctctggcctttatagcctgtccagcgtggtcacagttccctcttccagcctcgggacccagacatacatttgtaatgtgaaccataagccttctaataccaaagtggataagaaagtcgagcccaagagctgcgacaaaacccacacatgtcctccctgcccggctcctgagctgcttggaggcccctccgtgttcctgtttcctcccaagcccaaggatacgctcatgatctctcgcacccctgaagttacatgtgtggtcgtggacgttagccatgaggatccggaagtgaaattcaactggtatgtcgacggggtggaggtccacaatgccaagaccaaacccagagaggaacagtacaactccacatatcgggtggttagcgtgctgaccgtcctgcaccaggattggctcaatggaaaggagtacaaatgcaaggtgtctaacaaagcgctgcctgcccccattgaaaagacgatctccaaggctaaaggccaacctcgcgagccccaggtttacacacttccgccttgtagagacgaactgaccaagaatcaggtgagcctctggtgcctggtcaaagggttttatccctctgatattgccgtggagtgggagtccaacggacagcctgaaaataactacaagaccacaccccctgtgcttgacagcgacggctccttctttctgtattctaaactcaccgttgataagagccggtggcaacagggcaacgtcttctcctgttctgtgatgcatgaggctctgcacaatcattacacacagaagtccctgtccctcagccccgggaaa

SEQ ID NO: 39132 - RNA, 639 nt, synthetic construct
  misc_feature 1..639: note = derived and/or modified sequence opt5 from Vanucizumab_LightChain1
  source 1..639: mol_type = other RNA
cagcccggcctgacccaacctccgagcgtgtccgtcgcccccgggcagacagctagaatcacgtgcggaggcaacaatattgggtctaagagcgttcactggtaccagcagaaacctggacaagcccccgtgctcgtggtctatgacgattccgaccggccttctggcatccccgagcgcttcagcgggtccaactctggaaataccgcgacactgaccattagcagagtggaagctggcgatgaggccgactactattgtcaggtttgggattccagctctgaccattacgtgtttggcacagggaccaaggtcacagtgctttccagcgcctctaccaaaggaccttccgttttcccgctggctcccagctctaagtccacgagcggcgggaccgccgctctcggatgcctggtgaaagattattttcctgaacccgtcacagtgtcctggaactctggcgcccttaccagcggggtgcacacattccctgcggtcctgcagtccagcggactctactctctgtccagcgttgtgaccgtgccctctagctccctgggcacgcagacatatatctgtaatgtcaaccataagccgtctaataccaaggtggacaaaaaggttgagcctaaaagctgc

SEQ ID NO: 39133 - RNA, 642 nt, synthetic construct; identical to SEQ ID NO: 38294
  misc_feature 1..642: note = derived and/or modified sequence opt5 from Vanucizumab_LightChain2
  source 1..642: mol_type = other RNA

SEQ ID NO: 39134 - RNA, 1356 nt, synthetic construct
  misc_feature 1..1356: note = derived and/or modified sequence opt5 from Varlilumab_HeavyChain1
  source 1..1356: mol_type = other RNA
caggtgcaactggtcgagagcggcgggggagttgtgcagcccggcagatccctccggctgtcttgcgccgctagcgggttcaccttttcctcttacgacatgcactgggtgcgccaggcccctggaaagggccttgaatgggtcgcggtgatctggtatgatgggagcaacaaatactatgctgactccgttaagggaagattcacaatttctcgggataatagcaaaaacacgctgtacctccagatgaactccctgcgcgccgaggacaccgccgtgtattactgtgctagaggcagcggcaattgggggtttttcgattattggggacaaggcacacttgtcaccgtgtcttccgccagcacaaaggggccgtctgtttttcccctggctccttccagcaaatctacctccggaggcacagccgcgctcgggtgcctggtgaaggactacttccccgaacctgtcaccgtgagctggaactccggagccctgacgtctggcgtgcatacctttcccgctgtcctccagagctccggcctgtacagcctttcttccgttgtgacagtgcctagctctagcctggggacccagacatatatctgtaatgtcaatcacaagccgtccaacaccaaagtggataagaaagttgagcccaagtcttgcgacaaaacgcatacatgtcctccctgccctgcccccgaactcctgggaggcccgagcgtgttcctttttcctcccaagcctaaggataccctgatgatttcccggacacccgaggtcacctgtgtggttgtggacgtcagccacgaggatcccgaagtgaaattcaattggtacgtcgacggggtggaggttcataacgctaagaccaaacctcgcgaggaacagtataattctacatacagagtggtctccgtgctcacggttctgcaccaagattggctgaacggaaaggagtataaatgcaaggtgagcaataaagccctcccggcgcccatcgaaaagaccatttctaaggccaaaggccagcctcgggagccccaggtctacacactgcctccctcccgcgacgaacttaccaagaaccaggtgagcctgacatgtctcgtgaaagggttttatccgtccgacatcgctgttgagtgggaatctaatggacaacctgagaacaactacaagaccacgccccctgtcctggatagcgacggctccttctttctttactctaaactgacagtggataagagcagatggcagcagggcaatgtgttctcctgcagcgtcatgcacgaggccctccataaccactatacccaaaagtctctgtccctgagccccgggaaaggatcttcc

SEQ ID NO: 39135 - RNA, 642 nt, synthetic construct
  misc_feature 1..642: note = derived and/or modified sequence opt5 from Varlilumab_LightChain1
  source 1..642: mol_type = other RNA
gacatccagatgacccaaagcccctcctctctgagcgcctccgtgggcgatcgggtcacaattacgtgccgggcttctcaggggatcagccgctggctcgcctggtaccagcagaagcctgagaaagcgccgaagtccctgatttatgctgcctctagccttcaatccggagttcccagcagattctctggctccgggagcggaaccgactttacactgaccatctcttccctccagcctgaagatttcgccacatactattgtcagcagtacaacacctatccccggacatttggccaagggaccaaagtggagattaagcgcacggtggctgcccctagcgtcttcatctttcccccttctgacgaacagctgaaatccggaaccgctagcgtggtttgccttctgaataacttctacccgagagaggccaaggtgcagtggaaggtcgataatgcgctccagtccggcaactctcaagaaagcgtgacagagcaggactccaaagatagcacctattctctgtccagcacactgaccctctctaaggccgactacgagaaacacaaggtttacgcttgtgaagtgacgcatcagggcctgagctcccccgtcacaaaatcttttaatagaggggagtgc

SEQ ID NO: 39136 - RNA, 1338 nt, synthetic construct
  misc_feature 1..1338: note = derived and/or modified sequence opt5 from Vatelizumab_HeavyChain1
  source 1..1338: mol_type = other RNA
caggtgcaactgcaggagagcggccccgggctcgtcaagccttccgaaaccctgtctcttacatgcacggttagcggattctccctgaccaactacggcatccactggattagacagccgcccgggaaaggactcgagtggctgggcgtgatctgggcccgggggtttacaaattataactctgctcttatgagccgcctgaccatttccaaggacaattctaaaaaccaggtgagcctcaagctgtccagcgtcacagccgcggataccgctgtgtactattgtgccagagccaatgacggagtttactatgctatggattactggggccaaggcacactggtgaccgtctcttccgccagcacgaaagggccttctgtgttccccctcgctccttgctcccggagcacctctgaatccacagccgcgctgggatgtcttgttaaggactattttcccgagcctgtgaccgtcagctggaactccggcgccctgacatctggggtgcataccttcccggctgtgctccagagctccggactgtacagcctttcttccgtcgttacggtgcccagctctagcctgggcacaaagacctacacatgcaatgtggatcacaaaccttccaacaccaaggtcgacaaacgcgtggaatctaagtatgggcccccttgtcccagctgcccggcccctgagtttctcggaggcccctccgttttcctgtttcctcccaaacccaaggataccctgatgatcagcagaacacctgaggtgacgtgtgtcgtggttgacgtgtctcaggaagatccggaggtccagttcaattggtacgtggacggcgtcgaagtgcataacgctaagaccaaaccccgggaggagcaatttaattccacatatcgcgttgtgagcgtcctcaccgtgctgcaccaggattggcttaacgggaaggaatacaaatgcaaggtttctaataaaggactgccttccagcattgagaagacaatctccaaagccaagggccagcccagagaacctcaggtgtataccctgcccccgtctcaagaggaaatgacgaagaaccaggtcagcctcacatgtcttgtgaaagggttctacccttccgacatcgcggtggagtgggagtctaatggacagcccgaaaacaactataagaccacccctcccgttctggatagcgacggctcctttttcctctacagccggctgacagtcgacaaatctcgctggcaagaggggaatgtgttttcctgcagcgtgatgcatgaagccctgcacaaccactacacccagaagtctctctccctgagccttggaaaa

SEQ ID NO: 39137 - RNA, 639 nt, synthetic construct
  misc_feature 1..639: note = derived and/or modified sequence opt5 from Vatelizumab_LightChain1
  source 1..639: mol_type = other RNA
gacttcgtgatgacccagagccccgcctttctgtccgtcacacctggcgagaaggttacgattacctgctctgctcaaagctccgtgaactacatccactggtatcagcagaaaccggatcaggcccccaagaaactcatctacgacacatctaagctggcgagcggggtgccttccagattctctggaagcggctccgggaccgattatacatttaccattagctctcttgaagctgaggacgccgccacatactattgtcaacagtggaccacgaatcccctgaccttcggacagggcacaaaagtcgaaatcaagcggaccgtggctgccccttccgtttttatttttccccctagcgatgagcagctcaagtctgggacagcttccgtggtctgcctgcttaacaatttctacccgcgcgaagccaaagtgcaatggaaggttgacaacgcgctgcagagcggaaattctcaggagtccgtgaccgagcaggatagcaaagactccacgtattctctcagctccacactgaccctgagcaaggccgattacgaaaaacataaggtctacgcttgtgaggtgacacaccaaggcctctcttcccccgtgaccaagagcttcaacagaggcgaatgc

SEQ ID NO: 39138 - RNA, 1353 nt, synthetic construct
  misc_feature 1..1353: note = derived and/or modified sequence opt5 from Vedolizumab_HeavyChain1
  source 1..1353: mol_type = other RNA
caggtgcaactggtccagagcggcgccgaggttaagaaacccggggcttccgtgaaggtgtcttgcaaaggaagcggctacaccttcacatcctattggatgcactgggtcagacaggcccctgggcagcggctcgaatggatcggagagattgacccgtctgaaagcaacacgaattacaaccaaaagtttaaaggccgcgtgaccctgacagttgatatctccgcgtctaccgcttatatggagcttagctccctgagaagcgaagacacagccgtgtactattgtgcccgcgggggatacgatggctgggactatgctattgattactggggccaggggaccctcgtcacagtgtcttccgccagcaccaagggaccctctgttttccctctggctccctccagcaagtctacgtccggcgggaccgccgcgcttggatgcctggtgaaagactactttcctgagcccgtcacagtgagctggaactccggcgccctcacctctggggtgcatacattccctgctgtcctgcagagctccggactgtatagcctctcttccgttgtgaccgtgccgagctctagcctgggcacgcagacatacatctgtaatgtcaatcacaagccctccaacaccaaagtggataagaaagttgagcctaagtcttgcgacaagacacatacctgtcccccttgccccgccccggaacttgctggcgcccctagcgtgtttctgtttccccctaaacccaaggataccctcatgatttcccggacacccgaggtcacgtgtgtggttgtggacgtcagccacgaagatcctgaggtgaaattcaattggtatgtcgacggggtggaggttcataacgcgaagaccaaaccgagagaggaacaatacaattctacatatcgggtggtctccgtgctgaccgttcttcaccaggattggctgaacggaaaggaatacaaatgcaaggtgagcaataaggccctccccgctcctatcgagaaaacaatctctaaggccaaaggccagccccgcgaacctcaggtctataccctgcccccgtccagagacgagctgacgaagaaccaagtgagcctcacatgtctggtgaaagggttctacccttccgacattgctgttgagtgggaatctaatggacagcccgagaacaattacaagaccacccctcccgtccttgatagcgacggctcctttttcctgtattctaagctcacagtggataaaagccggtggcagcaagggaacgtgttttcctgcagcgtcatgcacgaagccctgcataaccactacacccagaagtctctttccctgagccctggaaaa

SEQ ID NO: 39139 - RNA, 657 nt, synthetic construct
  misc_feature 1..657: note = derived and/or modified sequence opt5 from Vedolizumab_LightChain1
  source 1..657: mol_type = other RNA
gacgtggtcatgacccagagccccctgtccctccctgttacaccgggcgagcccgcctctatcagctgcagatcctctcaaagcctggctaagtcctacgggaacacgtatctttcttggtacctgcagaaacctggacagagcccccagctcctgatttatggcatctccaatcggttcagcggggtgcctgatcgcttttctggatccggcagcgggaccgacttcacacttaagatttctagagtggaagccgaggatgtcggagtgtactattgtctgcaaggcacccaccagccctacacatttggccaggggaccaaagttgaaatcaagcggacagtggcggctccttccgtcttcatttttccgcccagcgacgagcagctcaaatctggaaccgcctccgtggtttgcctgctgaacaatttctatcctcgcgaagccaaggtgcaatggaaggtcgataacgctctccagagcggcaattcccaggagtctgtgacggagcaggacagcaaagattccacctacagcctgtcttccacacttaccctgagcaaggccgactacgaaaaacataaggtgtatgcttgtgaggtcacacaccaagggctctctagccccgttaccaaatcctttaacagaggagaatgc

SEQ ID NO: 39140 - RNA, 1353 nt, synthetic construct
  misc_feature 1..1353: note = derived and/or modified sequence opt5 from Veltuzumab_HeavyChain1
  source 1..1353: mol_type = other RNA
caggtgcaactgcagcagagcggcgccgaggtcaagaaacccgggtcctctgttaaggtgagctgcaaggcttccggatacaccttcacatcttataacatgcactgggtgaaacaggcccctggccaagggctcgaatggatcggagcgatttacccgggcatgggggacacgagctataatcagaaatttaagggaaaggctaccctgacagccgatgagtccaccaacacagcctacatggaactttctagcctgagatccgaggacaccgctttctattactgtgcccggagcacatattacggcggcgattggtactttgacgtctgggggcagggaaccacggtgaccgtttcttccgctagcacaaaaggcccctctgtgttccctctcgccccctccagcaagtctacctccgggggaacagcggccctgggctgccttgtcaaagattattttcctgaacccgtgaccgttagctggaactccggggctctgacgtctggagtgcatacattccctgccgtcctccagagctccggcctgtacagcctgtcttccgtggtgaccgtcccgagctctagcctcggcacacaaacctatatctgtaatgttaatcacaagccctccaacaccaaagtggacaagcgcgtggagcctaagtcttgcgataaaacacatacgtgtcccccttgccccgctccggagctgcttgggggacctagcgtctttctgtttccccctaagcccaaagacaccctcatgatttccagaacacccgaagtgacctgtgttgtggtcgatgtgagccacgaggaccctgaagttaagtttaattggtacgtggatggcgtcgaggtgcataacgccaaaacaaagccgcgggaggaacagtataattctacctaccgcgtcgtgtccgttctgacggtgcttcaccaggactggctgaacgggaaagagtataagtgcaaggtcagcaataaagcgctccccgcccctatcgaaaagacaatttctaaagctaagggacagcccagagagcctcaagtgtacaccctgcccccgtcccgggaagagatgaccaaaaaccaggttagcctgacatgtctcgtgaagggcttctacccttccgatatcgccgtcgagtgggaatctaatgggcagcccgagaacaattataagaccacacctcccgtgctggacagcgacggatcctttttcctttactctaaactgacggtggataagagccgctggcaacagggcaacgttttctcctgcagcgtcatgcacgaagctctccataaccactatacccagaaatctctgtcccttagccctggcaag

SEQ ID NO: 39141 - RNA, 639 nt, synthetic construct
  misc_feature 1..639: note = derived and/or modified sequence opt5 from Veltuzumab_LightChain1
  source 1..639: mol_type = other RNA
gacatccagctgacccaaagcccctcctctctcagcgcctccgtgggcgatagagtcacaatgacgtgccgggcttctagctccgtttcttacattcactggttccagcagaagcctgggaaagccccgaagccctggatctatgcgaccagcaacctggcttccggagtgcctgtgcgctttagcggctctgggtccggaacagactacaccttcacaattagctctcttcagcccgaggatatcgccacctattactgtcaacagtggacatccaatcctcccacctttggcgggggaacgaaactggaaattaagagaaccgtcgccgctcctagcgtgttcatctttccgccctctgacgagcagctcaaatccggcacagccagcgttgtgtgcctgcttaacaatttctatcctcgggaagctaaggtccagtggaaggtggataacgccctgcaatccggcaattctcaggagagcgttaccgaacaggactccaaagatagcacatactctctctccagcaccctgacgctgtctaaggcggactatgagaaacataaggtgtacgcctgtgaggtcacacaccaggggctcagctcccccgtgaccaaatcttttaaccgcggagaatgc

SEQ ID NO: 39142 - RNA, 1359 nt, synthetic construct
  misc_feature 1..1359: note = derived and/or modified sequence opt5 from Vesencumab_HeavyChain1
  source 1..1359: mol_type = other RNA
gaggtgcagctggtcgaaagcggcgggggactcgttcaacccggcgggtccctgagactttcttgcgccgctagcggattcaccttttcctcttacgccatgagctgggtgcggcaggcgcctggcaaggggctggagtgggtgtcccagatctctccggctggaggctatacaaactacgccgacagcgtcaaaggccgcttcacgatttccgccgataccagcaagaatacagcttatctccagatgaactctctgagagccgaagacaccgctgtgtactattgtgcccgcggggagcttccctactatcggatgtccaaagttatggatgtgtggggacaaggcacactggtcaccgtgagctctgcgtccacaaaggggcctagcgtttttcccctcgccccttcttccaaaagcacctccggaggcacggctgccctggggtgcctggtgaaggactacttccccgaacctgtcaccgtgtcttggaatagcggagctctcacatccggcgtgcacacctttccggccgtcctgcagagctctggcctttactccctgagctctgttgtgacagtgcccagctcctctctcgggacccagacgtatatctgtaacgtcaatcataagcctagcaacacaaaagtggataagaaagttgagcccaagtcctgcgacaaaacccacacatgtcctccctgcccggcgcctgagctgcttggaggccccagcgtgttcctgtttcctcccaagcccaaggataccctcatgatttctagaacccctgaagtcacatgtgtggttgtggacgtctcccatgaggatccggaagtgaaattcaattggtacgtcgacggggtggaggttcacaacgccaagacgaaaccccgggaggaacagtataatagcacctaccgcgtggtctctgtgctgacagttctgcatcaagattggctcaacggaaaggagtataaatgcaaggtgtccaataaagctctgcctgcccccatcgaaaagaccattagcaaggctaaaggccagcctagagagccccaggtctacacacttccgccttcccgggaagagatgaccaagaaccaggtgtctctgacgtgtctcgtgaaagggttttatcccagcgacatcgccgttgagtgggaatccaatggacaacctgagaacaattacaagacaacaccccctgtcctggattctgacggcagcttctttctttactccaaactgaccgtggacaagagccgctggcagcagggcaacgtgttctcttgctccgtcatgcacgaagccctccacaaccattatacccaaaagagcctgtctctgtcccccgggaaa

SEQ ID NO: 39143 - RNA, 642 nt, synthetic construct
  misc_feature 1..642: note = derived and/or modified sequence opt5 from Vesencumab_LightChain1
  source 1..642: mol_type = other RNA
gacatccagatgacccaaagccccagctctctgagcgcctccgtgggcgatagagtcacaattacgtgccgggcttctcagtacttcagctcctatctcgcctggtaccagcagaagcctgggaaagcgccgaagctgcttatctatggagcttctagccgcgcctccggcgttcccagcagattttctgggtccggaagcggcaccgacttcacactgaccatttcttccctccaacctgaggattttgccacatactattgtcagcagtacctggggtctccccctaccttcggacagggcacaaaagtggaaatcaagcggaccgtggctgcccccagcgtctttattttccctccgtccgacgagcaacttaaaagcggcacggcttccgtggtttgcctgctcaacaatttttatccccgcgaagccaaggtgcagtggaaggtcgataacgcgctgcagtctgggaatagccaggagtccgtgaccgaacaagacagcaaagattctacatactccctgagctctaccctcacactgagcaaggccgactacgagaaacacaaggtttatgcttgtgaggtgacccatcagggactttcctctcctgtcacgaaatccttcaacagaggcgaatgc

SEQ ID NO: 39144 - RNA, 1338 nt, synthetic construct
  misc_feature 1..1338: note = derived and/or modified sequence opt5 from Visilizumab_HeavyChain1
  source 1..1338: mol_type = other RNA
caggtgcaactggtccagagcggcgccgaggttaagaaacccggggcttccgtgaaggtgtcttgcaaagccagcggatacaccttcatctcctatacaatgcactgggtcagacaggcgcctggccaggggctcgaatggatgggatacattaacccgcggtctggctatacgcattacaatcaaaagctgaaagacaaggctacccttacagccgataagagcgcctccaccgcttatatggagctgtctagcctccgctccgaagacacagccgtgtactattgtgctagaagcgcctactacgattatgacgggtttgcgtactggggacagggcaccctggttacagtgtcttccgccagcaccaaaggcccctctgtcttccctcttgctccctgctcccggagcacgtctgagtccaccgccgctctggggtgtctcgtgaaggattattttcctgaacccgttacagtgagctggaactccggagccctgacctctggcgtccacacattccctgcggtgctgcagagctccgggctctacagcctgtcttccgtggtcaccgttccgagctctaattttggaacgcagacatatacctgcaacgtggaccataaacccagcaatacaaaggtggataaaaccgtcgagcgcaagtgttgcgtggagtgtcctccctgccctgctcccccggccgccgctccttccgttttcctttttccccctaagcccaaagacaccctgatgatctctagaacacccgaagtgacgtgtgtcgtggttgatgtgagccacgaggaccctgaagtccaattcaactggtacgtggatggcgtcgaggtgcataatgccaagaccaaaccgcgggaggaacagtttaactccacattccgcgttgtgagcgtcctcaccgtggttcaccaggactggctgaatgggaaggagtataaatgcaaggtgtctaacaaaggacttcccgcccctattgaaaagacaatctccaagaccaaaggccagcccagagagcctcaagtctacacgctgcccccgagccgggaagagatgacaaagaatcaggtgtctctcacctgtctggtgaaaggcttttacccttccgatattgctgttgagtgggaaagcaacgggcagcccgagaataactataagaccacacctcccatgctggactccgacggatctttctttctctacagcaaactgaccgtcgataagtcccgctggcaacagggcaatgtgttctcttgcagcgtgatgcacgaagcgcttcataaccactatacacagaagtccctgagcctctctccttccaaa

SEQ ID NO: 39145 - RNA, 639 nt, synthetic construct
  misc_feature 1..639: note = derived and/or modified sequence opt5 from Visilizumab_LightChain1
  source 1..639: mol_type = other RNA
gacatccagatgacccaaagcccctcctctctgagcgcctccgtgggcgatagagtcacaattacgtgctctgctagctcctctgttagctacatgaactggtatcagcagaagcctgggaaagccccgaagcggctcatctacgacacctccaaactggcgagcggagtgccctctcgcttctccggcagcgggtctggaacagattttacccttacaatttccagcctgcagcctgaggacttcgctacctattactgtcaacagtggtcttccaatccccctacatttggcgggggaaccaaggtggaaatcaaaagaacggtcgccgcccccagcgtgttcatttttcctccgtccgatgagcagctcaagtctggcaccgctagcgttgtgtgcctgcttaacaatttctatccccgggaagccaaggtccagtggaaagtggacaacgctctgcaatccggcaatagccaggagtctgttacagaacaggattccaaggacagcacctactctctcagctccacactgaccctgtctaaagccgattatgagaagcacaaagtgtacgcgtgtgaggtcacgcatcaggggctcagctcccctgtgacaaagagctttaaccgcggagaatgc

SEQ ID NO: 39146 - RNA, 1353 nt, synthetic construct
  misc_feature 1..1353: note = derived and/or modified sequence opt5 from Volociximab_HeavyChain
  source 1..1353: mol_type = other RNA
caggtgcagctgaaggagagcggccccgggctcgtcgccccttcccagtctctgagcattacctgcacaatctccggattctctcttacggactacggcgttcactgggtgagacagccgcccgggaaaggactggaatggctcgtggtcatctggagcgatggctcctctacctataacagcgctctgaagtcccggatgacaattcgcaaagacaatagcaagtctcaggtgtttcttatcatgaactccctgcaaaccgatgacagcgccatgtactattgtgcgagacatgggacatactatggaatgaccacaaccggcgatgctctcgactactggggccaggggacgtctgttaccgtgtccagcgcctctacaaaaggaccttccgtcttccccctggccccttgcagccggtccacctctgagagcacagctgccctgggctgtctcgtgaaggattattttcccgaacctgttaccgtgtcctggaatagcggggctctgacgtctggagtccacacattcccggccgtgcttcagtccagcggcctgtactctctcagctccgtggtcaccgttccctctagctccctggggacaaagacctatacctgcaacgtggaccataaacctagcaatacaaaggtggataaacgcgtcgagtctaagtacggacccccttgtccctcctgcccggcgcctgaatttcttggcggccccagcgtgttcctgtttcctcccaaacccaaggacacgctcatgatttctagaacccctgaggttacatgtgtggtcgtggatgtttcccaggaggacccggaagtgcaattcaactggtacgtcgatggggtggaggtccacaatgccaagaccaaaccccgggaggaacagtttaacagcacatatcgcgtggtttccgtgctgaccgtcctgcatcaggactggctcaatggaaaggagtacaaatgcaaggtgtctaacaaaggcctgcctagctccatcgaaaagacgatctctaaagctaaggggcagcccagagagcctcaagtttatacacttcccccgagccaggaagagatgaccaagaatcaggtgtccctgacctgtctcgtcaaaggattctaccctagcgacattgccgtggaatgggagtctaacggccaacccgagaataactataagacaacccctcccgtgctggattccgacgggagctttttcctttactctcggctgacagttgataaatcccgctggcaggaaggaaatgtctttagctgctctgtgatgcacgaggctctccacaaccattacacgcaaaagagcctgtccctgagcctcggcaaa

SEQ ID NO: 39147 - RNA, 645 nt, synthetic construct
  misc_feature 1..645: note = derived and/or modified sequence opt5 from Volociximab_LightChain
  source 1..645: mol_type = other RNA
cagatcgtgctgacccaaagccccgccattatgtccgcttctctcggcgagagagtcacaatgacgtgcaccgccagctcctctgttagctccaactacctgcactggtatcagcagaaacctgggtctgcgccgaatctttggatctacagcacatccaacctggctagcggagtgcccgcccggttctctggctccgggagcggaacctcttattccctcacaattagctctatggaagccgaggacgctgccacctactattgtcatcagtacctgcgctcccctcccacatttggcgggggaaccaaacttgaaatcaagagaacggtggctgcccctagcgtcttcatttttcccccttccgatgagcaactgaaatctggcaccgcgagcgtggtttgcctcctgaataacttctatccgcgggaagccaaggtgcagtggaaagtcgacaatgctctgcagtccggcaacagccaggagtctgtgacagagcaagattccaaggacagcacctactctctcagctccacactgaccctttctaaggccgattacgaaaaacacaaggtttatgcttgtgaggtgacgcatcaggggctgagctcccccgtcacaaagagctttaatcgcggagaatgc

SEQ ID NO: 39148 - RNA, 1344 nt, synthetic construct
  misc_feature 1..1344: note = derived and/or modified sequence opt5 from Vorsetuzumab_HeavyChain1
  source 1..1344: mol_type = other RNA
caggtgcaactggtccagagcggcgccgaggttaagaaacccggggcttccgtgaaggtgtcttgcaaagccagcggatacaccttcacaaactatggcatgaattgggtcagacaggcgcctgggcagggactcaagtggatgggctggatcaacacgtacaccggggaaccgacatatgctgacgcctttaaaggacgggtgaccatgacacgcgatacctccatttctacagcctacatggagctgagcagacttcggtccgacgataccgctgtttattactgtgcccgcgactatggcgattacggcatggactactgggggcaaggaacgaccgtgacagtctctagcgcttccaccaagggccccagcgtgttccctctggccccctcttccaagagcacatctgggggaaccgcggccctcggctgcctggttaaagattattttcctgaacccgtgacggtctcctggaatagcggggctcttacatctggagtgcacaccttccctgccgtgctgcagtccagcggcctctactccctgtctagcgtcgttacagtgccgtccagctctctgggcacccagacctatatctgtaacgtgaatcataagccctccaacacaaaagtcgacaagaaagtggagcctaagagctgcgataagacgcacacctgtcccccttgccccgctccggaactcctcgggggaccttctgtttttctttttccccctaaacccaaggacacactgatgattagcagaacccccgaggtgacatgtgtcgtggttgatgtgtcccatgaggaccctgaagtcaaattcaattggtacgtggatggcgtcgaggtgcacaacgccaagaccaaaccgcgggaagaacagtataattctacgtaccgcgttgtgagcgtcctcacagtgctgcatcaagactggcttaacgggaaggagtataaatgcaaggtttccaataaggcgctgcccgcccctatcgagaaaaccattagcaaggctaaaggacagcccagagagcctcaggtgtacaccctgcccccgtctcgggacgaactgacaaagaaccaggtctccctgacctgtctcgtgaaaggcttctaccctagcgatatcgccgtggagtgggaatctaatgggcaacccgagaacaattataagacaacgcctcccgttctggactccgatggcagctttttcctttactccaagctgaccgtcgacaaatctcgctggcagcagggaaacgtgtttagctgctccgtgatgcacgaggctctccacaaccattatacacaaaagtctctgagcctttcccctggcaaa

SEQ ID NO: 39149 - RNA, 654 nt, synthetic construct
  misc_feature 1..654: note = derived and/or modified sequence opt5 from Vorsetuzumab_LightChain1
  source 1..654: mol_type = other RNA
gacatcgtgatgacccagagccccgattccctggccgtctctctcggcgagagagctacaattaactgccgggccagcaagtccgtttctacgagcgggtactccttcatgcactggtatcaacagaaacctggacagccgcccaagctgcttatctacctggcgtctaatctcgaaagcggcgtgcctgaccgcttttccgggagcggatctggcaccgatttcacactgaccatttccagccttcaggctgaggacgtggccgtctattactgtcaacattctagagaagtgccctggacatttgggcagggaaccaaagttgagatcaagcggacagtggccgctccttccgtcttcatttttccccctagcgatgaacagctgaaatctggcaccgcctccgtggtttgcctcctgaacaatttctatccgcgcgaggctaaggtgcagtggaaggtcgacaacgccctgcaaagcggcaattcccaggagtctgtgacggaacaggatagcaaagactccacctacagcctctcttccacactgacccttagcaaggcggattatgagaaacacaaggtgtacgcctgtgaagtcacacatcaggggctgtctagccccgttaccaaatcctttaacagaggagagtgc

SEQ ID NO: 39150 - RNA, 1344 nt, synthetic construct; identical to SEQ ID NO: 39148
  misc_feature 1..1344: note = derived and/or modified sequence opt5 from Vorsetuzumab_mafodotin_HeavyChain1
  source 1..1344: mol_type = other RNA

SEQ ID NO: 39151 - RNA, 654 nt, synthetic construct; identical to SEQ ID NO: 39149
  misc_feature 1..654: note = derived and/or modified sequence opt5 from Vorsetuzumab_mafodotin_LightChain1
  source 1..654: mol_type = other RNA

SEQ ID NO: 39152 - RNA, 1347 nt, synthetic construct; identical to SEQ ID NO: 38374
  misc_feature 1..1347: note = derived and/or modified sequence opt5 from Yttrium_(90Y)_clivatuzumab_tetraxetan_HeavyChain1
  source 1..1347: mol_type = other RNA

SEQ ID NO: 39153 - RNA, 645 nt, synthetic construct; identical to SEQ ID NO: 38375
  misc_feature 1..645: note = derived and/or modified sequence opt5 from Yttrium_(90Y)_clivatuzumab_tetraxetan_LightChain1
  source 1..645: mol_type = other RNA

SEQ ID NO: 39154 - RNA, 1338 nt, synthetic construct
  misc_feature 1..1338: note = derived and/or modified sequence opt5 from Yttrium_Y_90_epratuzumab_tetraxetan_HeavyChain1
  source 1..1338: mol_type = other RNA
caggtgcaactggtccagagcggcgccgaggttaagaaacccgggtcctctgtgaaggtgagctgcaaggcttccggatacaccttcacatcttattggctccactgggtcagacaggcccctggccaggggctggaatggatcggatacattaacccgcggaatgactatacggagtacaaccaaaattttaaagataaagcgaccatcacagctgacgaaagcaccaacacagcctatatggagctttcctctctgcgcagcgaagataccgccttctacttttgtgctagacgggacattacaaccttctattggggccaggggacgaccgtgacagtttccagcgcctctaccaagggaccctccgtgtttcctctcgctcccagctctaagtccacaagcggcggcaccgccgcgctggggtgccttgtcaaagattacttccctgagcccgtgacggtttcttggaactccggagccctgacaagcggcgtgcatacctttcctgctgtcctccagtcctctgggctgtacagcctgtccagcgtggtgacagtcccgtcttccagcctcggaacccagacctatatctgtaatgttaatcacaagccctctaacacaaaagtggacaagcgcgtggagcctaaaagctgcgataagacgcatacctgtcccccttgccccgccccggaactgcttggcgggccttccgtcttcctgtttccccctaagcccaaagacacactcatgatttctagaacccccgaggtgacatgtgttgtggtcgatgtgagccacgaagaccctgaggttaagttcaattggtacgtggatggagtcgaggtgcataacgctaaaaccaagccgcgggaggaacaatataattccacgtaccgcgtcgtgagcgttctgacagtgcttcaccaggactggctgaacggcaaagaatataagtgcaaagtctctaataaggccctccccgcgcctatcgagaagaccatctccaaagccaagggccagcccagagaacctcaggtgtacaccctgcccccgagccgggaggagatgaccaaaaaccaagtttctctgacatgtctcgtgaaggggttttatccttccgatattgctgtcgaatgggagagcaatggacagcccgaaaacaactacaaaacaacgcctcccgtgctggactccgacggctctttctttctttacagcaagctgaccgtggataagtcccgctggcagcaagggaatgttttctcttgcagcgtcatgcacgaggccctccataaccactatacacagaaatccctgagcctttctcctggaaag

SEQ ID NO: 39155 - RNA, 657 nt, synthetic construct
  misc_feature 1..657: note = derived and/or modified sequence opt5 from Yttrium_Y_90_epratuzumab_tetraxetan_LightChain1
  source 1..657: mol_type = other RNA
gacatccagctgacgcaaagcccctcctctctcagcgcctccgtgggcgatagagtcacaatgtcttgcaagagctcccagtctgttctgtacagcgctaaccacaaaaattatcttgcctggtaccagcagaagcctgggaaagcgccgaagctgctcatttattgggcttccacgcgggagagcggagtgccctctcgcttctccggcagcgggtctggaaccgactttacattcaccatctccagcctgcaacctgaagatattgccacatactattgtcatcagtacctttcttcctggacctttggcgggggaacaaaagtgcagatcaagagaaccgtcgccgctcccagcgtgttcatttttcctccctccgacgagcagctgaagtctggcacggccagcgttgtgtgcctcctgaacaatttctatcctcgggaagctaaagtccaatggaaggtggataacgccctgcagtccggcaatagccaggagtctgttaccgaacaggactccaaagatagcacatactctctcagctccaccctgacactttctaaggcggactacgagaaacacaaggtgtatgcctgtgaggtcacccatcaagggctgagctccccggtgaccaagagctttaaccgcggagaatgc

SEQ ID NO: 39156 - RNA, 1326 nt, synthetic construct
  misc_feature 1..1326: note = derived and/or modified sequence opt5 from Yttrium_Y_90_epratuzumab_HeavyChain1
  source 1..1326: mol_type = other RNA
caggtgcaactggtccagagcggcgccgaggttaagaaacccgggtcctctgtgaaggtgagctgcaaggcttccggatacaccttcacatcttattggctccactgggtcagacaggcccctggccaggggctggaatggatcggatacattaacccgcggaatgactatacggagtacaaccaaaattttaaagataaagcgaccatcacagctgacgaaagcaccaacacagcctatgagctttcctctctgcgcagcgaagataccgccttctacttttgtgctagacgggacattacaaccttctattggggccaggggacgaccgtgacagtttccagcgcctctaccaagggaccctccgtgtttcctctcgctcccagctctaagtccacaagcggcggcaccgccgcgctggggtgccttgtcaaagattacttccctgagcccgtgacggtttcttggaactccggagccctgacaagcggcgtgcatacctttcctgctgtcctccagtcctctgggctgtacagcctgtccagcgtggtgacagtcccgtcttccagcctcggaacccagacctatatctgtaatgttaatcacaagccctctaacacaaaagtggacaagcgcgtggagcctaaaagctgcgataagacgcatacctgtcccccttgccccgccccggaactgcttggcgggccttccgtcttcctgtttccccctaagcccaaagacacactcatttctagaacccccgaggtgacatgtgttgtggtcgatgtgagccacgaagaccctgaggttaagttcaattggtacgtggatggagtcgaggtgcataacgctaaaaccaagccgcgggaggaacaatataattccacgtaccgcgtcgtgagcgttctgacagtgcttcaccaggactggctgaacggcaaagaatataagtgcaaagtctctaataaggccctccccgcgcctatcgagaagaccatctccaaagccaagggccagcccagagaacctcaggtgtacaccctgcccccgagccgggaggagaccaaaaaccaagtttctctgacatgtctcgtgaaggggttttatccttccgatattgctgtcgaatgggagagcaatggacagcccgaaaacaactacaaaacaacgcctcccgtgctggactccgacggctctttctttctttacagcaagctgaccgtggataagtcccgctggcagcaagggaatgttttctcttgcagcgtccacgaggccctccataaccactatacacagaaatccctgagcctttctcctggaaag

SEQ ID NO: 39157 - RNA, 654 nt, synthetic construct
  misc_feature 1..654: note = derived and/or modified sequence opt5 from Yttrium_Y_90_epratuzumab_LightChain1
  source 1..654: mol_type = other RNA
gacatccagctgacgcaaagcccctcctctctcagcgcctccgtgggcgatagagtcacatcttgcaagagctcccagtctgttctgtacagcgctaaccacaaaaattatcttgcctggtaccagcagaagcctgggaaagcgccgaagctgctcatttattgggcttccacgcgggagagcggagtgccctctcgcttctccggcagcgggtctggaaccgactttacattcaccatctccagcctgcaacctgaagatattgccacatactattgtcatcagtacctttcttcctggacctttggcgggggaacaaaagtgcagatcaagagaaccgtcgccgctcccagcgtgttcatttttcctccctccgacgagcagctgaagtctggcacggccagcgttgtgtgcctcctgaacaatttctatcctcgggaagctaaagtccaatggaaggtggataacgccctgcagtccggcaatagccaggagtctgttaccgaacaggactccaaagatagcacatactctctcagctccaccctgacactttctaaggcggactacgagaaacacaaggtgtatgcctgtgaggtcacccatcaagggctgagctccccggtgaccaagagctttaaccgcggagaatgc

SEQ ID NO: 39158 - RNA, 1365 nt, synthetic construct
  misc_feature 1..1365: note = derived and/or modified sequence opt5 from Zalutumumab_HeavyChain1
  source 1..1365: mol_type = other RNA
caggtgcaactggtcgagagcggcgggggagttgtgcagcccggcagatccctccggctgtcttgcgccgctagcgggttcaccttttccacatacggaatgcactgggtgcgccaggcccctggcaaggggcttgaatgggtcgcggtgatctgggacgatggatcttataaatactatggcgacagcgttaagggcagattcacgatttcccgggataactctaaaaataccctgtacctccagatgaacagcctgcgcgctgaggacacagccgtgtattactgtgccagagatgggatcaccatggtccggggagtgatgaaggactattttgattactggggccaagggacacttgttaccgtgtccagcgcttctacaaaaggaccgtccgtcttccccctggcccctagctctaagtccaccagcggcgggacggctgccctcggatgcctggtgaaggactactttcccgaacctgtgaccgtctcttggaactccggcgcgctgacaagcggcgttcataccttccccgccgtgctccagtcctctgggctgtatagcctttccagcgtggtcacagtgccttcttccagcctgggaacccagacgtacatttgtaatgttaatcacaaaccgtctaacacaaaggtggataaacgcgtcgagcccaagagctgcgacaaaacccatacatgtcctccctgccctgctcccgaactcctgggcgggccgtccgtgtttcttttccctcccaagcctaaggataccctgatgatctctagaacccccgaggttacatgtgtggtcgtggacgtcagccacgaggatcccgaagtgaaatttaattggtatgttgacggagtggaggtccataacgccaagacgaaacctcgggaggaacagtacaattccacctatcgcgtggttagcgtgctcacagtcctgcaccaagactggctgaacggcaaggagtacaaatgcaaggtgtctaataaagctctcccggcccccattgaaaagaccatctccaaggcgaaagggcagcctagagagccccaggtgtatacactgcctcccagccgggaagagatgaccaagaaccaggtttctcttacgtgtctggtcaaaggattctacccgtccgatatcgccgtggaatgggagagcaatggccaacctgagaacaattacaagacaacaccccctgtgctcgactccgatggcagctttttcctgtattctaaacttaccgtcgacaagtcccgctggcagcaggggaacgtgttttcttgcagcgttatgcacgaagctctgcataaccactacacccaaaagtccctcagcctgtctcccggaaaa

SEQ ID NO: 39159 - RNA, 642 nt, synthetic construct
  misc_feature 1..642: note = derived and/or modified sequence opt5 from Zalutumumab_LightChain1
  source 1..642: mol_type = other RNA
gccatccagctgacccaaagccccagctctctcagcgcttccgtgggcgacagagtcacaattacgtgccgggcctctcaggatatcagctccgcgctggtttggtaccagcagaagcctgggaaagctccgaaacttctgatttatgacgcctctagcctcgagtccggagtgcccagccgcttctctggctccgaaagcgggaccgattttacactgaccatctcttcccttcaacctgaggacttcgccacatactattgtcagcagtttaacagctaccccctgaccttcggaggcgggacaaaggtggaaattaagagaaccgtcgctgccccttctgtgtttatctttcccccttccgatgagcagctcaaaagcggaacggcttccgttgtgtgcctgctgaataacttctatccgcgggaagccaaggtccaatggaaggtggacaatgcgctccagtctggcaacagccaggagtccgttaccgagcaggatagcaaagactctacatactccctgagctctacccttacactgagcaaggccgattatgaaaaacacaaggtgtacgcttgtgaggtcacccatcaaggcctctcctctcccgtgacgaaatccttcaatcgcggggaatgc

SEQ ID NO: 39160 - RNA, 1332 nt, synthetic construct
  misc_feature 1..1332: note = derived and/or modified sequence opt5 from Zanolimumab_H0_HeavyChain
  source 1..1332: mol_type = other RNA
caggtgcaactgcagcagtggggcgccgggctcctgaagcccagcgagaccctttccctgacatgcgctgtctacggaggctctttcagcgggtattactggtcctggatcagacagcctccgggaaaaggcctcgaatggattggggagatcaaccactctggaagcacgaattataacccctccctgaagtctcgggttaccattagcgtggacacatccaaaaatcaatttagccttaagctgtcttccgtgaccgccgcggatacagctgtctactattgtgcccgcgtgatcaactggttcgacccttggggccagggcaccctcgttacagtgagctctgcctccaccaaagggcccagcgtctttcctctggctccctcttccaagagcacgtccggaggcaccgccgctctggggtgcctcgtgaaggattacttccctgaaccggttacagtgtcttggaatagcggagccctgacctccggcgtccatacatttcccgcggtgcttcagagctctgggctgtattccctcagctcttggaccgtgcctagctcctctctgggaacgcagacatacatttgtaacgtcaatttcatcaaacccagcaacaccaaggttgacaaaaaggtggagcctaaatcctgcgataagacacacacctgtcccccgtgccctgcccccgaacttctgggcggccctagcgtgtttctcttccctcccaagcccaaagacaccctgatgatctctagaacaccggaggtcacgtgtgtgtgggatgtttcccatgaggaccccgaagtgaagtttaattggtacgtcgatggggtggaggttcacaacgctaaaaccaagcctcgggaggaacaatataatagcacataccgcgtggtctctgtgctgaccgtcctccatcaggactggctgaacggaaaagagtataagtgcaaagtgtccaataaggcccttcccgctcctattgaaaagacaatcagcaaagccaagggccagcccagagagccgcaggtttacaccctgcctccctcccgggaagagatgacgaaaaaccaagtgtctctcacatgtctggtcaaggggttctatcctagcgatattgcggtggaatgggagtccaatggacagcccgagaacaactacaaaaccacccctcccgttcttgactctgatggcagctttttcctgtattccaagctcacagtggacaagagccgctggcagcaagggaatgtcttttcttgctccgtgatgcacgaagccctgcacaaccattacacccagaaaagcctgtctctctccccgggaaag

SEQ ID NO: 39161 - RNA, 642 nt, synthetic construct
  misc_feature 1..642: note = derived and/or modified sequence opt5 from Zanolimumab_L0_LightChain
  source 1..642: mol_type = other RNA
gacatccagatgacccaaagcccctcctctgtgagcgcctccgtcggcgatagagttacaattacgtgccgggcttctcaggacatcagctcctggctggccgtggtgtaccagcacaagcctgggaaagcgccgaagctcctgatttatgctgcctctagccttcagtccggagtccccagccgcttctctggctccgggagcggaaccgattttacactgaccatctcttccctccaacctgaggacttcgccacatactattgtcagcaggctaacagctttccctacaccttcggcgggggaacaaaactggaaattaagagaaccgtggccgctccttctgtttttatctttcccccttccgatgagcagcttaaaagcggcacggcctccgtggtctgcctgctcaataacttctatccgcgggaagcgaaggtgcaatggaaggttgacaatgccctgcagtctggcaacagccaggagtccgtgaccgaacaggatagcaaagactctacatactccctgagctctaccctcacactgagcaaggctgattatgagaaacataaggtctacgcctgtgaggtgacccaccaagggctttcctctcccgtgacgaaattcaatcgcggagaatgc

SEQ ID NO: 39162 - RNA, 1344 nt, synthetic construct; identical to SEQ ID NO: 38781
  misc_feature 1..1344: note = derived and/or modified sequence opt5 from Zatuximab_HeavyChain1
  source 1..1344: mol_type = other RNA

SEQ ID NO: 39163 - RNA, 657 nt, synthetic construct; identical to SEQ ID NO: 38782
  misc_feature 1..657: note = derived and/or modified sequence opt5 from Zatuximab_LightChain1
  source 1..657: mol_type = other RNA

SEQ ID NO: 39164 - RNA, 1356 nt, synthetic construct
  misc_feature 1..1356: note = derived and/or modified sequence opt5 from Actoxumab_HeavyChain
  source 1..1356: mol_type = other RNA
caagtgcaactggtcgagagcggcgggggagttgtgcagcccggcagatccctccggctgtcttgcgccgctagcgggttctccttttctaactacggaatgcactgggtgcgccaggcccctggcaaggggcttgaatgggtcgcgctgatctggtatgacggaagcaatgaggattacaccgactccgtgaaaggcagattcacaatttctcgggataacagcaagaatacgctctatctgcagatgaactcccttcgcgctgaagacaccgccgtttactattgtgccagatggggcatggtgcgcggggtcatcgatgtgtttgacatttggggacaaggcacagttgtgaccgtcagctctgcttccacaaaagggccgagcgtgttccccctggccccttcttccaagagcacctctggaggcacagctgccctcgggtgcctggtgaaagattactttcccgagcctgtcaccgtttcctggaatagcggagcgctgacgtccggcgtgcataccttccccgccgtgctccagtctagcggcctgtattcccttagctctgtcgtgacagttccttccagctctctggggacccagacatacatctgtaacgtgaatcacaagccgagcaacaccaaggtcgacaaacgggtggaacccaagtcctgcgataaaacgcatacatgtcctccctgccctgctcccgagctcctgggaggcccgtctgtttttcttttccctcccaagcctaaagacaccctgatgattagcagaacacccgaggtgacctgtgtcgtggtcgatgtgtcccacgaagaccccgaggttaagtttaattggtacgtggatggggtcgaagtgcataacgccaagaccaaacctcgggaggagcagtataatagcacataccgcgttgtgtctgtcctcacggtgctgcaccaagactggctgaacggaaaggaatataaatgcaaggtgtccaataaagctctcccggcccccatcgagaagaccatcagcaaagcgaagggccagcctagagaaccccaggtttacacactgcctccctctcgggaggaaatgaccaagaaccaggtctcccttacatgtctggtgaaagggttctatccgagcgacattgccgtggagtgggagtccaatggacaacctgaaaacaactacaagaccacgccccctgtcctcgattctgacggcagctttttcctgtattccaaacttacagtggataagtctcgctggcagcagggcaatgtttttagctgctccgtgatgcacgaggctctgcataaccactacacccagaaaagcctctctctgtcccccgggaag

SEQ ID NO: 39165 - RNA, 642 nt, synthetic construct
  misc_feature 1..642: note = derived and/or modified sequence opt5 from Actoxumab_LightChain
  source 1..642: mol_type = other RNA
gacatccagatgacccaaagccccagctctgtgagcgcctccgtcggcgatagagttacaattacgtgccgggcttctcaggggatcagctcctggctggcctggtaccagcacaagcctggaaaagcgccgaagctcctgatttatgctgcctctagccttcagtccggcgtgcccagccgcttctctgggtccggaagcggcaccgactttacactgaccatctcttccctccaacctgaggatttcgccacatactattgtcagcaggctaacagctttccctggaccttcgggcagggaacaaaagtggaaattaagagaaccgtcgccgctccttctgtgtttatctttcccccttccgacgagcaactgaaaagcggcacggcctccgttgtgtgccttctgaataacttctacccgcgggaagcgaaggtccagtggaaggtggataatgccctccagtctggcaacagccaggagtccgttaccgaacaagacagcaaagattctacatattccctgagctctaccctgacactcagcaaggctgactacgagaaacataaggtgtatgcctgtgaggtcacccaccaggggctgtcctctcccgtgacgaaatccttcaatcgcggagaatgc

SEQ ID NO: 39166 - RNA, 1326 nt, synthetic construct
  misc_feature 1..1326: note = derived and/or modified sequence opt5 from Andecaliximab_HeavyChain
  source 1..1326: mol_type = other RNA
caggtgcaactgcaggagagcggccccgggctcgtcaagccttccgaaaccctgtctcttacatgcacggttagcggattctccctgctctcttacggcgtgcactgggtgagacagccgcccgggaaaggactggagtggcttggcgtcatctggaccgggggaacaaccaactataatagcgccctgatgtcccggtttacaatttctaaggacgatagcaaaaacaccgtgtacctcaagatgaactccctgaaaacagaagacaccgctatctattactgtgcccgctattactatggcatggattactggggccaggggacgctggttaccgtgagctctgcgtccacaaagggacctagcgtcttccccctcgctccttgctctagatccaccagcgagtctacagccgccctgggctgtcttgtgaaggactactttcccgaacctgttaccgtgtcctggaatagcggggctctgacgtccggagtccatacattcccggccgtgctccaatctagcggcctgtattcccttagctctgtggtcaccgttccctccagctctctggggacaaaaacctatacctgcaatgtggatcacaagcctagcaacacaaaagtggacaagcgggtcgagtccaaatacggacccccttgtcccccgtgccctgctcccgagtttctcggcggcccttctgtgttcctgtttcctcccaagcccaaggatacgctgatgattagccgcaccccggaagttacatgtgtggtcgtggacgtttcccaggaggatcccgaagtgcagttcaattggtacgtcgacggggtggaggtccataacgccaaaaccaagcctagagaggaacagtttaatagcacatatcgggtggtttctgtgctcaccgtcctgcaccaagattggcttaacggaaaagagtacaagtgcaaagtgtccaataagggcctgcccagctctatcgagaaaacgatttccaaggcgaaggggcagcctcgcgaaccccaggtttatacactcccgcctagccaggaagagatgaccaaaaaccaagtgtccctgacctgtcttgtcaagggattctacccctctgacatcgccgtggagtgggaaagcaatggccagcctgagaacaattacaaaacaacaccccctgtgctggattccgacgggagctttttcctctattctagactgaccgttgacaagtcccggtggcaggaaggaaacgtctttagctgctctgtgatgcatgaggctctgcacaaccactacacgcaaaaatccctcagcctgtctcttggcaag

SEQ ID NO: 39167 - RNA, 642 nt, synthetic construct
  misc_feature 1..642: note = derived and/or modified sequence opt5 from Andecaliximab_LightChain
  source 1..642: mol_type = other RNA
gacatccagatgacccaaagcccctcctctctgagcgcctccgtgggcgatagagtcacaattacgtgcaaggcttctcaggacgttcggaacaccgtggcctggtaccagcagaaacctgggaaggcgccgaaactcctgatctatagctcctcttaccgcaatacaggagtgcccgatagattcagcggctccgggagcggaaccgactttacacttaccatttcttccctgcaagctgaggatgtcgccgtgtattactgtcagcagcactatatcacaccttacaccttcggcgggggaacgaaggttgaaattaaacggaccgtggccgctcccagcgtctttatcttccctccctctgacgagcagctcaagtccggcacagccagcgtggtttgcctgcttaacaatttttatcctcgcgaagctaaggtgcaatggaaagtcgataacgccctgcagtctggcaattcccaggagagcgtgaccgaacaggactccaaggattctacatacagcctctccagcaccctgacgctgtctaaagcggactacgagaagcataaagtgtatgcctgtgaggtcacacaccaagggctctccagcccggttaccaagtctttcaacagaggagaatgc

SEQ ID NO: 39168 - RNA, 1353 nt, synthetic construct
  misc_feature 1..1353: note = derived and/or modified sequence opt5 from Aprutumab_HeavyChain
  source 1..1353: mol_type = other RNA
gaggtgcagctgctcgaaagcggcgggggactggtccaacccggcgggtcccttagactgtcttgcgccgctagcggattcaccttttcctcttacgccatgagctgggttcggcaggcgcctggcaaggggctcgagtgggtgtccgctatctctggaagcggcacatccacgtattacgccgacagcgtgaaaggccgcttcaccatttctagagataactccaagaatacactgtatcttcagatgaacagcctgcgggccgaagacaccgctgtctactattgtgcccgcgtgagatacaattggaaccacggggattggtttgacccgtggggacagggcacactcgttaccgtgtcttccgctagcacaaaagggccctctgtcttccctctggccccctccagcaagtccacctctggaggcacggcggccctggggtgcctcgtgaaagattattttcctgagcccgttaccgtgagctggaactccggagctctgacaagcggcgtccataccttccctgccgtgcttcaatcttccggcctgtacagcctctctagcgtggtcacagttccgtcctctagcctggggacccagacgtacatctgtaatgtgaatcacaagccctccaacacaaaggtggacaaaaaggtcgaacctaaaagctgcgataagacccatacatgtcccccttgccccgctccggagcttctgggaggcccttctgtgtttctctttccccctaaacccaaggacaccctgatgatttcccggacccccgaggttacatgtgtggtcgtggatgttagccacgaagaccctgaggtgaagttcaattggtatgtcgatggggtggaagtccataacgccaaaacgaagccgcgcgaggagcagtacaattctacctatagagtggtttccgtgctgacagtcctccaccaggactggctgaacggaaaagaatacaagtgcaaagtgagcaataaggcgcttcccgcccctatcgagaaaaccatttccaaggctaagggccaaccccgggaacctcaggtttatacactgcccccgtctcgcgatgagctcaccaaaaaccaggtgagcctgacgtgtcttgtcaaggggttctacccttccgacatcgccgtggaatgggagtctaatggacagcccgagaacaactataaaacaacccctcccgtgctggacagcgatggctcctttttcctctacagcaagctgaccgttgacaaatctagatggcaacagggcaatgtcttttcctgcagcgtgatgcacgaagctctgcataaccactacacacagaagtctctctccctgagccctggg

SEQ ID NO: 39169 - RNA, 648 nt, synthetic construct
  misc_feature 1..648: note = derived and/or modified sequence opt5 from Aprutumab_LightChain
  source 1..648: mol_type = other RNA
cagagcgtgctgacccaacccccttccgcctctggcacaccggggcagagagtcacgatcagctgctccggatctagctccaacattggcaataactacgtttcttggtatcagcagctccccgggaccgctcctaagctgcttatctacgagaattataaccggcccgccggagtgcctgaccgcttcagcggctccaagagcgggacatctgcgtccctggctattagcggactcagatctgaagatgaggccgactactattgttccagctgggatgactctctgaattactgggtgtttggcggcgggaccaaacttacagtcctgggacaacccaaagccgctccttccgtgaccctcttcccgcccagctccgaggaactgcaggccaacaaggctacactggtttgcctcatctctgatttttatcctggcgccgtgaccgtcgcgtggaaagccgacagctcccccgtgaaggctggggttgaaacgaccacacctagcaagcagtctaataacaaatacgccgcttccagctacctgtctcttacccccgagcagtggaaaagccaccggtcctattcttgtcaagtgacacatgagggaagcaccgtcgaaaagacggtggccccgacagagtgctcc

SEQ ID NO: 39170 - RNA, 1341 nt, synthetic construct
  misc_feature 1..1341: note = derived and/or modified sequence opt5 from Azintuxizumab_HeavyChain
  source 1..1341: mol_type = other RNA
gaggtgcagctggtcgaaagcggcgggggactcgttcaacccggcgggtccctgagactttcttgcgccgctagcggattcaccttttccgactactatatggcctgggtgcggcaggcgcctggcaaggggctggagtgggtggcttctatcaactacgatggaagctccacatattacgtcgactctgtgaaaggccgcttcacgattagcagagataatgccaagaactccctctatctgcagatgaatagccttcgggccgaagacaccgctgtttactattgtgcccgcgatagaggctactactttgactattgggggcagggaacaaccgtgacagtctcttccgctagcaccaaaggcccgtctgtgttccccctggccccttccagcaagtctacatccgggggaaccgcggccctcggctgcctggttaaagattactttcccgagcctgtgacggtcagctggaactccggggctctgacctctggagtgcacacattccccgccgtgctccaaagctccggcctgtatagcctttcttccgtcgttaccgtgcctagctctagcctgggcacacagacctacatctgtaatgtgaaccataagccgtccaatacgaaggtcgacaaaaaggtggaacccaaatcttgcgataagacacacacctgtcctccctgccctgctcccgagctccttgggggaccgagcgtttttctgttccctcccaaacctaaggacacactgatgatttcccggacccccgaggtgacctgtgtcgtggttgatgtgagccatgaagaccccgaggtcaagtttaactggtatgtggatggcgtcgaagtgcacaatgccaaaacaaagcctcgcgaggagcagtacaactctacgtatagagttgtgtccgtcctcaccgtgctgcatcaggactggctgaatgggaaagaatacaagtgcaaagttagcaacaaggcgctcccggcccccatcgagaaaacaatttctaaggctaagggacaacctcgggaaccccaggtgtacaccctgcctccctcccgcgaggaaatgacaaagaatcaggtcagccttacctgtctggtgaagggcttctatccgtccgacatcgccgtggagtgggagtctaacgggcagcctgaaaataactacaaaacgacaccccctgttctcgatagcgacggatcctttttcctgtattctaaacttaccgtcgataaaagcagatggcaacagggcaacgtgttttcctgcagcgtgatgcacgaggctctgcacaatcattacacccagaagtctctctccctgagccccggcaag

SEQ ID NO: 39171 - RNA, 660 nt, synthetic construct
  misc_feature 1..660: note = derived and/or modified sequence opt5 from Azintuxizumab_LightChain
  source 1..660: mol_type = other RNA
gacgtggtcatgacccagacacccctgagcctctccgttacgcctggccaaccggcctctatcagctgcagatcctctcagagcctggtgcactccaacgggaatacctaccttcattggtatctgcagaagcccggacagtctcctcaactcctgatttacaaagtgagcaaccggttctccggcgtccccgatcgctttagcgggtctggatccggcacagacttcacccttaagatcagcagagtggaggctgaagatgttggggtgtatttttgttctcagtccacacacgtccctcccttcacctttggaggcggcacaaaagtggagattaagcggaccgttgccgcgcctagcgtgttcatctttccgccctctgacgaacagctgaaatccgggacggctagcgtcgtgtgcctcctgaataacttctaccctcgcgaggccaaggtgcagtggaaggtcgataatgccctgcaatccggaaactctcaggaaagcgttaccgagcaggactccaaagatagcacatattctctctccagcaccctgacactttctaaggctgactacgagaaacataaggtgtatgcctgtgaagtgacccaccagggcctgagctcccccgtcacgaaatcttttaatagaggggagtgc

SEQ ID NO: 39172 - RNA, 366 nt, synthetic construct
  misc_feature 1..366: note = derived and/or modified sequence opt5 from Blinatumomab_HeavyChain1
  source 1..366: mol_type = other RNA
caggtgcaactgcagcagagcggcgccgagctcgtcagacccgggtcctctgttaagatcagctgcaaggcttccggatacgccttctctagctattggatgaactgggtgaaacagcggcctggccaagggctggaatggattggacagatctggccgggcgacggggataccaattacaacggaaaatttaagggcaaagcgacacttacggctgacgagtcctctagcaccgcctatatgcagctgtccagcctcgcctctgaagattccgctgtgtacttctgtgcccgcagagagacaaccacagtcggccggtattactatgctatggactactgggggcagggaaccacagtgaccgtt

SEQ ID NO: 39173 - RNA, 363 nt, synthetic construct
  misc_feature 1..363: note = derived and/or modified sequence opt5 from Blinatumomab_HeavyChain2
  source 1..363: mol_type = other RNA
gacatcaagctgcagcaaagcggcgccgagctcgctagacccggggcctccgtgaaaatgtcttgcaagaccagcggatacacattcacgcggtataccatgcactgggtcaaacagcgccctggccaggggctggaatggattggatacatcaacccgtccagaggctatacaaattacaaccagaagtttaaagataaggcgacccttacaaccgacaagtctagctccacagcttatatgcaactgtctagcctcacctccgaggatagcgccgtttactattgtgcccggtactacgacgatcattattgcctggactactgggggcagggaacgacccttacagtgtcttccgtggaa

SEQ ID NO: 39174 - RNA, 1494 nt, synthetic construct
  misc_feature 1..1494: note = derived and/or modified sequence opt5 from Blinatumomab_LightChain_HeavyChain_HeavyChain_LightChain
  source 1..1494: mol_type = other RNA
gacatccagctgacccaaagccccgcctccctcgctgtgtctctgggccagagagccacaattagctgcaaggcgtcccagtctgtcgattacgacggggatagctatcttaactggtaccagcaaatccctggacagccgcccaaactgctcatttatgacgcttccaatctggtttctggcatccctccccggttcagcgggtccggaagcggcacggattttacccttaacattcaccctgtggagaaggtggacgccgccacataccattgtcagcagtctaccgaagatccctggacattcgggggaggcaccaaactggagatcaagggcgggggaggctccgggggaggcgggagcggaggcggcgggtctcaagtccagctccagcagtccggagctgaactggtgcgccctggcagctctgttaaaatctcctgcaaggccagcgggtatgctttttcctcttactggatgaattgggtgaagcaaagaccgggacagggcctggagtggattgggcagatctggcccggagacggcgatacaaactataatggcaaattcaaggggaaagccaccctcacggcggacgaaagctccagcaccgcctacatgcaactgtcttcccttgctagcgaggattctgccgtctacttttgtgctcggcgcgagacaaccacagtgggaagatattactatgccatggactactggggccaggggaccacggttacagtgagctccggaggcgggggctctgatattaagctgcagcagagcggagcggaactcgcccggcctggcgcttccgtcaaaatgagctgcaagacctctgggtatacattcacccgctacaccatgcactgggtgaagcaaagacccggacagggcctggagtggatcgggtatattaacccttcccggggatacacaaattacaaccagaaatttaaggacaaagccacgcttaccacagacaagtctagctccaccgcttatatgcagctgagctccctcacatctgaagatagcgccgtgtactattgtgcccgctactatgacgatcattactgcctggactattggggccaagggaccacgctgacagtctcctctgttgagggcggaagcggcgggtccggaggcagcgggggatctggcggggtggatgacatccagctcacccagtcccccgctattatgagcgcgtctccgggcgagaaagtgaccatgacatgtagagcctccagctctgtcagctacatgaattggtaccagcaaaagtccggaaccagccctaaacggtggatctatgatacatctaaggtggcttccggcgttccctaccgcttcagcgggtccggatctggcacgagctattccctgaccatctctagcatggaagccgaggacgccgctacatactattgccagcagtggtcctctaaccctcttacctttggggccggaacaaagctggaactcaaa

SEQ ID NO: 39175 - RNA, 333 nt, synthetic construct
  misc_feature 1..333: note = derived and/or modified sequence opt5 from Blinatumomab_LightChain1
  source 1..333: mol_type = other RNA
gacatccagctgacccaaagccccgcctccctcgctgtgtctctgggccagagagccacaattagctgcaaggcgtcccagtctgtcgattacgacggggatagctatcttaactggtaccagcaaatccctggacagccgcccaaactgctcatttatgacgcttccaatctggtttctggcatccctccccggttcagcgggtccggaagcggcacggattttacccttaacattcaccctgtggagaaggtggacgccgccacataccattgtcagcagtctaccgaagatccctggacattcgggggaggcaccaaactggagatcaag

SEQ ID NO: 39176 - RNA, 324 nt, synthetic construct
  misc_feature 1..324: note = derived and/or modified sequence opt5 from Blinatumomab_LightChain2
  source 1..324: mol_type = other RNA
gtggacgatatccagctgacccaaagccccgccattatgtccgcttctcctggcgagaaggtcacaatgacgtgcagagccagctcctctgttagctacatgaactggtatcagcagaaatccgggacctctccgaagcggtggatctacgacacaagcaaagtggcgtccggagtgccctatcgcttcagcggctctgggtccggaaccagctactctctcacaatttccagcatggaagctgaggatgccgccacctattactgtcagcaatggtcttccaatcctctgacatttggcgctgggaccaaacttgaactgaag

SEQ ID NO: 39177 - RNA, 1350 nt, synthetic construct
  misc_feature 1..1350: note = derived and/or modified sequence opt5 from Brazikumab_HeavyChain
  source 1..1350: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatctggtatgacggaagcaacgagtactatgctgattccgttaaaggcagattcacaatttctcgggacaatagcaagaacacgctgtacctccagatgaatagcctgcgcgccgaagataccgccgtgtattactgtgctagagaccggggctatacatcctcttggtacccggatgcctttgacatctgggggcaaggaaccatggtcacagtgtccagcgcttctaccaaaggcccctccgttttccctcttgccccctgcagccgctctacatccgagagcaccgcggccctggggtgtctcgtgaaggattactttcctgaacccgtcacggtgtcctggaactctggagctctgaccagcggcgtgcatacattccctgccgtcctgcagtccagcgggctctattctctgtccagcgttgtgaccgtgccgtctagcaattttggaacacagacctacacgtgcaacgtcgaccacaaaccctccaatacaaaggtggataagaccgttgagagaaaatgttgcgtggagtgtcctccctgccctgctcccccggtcgccggcccttctgtgttcctttttccccctaagcccaaagacacactgatgattagccggacccccgaagttacctgtgtggtcgtggatgtctcccatgaggaccctgaagtgcagttcaactggtatgttgatggcgtggaggtccacaatgcgaagacaaaaccgcgcgaggaacaatttaacagcacgttcagagtggtttctgtgctcaccgtcgtgcatcaggactggctgaatgggaaggagtacaagtgcaaagtgtccaacaagggacttcccgcccctatcgaaaagacaattagcaagaccaaaggccagccccgggagcctcaggtttatacactgcccccgtctcgcgaagagatgaccaagaatcaagtctccctcacgtgtctggtgaaagggttttaccctagcgacatcgctgtggagtgggaatccaacggacagcccgagaataactataagacaacccctcccatgctggattctgacggcagcttcttcctctactccaagctgaccgtcgataaatctagatggcagcaagggaacgtgtttagctgctccgttatgcacgaagcccttcacaatcattacacacagaaaagcctgtctctctcccctggaaaa

SEQ ID NO: 39178 - RNA, 651 nt, synthetic construct
  misc_feature 1..651: note = derived and/or modified sequence opt5 from Brazikumab_LightChain
  source 1..651: mol_type = other RNA
cagagcgtgctgacccaacccccttccgtctctggcgccccggggcagagagttacaatcagctgcacgggatcctctagcaacaccggcgctgggtacgacgtgcactggtatcaacaggtgcccggaacagcccctaagctcctgatttacggctccgggaatcggccctctggagtccctgatcgcttcagcggctccaaaagcggcacctctgcgtcccttgctatcacagggctgcaggccgaggacgaagccgattattactgtcagagctatgactcttccctcagcggatgggtgtttggcgggggaaccagactgacagttcttggccagcccaaggctgccccttctgtgaccctgttcccgccctccagcgaggaactccaggctaacaaagccacgctggtctgcctgatttccgatttttaccctggggcggtgaccgttgcctggaaggctgactctagccccgtgaaagccggagtcgagacaaccacaccttccaagcaaagcaataacaagtatgctgcctcttcctacctcagcctgacccccgaacagtggaaatctcatcggagctactcctgtcaggtgacgcacgagggctctacagtggagaagaccgtcgcgccgacagaatgcagc

SEQ ID NO: 39179 - RNA, 363 nt, synthetic construct
  misc_feature 1..363: note = derived and/or modified sequence opt5 from Brolucizumab_HeavyChain
  source 1..363: mol_type = other RNA
agcgaggtgcagctggtcgaatccggcgggggactcgttcaacccggcgggtctctgagacttagctgcaccgcctccggattctctctgacagactactattacatgacgtgggtgcggcaggctcctggcaaggggctcgagtgggtgggatttatcgatccggacgatgacccctattacgccacctgggcgaaaggccgcttcacaattagcagagataactccaagaataccctgtatcttcagatgaactctctgcgggctgaagacacagccgtctactattgtgccggcggggatcacaatagcggatggggcctcgacatctgggggcagggaaccctggtgacagtttccagc

SEQ ID NO: 39180 - RNA, 333 nt, synthetic construct
  misc_feature 1..333: note = derived and/or modified sequence opt5 from Brolucizumab_LightChain
  source 1..333: mol_type = other RNA
atggagatcgtgatgacccagagcccctccacactgtctgccagcgtcggcgacagagttattatcacgtgccaggcttccgaaattatccactcttggctcgcctggtaccaacagaagcctgggaaagcgccgaagctgcttatttatctggctagcaccctcgcctccggagtgccctctcggttcagcggctccgggagcggagccgagtttacactgaccatctcttcccttcagcctgatgacttcgctacatactattgtcaaaacgtgtacctggccagcaccaatggcgctaactttgggcagggaacaaaactcaccgtcctg

SEQ ID NO: 39181 - RNA, 1347 nt, synthetic construct
  misc_feature 1..1347: note = derived and/or modified sequence opt5 from Cabiralizumab_HeavyChain
  source 1..1347: mol_type = other RNA
caggtgcaactggtccagagcggcgccgaggttaagaaacccgggtcctctgtgaaggtgagctgcaaggcttccggatacaccttcacagacaactatatgatctgggtcagacaggcccctggccaggggctcgaatggatgggagatattaatccgtacaacggcgggacgacctttaatcaaaagttcaaaggacgggtgacaatcaccgcggacaagtctacaagcaccgcttatatggagctgtcctctcttcgcagcgaagatacagccgtttactattgtgccagagagtccccctactttagcaacctgtatgtgatggactactggggccagggcaccctcgtcacggtgtcttccgctagcaccaaggggccttctgttttccccctggccccttgctcccggagcacatctgaatccaccgctgcccttggatgtctggtgaaagattactttcccgagcctgtcacagtgagctggaactccggcgcgctcacctctggggtgcacacgttcccggccgtcctgcagagctccggactgtatagcctctcttccgttgtgacagtgcccagctctagcctgggcaccaagacatatacctgcaatgtcgaccataaaccttccaataccaaggtggataaacgcgttgagtctaagtacgggcccccttgtcccccgtgccctgctcccgaatttcttggaggccctagcgtgttcctgtttcctcccaagcccaaagacacactcatgatttccagaacgccggaggtcacctgtgtggttgtggatgtcagccaggaagaccccgaggtgcaattcaactggtacgtcgatggcgtggaggttcacaatgccaagacaaaacctcgggaggaacagtttaactctacctatcgcgtggtctccgtgctgacagttcttcatcaggactggctgaatgggaaggaatacaaatgcaaggtgagcaacaaaggactcccctcttccatcgagaagaccattagcaaggctaaaggccagcctagagaaccccaagtctatacgctgccgccttcccaggaggagatgacaaagaatcaggtgtctctgacctgtctcgtgaaagggttctaccccagcgatatcgccgttgaatgggagtccaacggacaacctgaaaataactacaagaccacaccccctgtcctggactctgacggcagctttttcctttattcccggctgaccgtggataaaagccgctggcaggaggggaacgtgttctcttgctccgtcatgcacgaagcgctccataatcactacacacagaaaagcctgtctctttccctgggaaag

SEQ ID NO: 39182 - RNA, 654 nt, synthetic construct
  misc_feature 1..654: note = derived and/or modified sequence opt5 from Cabiralizumab_LightChain
  source 1..654: mol_type = other RNA
gagatcgtgctgacccagagccccgccacactctccctgtctcctggcgaaagagctacgcttagctgcaaggcctcccaatctgtcgactacgatggggacaactatatgaattggtaccagcagaaaccgggacaggcgccccggctgctcatttatgctgccagcaacctggagtccggcatccctgcccgcttctctgggagcggatccggcaccgattttacacttaccattagctctctggaacccgaggacttcgctgtttactattgtcacctctccaatgaagatctgagcacatttgggggaggcaccaaggtggagatcaaaagaacagtggccgctccttctgtcttcatttttcccccttccgacgagcaactcaagagcggcaccgcctctgtggtttgcctgctgaacaatttctacccgcgggaagcgaaagtgcagtggaaggtcgataacgcccttcagtccgggaatagccaggagtccgtgacggaacaagactctaaggatagcacctattccctgagctctacactcaccctgtccaaagctgactacgagaagcataaagtttacgcctgtgaggtgacacaccagggacttagctctcccgtcaccaagagctttaaccgcggcgaatgc

SEQ ID NO: 39183 - RNA, 1329 nt, synthetic construct
  misc_feature 1..1329: note = derived and/or modified sequence opt5 from Camrelizumab_HeavyChain
  source 1..1329: mol_type = other RNA
gaggtgcagctggtcgaaagcggcgggggactcgttcaacccggcgggtccctgagactttcttgcgccgctagcggattcaccttttcctcttacatgatgagctgggtgcggcaggcccctggcaaggggctggagtgggtggcgacaatctccggaggcggcgctaacacgtattacccggactctgtcaaagggcgcttcaccattagcagagataatgccaagaactccctctatctgcagatgaatagccttcgggccgaagacacagctgtgtactattgtgcccgccagctgtactattttgattactggggacaaggcaccacagttaccgtgtcttccgctagcacaaaagggccctctgtcttccctctcgccccctgctccagaagcacctctgagtccacggcggccctgggatgtctggtgaaggactactttcctgaacccgttaccgtgagctggaactccggcgctctcacatctggggtccacaccttccctgccgtgctgcagagctccggactttatagcctgtcttccgtggtcacagttccgagctctagcctcggcaccaaaacgtacacatgcaatgtggatcataagccctccaacaccaaggtggacaaacgggtcgagtctaagtatggccctccctgtcctccctgcccggctcctgagtttcttgggggacccagcgtgttcctgtttcctcccaaacccaaggatacactgatgatctcccgcacccctgaagttacctgtgtggtcgtggacgttagccaggaggatccggaagtgcagttcaattggtacgtcgacggcgtggaggtccacaacgccaaaacaaagcccagagaggaacaatttaattctacgtatcgggtggtttccgtgctcaccgtcctgcatcaggattggctgaacgggaaggagtacaaatgcaaggtgagcaataaaggactcccttcttccattgaaaagacaatcagcaaagcgaagggccagccccgcgagcctcaggtttataccctgcccccgtcccaagaagagatgacaaagaaccaggtgtctcttacctgtctggtcaaggggttctaccctagcgacattgccgtggagtgggaatccaatggacagcccgagaacaattacaagacgacacctcccgtgctcgattctgacggcagctttttcctgtattccagacttaccgttgacaaaagccggtggcaagaaggcaacgtcttctcttgctccgtgatgcacgaggctctgcataaccactacacccagaaaagcctctctctgtccctggggaaa

SEQ ID NO: 39184 - RNA, 642 nt, synthetic construct
  misc_feature 1..642: note = derived and/or modified sequence opt5 from Camrelizumab_LightChain
  source 1..642: mol_type = other RNA
gacatccagatgacccaaagcccctcctctctgagcgcctccgtgggcgatagagtcacaattacgtgcctcgcttctcagaccatcgggacatggctgacctggtaccagcagaagcctggaaaagccccgaaacttctgatttatacagcgaccagcctcgctgacggcgttccctcccggttctctgggagcggatccggcacagattttaccctgacgatcagctctcttcaacctgaggacttcgccacctactattgtcaacaggtgtactccattccctggacatttgggggaggcaccaaggtggaaatcaagcgcacagtcgccgctcctagcgtgttcatctttcccccttctgatgagcagctgaaatccggcaccgccagcgttgtgtgcctcctgaacaatttctatccgagagaagctaaggtccagtggaaggtggacaacgccctgcagtctggaaattcccaggagagcgttacggaacaggattccaaagactctacatacagcctctccagcaccctgacactttctaaggcggattatgagaaacacaaggtgtacgcctgtgaggtcacccatcaagggctgtccagccccgtgaccaaatcttttaaccggggcgaatgc

SEQ ID NO: 39185 - RNA, 777 nt, synthetic construct; identical to SEQ ID NO: 38352
  misc_feature 1..777: note = derived and/or modified sequence opt5 from Caplacizumab_HeavyChain
  source 1..777: mol_type = other RNA

SEQ ID NO: 39186 - RNA, 657 nt, synthetic construct
  misc_feature 1..657: note = derived and/or modified sequence opt5 from Citatuzumab_bogatox_HeavyChain
  source 1..657: mol_type = other RNA
gaggtgcagctggtccaaagcggccccgggctcgttcagcctggaggctccgtgagaatctcttgcgccgctagcgggtacaccttcacaaactatggaatgaattgggtgaagcaggccccgggcaaagggctggaatggatgggatggattaacacgtacaccggcgagtccacatatgcggactcttttaagggccggttcacctttagccttgatacatccgcttctgccgcctacctgcagatcaatagcctccgcgctgaagacaccgccgtctattactgtgctagattcgccattaaaggggattattggggacaaggcacactgcttaccgtgtccagcgcgtctacgaaggggccctccgtttttcctctggcccccagctctaaatccaccagcggaggcacagctgccctcgggtgcctggtgaaggactacttccctgagcccgtcaccgtgtcttggaactccggagctctgacaagcggcgttcacacctttcctgccgtgctccagtcctctggcctgtacagcctttccagcgtcgtgacggtgccgtcttccagcctggggacacagacctatatctgtaatgtcaaccataagccctctaatacaaaagttgataagaaagtggaacctaagagctgc

SEQ ID NO: 39187 - RNA, 1356 nt, synthetic construct
  misc_feature 1..1356: note = derived and/or modified sequence opt5 from Cosfroviximab_HeavyChain
  source 1..1356: mol_type = other RNA
gacgtgaagctgctcgagagcggcgggggactggtccagcccggcgggtcccttaaactgtcttgcgccgctagcggattctccctctctaccagcggcgttggggtgggatggtttagacaaccttccggcaagggcctggaatggcttgccctgatctggtgggatgacgataaatactataacccgtctctcaagagccagctgtccattagcaaagacttctctcggaatcaggtgtttctgaagatctccaacgtcgatattgcggacacagctacgtactattgtgcccgcagagatcccttcgggtacgacaatgccatgggatattggggccaggggaccagcgtgacagtttcttccgctagcaccaagggaccttctgtgtttcccctcgccccttccagcaaatccacatctggcgggaccgctgccctgggatgccttgtcaaggattacttccccgagcctgtgacagttagctggaactccggcgcgctgaccagcggcgtgcacacgtttccggccgtcctccaatcttccgggctgtatagcctttctagcgtggtgaccgtcccctcctctagcctgggaacacagacctacatctgtaatgttaaccataaaccttccaatacaaaggtggacaaacgggtggaacccaagagctgcgataagacccacacgtgtcctccctgcccggctcctgagctcctgggcgggccctctgtcttcctgtttcctcccaaacccaaggacacactcatgatttcccgcacccctgaagtgacatgtgttgtggtcgatgtgagccatgaggacccggaggttaaattcaactggtacgtggacggagtcgaagtgcacaatgccaagaccaaacccagagaggaacagtataactctacctaccgggtcgtgtccgttctgacagtgcttcatcaggattggctgaatggcaaggagtataaatgcaaggtcagcaacaaggctctccctgcccccatcgagaaaacgatctccaaggcgaaagggcaacctcgcgaaccccaggtgtacaccctgccgccttctagagacgagcttacaaagaatcaggttagcctgacctgtctcgtgaaaggattttatccctccgatattgccgtcgaatgggagtctaacggccagcctgaaaataactacaagacaacgccccctgtgctggacagcgatggctccttctttctgtatagcaagctcaccgtggacaaatctcggtggcaacaggggaacgttttctcctgcagcgtcatgcacgaggctctgcacaatcattacacacagaagtctctttccctgagccccggaaaa

SEQ ID NO: 39188 - RNA, 639 nt, synthetic construct
  misc_feature 1..639: note = derived and/or modified sequence opt5 from Cosfroviximab_LightChain
  source 1..639: mol_type = other RNA
gacatcgtgatgacccagagccccctgtccctctctacaagcgtcggcgatagagtttccctgacgtgcaaggcctctcaaaacgtggggaccgctgtggcctggtaccagcagaaacctggacagagcccgaagctgctgatttattccgcgtctaatcggtacacaggcgtccccgaccgcttcaccgggagcggatccggcacagattttaccctcacaatcagcaacatgcaatctgaggacctggctgattatttctgtcagcagtactccagctatcctcttacctttggggccggaacgaaactggaactcagaaccgtggccgctccctctgttttcatttttcctccctccgacgagcagcttaagagcggcacagcctctgtggtctgcctgctcaataacttctaccctcgggaagctaaagtgcaatggaaggttgataatgccctgcagtccggcaacagccaggagtccgtgaccgaacaggactctaaggatagcacatattcccttagctctaccctgacgctctccaaagcggactacgagaagcacaaagtctacgcctgtgaggtgacacatcaagggctgagctctccggtgaccaagagctttaatcgcggagaatgc

SEQ ID NO: 39189 - RNA, 1344 nt, synthetic construct
  misc_feature 1..1344: note = derived and/or modified sequence opt5 from Crizanlizumab_HeavyChain
  source 1..1344: mol_type = other RNA
caggtgcaactggtccagagcggcgccgaggttaagaaacccggggcttccgtgaaggtgtcttgcaaagtcagcggatacaccttcacatcctatgacatcaactgggtgagacaggcccctggcaaggggctcgaatggatgggatggatttacccgggcgatgggtctatcaaatataatgagaagtttaagggacgggttacgatgaccgtggacaaaagcacagataccgcgtacatggaactgtcctctcttcgcagcgaggacacagctgtctattactgtgccagacggggcgaatatggcaactacgagggggccatggattactggggacagggcaccctggtgacagtttccagcgcttctaccaaggggccctccgtgttccctctcgccccctgcagccgctctacgtccgagagcaccgctgccctgggatgtcttgtcaaagactattttcctgaacccgtgacagtgtcttggaactccggcgcgctgaccagcggggtccacacattccctgccgttctccaatcctctggactgtacagcctgtccagcgtggtgaccgtcacgtcttccaattttggcacacagacctatacatgcaatgtggatcataagccgagcaacaccaaagttgacaagaccgtggagagaaagtgttgcgtcgaatgtcccccttgccccgctcctcccgtggccggcccgtctgttttcctctttcctcccaaacctaaggatacactgatgattagccggacgcccgaggtgacctgtgtcgtggtcgacgtgtcccacgaggatcccgaagttcagttcaattggtacgtggacgggatggaggtccataacgctaaaacaaagcctcgcgaggaacagtttaattctaccttcagagtggttagcgtgcttacagtcgtgcaccaagattggctgaacggaaaagaatataagtgcgccgtgtccaataaaggcctcccggcgcccatcgagaagaccattagcaagacgaaagggcagcctcgggagccccaggtttacacactgcctccctctcgcgaagagatgaccaagaaccaggtctcccttacctgtctggtgaaaggattttatccgagcgacatcgccgtggaatgggagtctaatggccaacctgaaaacaattacaagacaacaccccctatgctcgactccgatgggagcttctttctgtactccaaactgaccgtcgacaagtctagatggcagcagggaaacgtgttcagctgctccgttatgcatgaggctctccacaaccactatacgcaaaagtctctgagcctttcccccggcaaa

SEQ ID NO: 39190 - RNA, 654 nt, synthetic construct
  misc_feature 1..654: note = derived and/or modified sequence opt5 from Crizanlizumab_LightChain
  source 1..654: mol_type = other RNA
gacatccagatgacccaaagcccctcctctctgagcgcctccgtgggcgatagagtcacaattacgtgcaaggcttctcagagcgttgactacgatgggcactcctatatgaactggtaccagcagaaacctggaaaggccccgaaactcctgatctatgcggcttctaatcttgagagcggcgtgccctcccggttcagcgggtctggatccggcaccgactttacactgaccattagctctctccaacctgaagatttcgccacatactattgtcagcagtccgacgagaaccccctgacctttgggggaggcacaaaggtggaaatcaaacgcaccgtcgccgctcctagcgtgttcatttttcccccttctgatgagcagcttaagtccggcacggccagcgttgtgtgcctgctcaataacttctacccgagagaagctaaggtccaatggaaagtggacaatgccctgcagtccgggaactctcaggagagcgttaccgagcaggattccaaggacagcacatattctctgtccagcaccctcacactgtctaaagcggattacgaaaagcataaagtgtacgcctgtgaggtcacccaccaaggacttagctcccccgtgacgaagtcttttaatcggggcgaatgc

SEQ ID NO: 39191 - RNA, 1365 nt, synthetic construct
  misc_feature 1..1365: note = derived and/or modified sequence opt5 from Crotedumab_HeavyChain
  source 1..1365: mol_type = other RNA
gaggtgcagctggtcgaaagcggcgggggactcgttcaacccggcgggtccctgagactttcttgcgccgctagcggattcaccttttccaactacctgatgaattgggtgcggcaggcccctggcaaggggctcgagtggctggcgaacatccaggaagacggaattgagaaatattacgtggattctgtcaagggccgcttcacaatcagcagagacaatgctaaaaactccctttatctgcagatgaatagcctccgggccgaagatacggccgtgtactattgtgctcgcgagccgtctcactacgacattctgaccggctatgattactactatgggatggacgtttggggacaaggcacaaccgtgacagtctccagcgcctctaccaaggggccctccgtgtttcctctggctccctgcagcagatctacatccgagagcaccgccgcgctcggatgtctggttaaagattacttccctgaacccgtgacggtctcttggaactccggcgcccttaccagcggggtgcatacatttcctgctgtgctgcagtcctctggactctatagcctgtccagcgtcgttaccgtgccgtcttccagccttggcacaaagacctacacgtgcaatgtggaccacaagccctctaacacaaaagtcgataagcgggtggagagcaaatatggccctccctgtcctccctgcccggcccctgagttcctcgggggaccctccgtttttctgttccctcccaagcccaaagacaccctgatgatctctcgcacacctgaggtgacctgtgtcgtggttgatgtgagccaggaggacccggaagtccagtttaattggtacgtggatggcgtcgaggtgcataacgctaagaccaagcccagagaagaacaattcaattccacatatcgggttgtgagcgtcctgacggtgctccaccaggactggctgaacgggaaagaatacaagtgcaaagtttctaataagggacttccttccagcattgagaaaaccatctctaaggccaaaggccagccccgcgagcctcaggtgtacacactgcccccgtcccaagaagagatgaccaagaaccaggtcagcctcacatgtctggtgaaggggttttatccttccgacatcgcggtggaatgggagtctaatggacagcccgaaaacaactacaaaaccacgcctcccgttcttgatagcgacggctccttctttctgtattctagactcacagtcgataagagccggtggcaagagggcaatgtgttctcctgcagcgtgatgcatgaggccctgcacaaccactacacccagaaatctctgtccctcagcctggggaag

SEQ ID NO: 39192 - RNA, 642 nt, synthetic construct
  misc_feature 1..642: note = derived and/or modified sequence opt5 from Crotedumab_LightChain
  source 1..642: mol_type = other RNA
gacatccagatgacccaaagcccctcctctctgagcgcctccgtgggcgatagagtcacaattacgtgccgggcttctcaggggatccgcaacgacctcggatggtaccagcagaagcctggcaaagccccgaagagactgatttatgcggctagctcccttcaatctggggttcccagccggttctccggaagcggctctgggaccgagtttatcctgacagtgtccagcctccagcctgaagatttcgccacctactattgtctgcagtacaattctaacccctttacattcggacctggcaccaaagtggacattaagcgcacagtcgccgctccctccgtgtttatcttccctccgagcgatgagcagcttaaatctggcaccgcctccgttgtgtgcctgctcaataacttttatcccagagaagctaaggtccaatggaaggtggacaatgccctgcagagcgggaactcccaggagtctgttacggaacaggatagcaaagactccacctacagcctgtcttccacactcaccctgagcaaggcggattatgagaaacacaaggtgtacgcctgtgaggtcacacatcaaggactttctagccctgtgaccaaatccttcaatcggggcgaatgc

SEQ ID NO: 39193 - RNA, 1356 nt, synthetic construct
  misc_feature 1..1356: note = derived and/or modified sequence opt5 from Dezamizumab_HeavyChain
  source 1..1356: mol_type = other RNA
caggtgcaactggtccagagcggcgccgaggttaagaaacccgggtcctctgtgaaggtgagctgcaaggcttccggattcacctttgccacatacaacatgcactgggtcagacaggcgcctggccaggggctcgaatggatgggatatatctacccgggcgacgggaatgctaactataatcaacagttcaagggacgggtgacgattaccgccgataaatctacaagcaccgcctacatggagctgtcctctcttcgcagcgaagacacagctgtttattactgtgccagaggcgattttgactatgatggcgggtactacttcgactcctggggacagggcaccctggtgacagtcagctctgcttccaccaaggggcccagcgtgtttcctctcgccccctcttccaagagcacgtctggaggcaccgcggccctggggtgccttgttaaagattatttccctgagcccgtgacagtctcctggaacagcggagctctgacctccggcgtgcatacatttcctgccgtgctccagtctagcggcctgtactccctgagctctgtcgttaccgtgccgtccagctctctcgggacgcaaacatatatctgtaatgtgaaccacaagcccagcaataccaaagtcgacaagaaagtggaacctaagtcctgcgataagacacatacctgtcccccttgccccgctccggagctgcttggaggcccttctgttttcctgtttccccctaaacccaaggacaccctcatgattagccggacacccgaggtgacgtgtgtcgtggttgatgtgtcccacgaagaccctgaggtcaaattcaactggtacgtggatggggtcgaagtgcataatgccaagaccaaaccgcgcgaggagcagtataacagcacatacagagttgtgtctgtcctgaccgtgcttcaccaggactggctgaatggaaaggaatataaatgcaaggtttccaacaaggcgctccccgcccctatcgagaaaacaattagcaaggctaaaggccagccccgggaacctcaagtgtacaccctgcccccgtctcgcgacgagctgacgaagaatcaggtctccctcacatgtctggtgaaagggttttaccctagcgatatcgccgtggaatgggagtccaacggacagcccgagaataactataagaccacccctcccgttcttgactctgatggcagcttctttctgtactccaagctcacagtcgacaaatctagatggcaacagggcaacgtgttcagctgctccgtgatgcacgaagctctgcataatcactatacccagaaaagcctttctctgtcccctgggaaa

SEQ ID NO: 39194 - RNA, 642 nt, synthetic construct
  misc_feature 1..642: note = derived and/or modified sequence opt5 from Dezamizumab_LightChain
  source 1..642: mol_type = other RNA
gacatccagatgacccaaagcccctcctctctgagcgcctccgtgggcgatagagtcacaattacgtgccgggcttctgagaacatctacagctatctcgcctggtaccagcagaagcctgggaaagcgccgaagctgcttattcacaatgctaaaaccctggccgaaggagttccctcccgcttctctggcagcgggtccggaacagactttaccctcacaatcagctctctgcagcctgaggatttcgccacctattactgtcaacatcactatggcgctccccttacatttgggcagggaaccaagctggaaattaaaagaacggtggccgctccttccgtgttcatctttccccctagcgacgagcagctcaagtctggcaccgcctccgtcgtgtgcctgctgaacaatttctacccgcgggaagcgaaggttcagtggaaagtggataacgccctccaaagcggcaattctcaggagtccgtcacagagcaggacagcaaggattccacctattctctgagctccacacttaccctgagcaaagctgactacgaaaagcataaagtgtacgcctgtgaggttacgcaccaggggctctcttcccccgtgacaaagagctttaaccgcggagaatgc

SEQ ID NO: 39195 - RNA, 1506 nt, synthetic construct
  misc_feature 1..1506: note = derived and/or modified sequence opt5 from Duvortuxizumab_Chain1_scFv
  source 1..1506: mol_type = other RNA
gagaacgtgctgacccagagccccgccacactctccgtcacgcctggcgaaaaggctaccatcacatgcagagcctctcaaagcgtttcctacatgcactggtatcagcagaaaccggggcaggcgccccggctgcttatttacgacgcttctaatcgcgccagcggagtgccttccagattctctggcagcgggtccggaaccgatcatacactgaccatcagctctctcgaggccgaagacgctgccacatattactgttttcaaggctccgtgtatcccttcacctttgggcagggaacgaagctggagattaaaggcggcgggagcggaggcgggggagaagtccagcttgtggagtctggcgggggactggttcagcctggcggctccctccggctgagctgcgctgcctctgggttcaccttttccacatacgcgatgaactgggtgcgccaagcccccggaaagggcctggagtgggtcgggagaatccggagcaaatataataactacgctacctactatgccgattccgtgaagggacgcttcacaatttctagagacgatagcaaaaattccctctacctgcagatgaacagccttaagaccgaagacacggctgtttattactgtgtgcggcacggcaattttgggaactcttatgtctcctggttcgcctactggggacagggcacactggtgaccgtgagctctgcgagcacaaagggcgaggtcgccgcttgcgaaaaagaggttgccgctctcgagaaggaagtggccgccctggagaaagaagtggctgcgcttgagaaagggggaggcgataagacccatacctgtcctccgtgccccgcccctgaagctgccgggggaccctccgtctttctgttccctcccaagccgaaggacacactcatgatctctcgcacgcctgaggtgacctgtgttgtggtcgatgtgagccacgaggaccccgaagttaaatttaattggtatgtggatggcgtcgaggtgcataacgccaagacaaaacctagagaggaacagtacaattccacctaccgggtcgtgagcgttctgacagtgctgcaccaagactggctcaacgggaaggaatataaatgcaaggtctctaataaggctctgcccgcccccatcgagaaaaccatttccaaggcgaaaggccagcctcgcgagccccaggtgtacacgcttccccctagcagagaagagatgacaaagaaccaagtttctctgtggtgtctcgtgaaaggattctatccctccgatatcgctgtcgaatgggagagcaatggccagcctgaaaacaactacaagaccaccccgccggtgctggactccgacgggagctttttcctttattctaagctgacagtggataaatcccggtggcagcagggaaatgttttctcttgcagcgtcatgcacgaggccctccataaccactacacccaaaagtccctgagcctgtctcctggcaaa

SEQ ID NO: 39196 - RNA, 813 nt, synthetic construct
  misc_feature 1..813: note = derived and/or modified sequence opt5 from Duvortuxizumab_Chain2_scFv
  source 1..813: mol_type = other RNA
caggccgtggtcacccaagagcccagcctgacagtttcccctggcgggacggtgaccctcacatgcagatctagcaccggagctgtgacaacctccaactacgccaattgggtccagcagaagccgggccaggcgccccgggggctgatcggaggcacaaacaaacgcgctccttggacccccgccagattctctgggagccttctgggaggcaaggccgctctcacgattaccggcgcccaagctgaagacgaggccgattattactgtgcgctgtggtattccaatctttgggtgtttgggggaggcacaaaactgaccgttctcgggggaggcgggtctggaggcggcggacaggtgacactgcgggaaagcgggcctgccctggtcaagcccacccagacgctcacactgacctgcacattctccggctttagcctttctacctccgggatgggagtgggctggatccgccagcctccggggaaagctctggagtggctcgcccacatttggtgggacgatgacaagagatacaaccccgctcttaagagccggctgaccatctctaaagatacatccaagaatcaagttttcctgacgatgaccaacatggaccctgtggatacagccacctattactgtgcgcgcatggaactctggagctattactttgactactggggacagggcacaaccgtcacggtgtcttccgccagcacaaaaggcaaggtggctgcctgcaaagagaaggtcgctgccctgaaggagaaagttgccgctctgaaggaaaaagtggcggccctcaaggag

SEQ ID NO: 39197 - RNA, 681 nt, synthetic construct
  misc_feature 1..681: note = derived and/or modified sequence opt5 from Duvortuxizumab_Chain3_h-CH2-CH3
  source 1..681: mol_type = other RNA
gacaagacccacacatgtcccccttgcccggcccccgaggctgccggcgggcctagcgtgttcctgtttccccctaaacccaaggatacgctcatgatctccagaacccctgaagtcacatgcgttgtggtggacgtctctcatgaggatccggaagtgaaattcaactggtacgttgacggagtggaggtccacaatgcgaagaccaaaccccgggaagaacagtataacagcacataccgcgtggtttccgtgctgaccgtccttcatcaagattggctgaatggcaaggagtataagtgtaaagtgtctaacaaggctctccctgcccccattgagaaaacaatcagcaaggccaaagggcagcctagagagccccaggtgtacaccctgccgccttcccgggaagagatgacgaagaatcaggtctctcttagctgcgctgttaagggattttatccctccgacattgccgtggagtgggaaagcaacggccaacctgagaataactacaaaaccacacctcccgtgctggattctgacgggtccttctttctcgtcagcaagctgaccgtggataaatctcgctggcagcagggaaatgttttctcctgtagcgtgatgcacgaagctctgcataacagatatacacagaagtctctctccctgagccccggcaaa

SEQ ID NO: 39198 - RNA, 360 nt, synthetic construct
  misc_feature 1..360: note = derived and/or modified sequence opt5 from Efungumab_HeavyChain
  source 1..360: mol_type = other RNA
atggccgaggtgcagctggtcgaaagcggcgctgaggttaagaaacccggggaatccctcagaatctcttgcaagggaagcggctgtattatctcctcttactggattagctgggtgcggcaaatgcctgggaaaggactggagtggatgggcaagatcgacccgggggattcctatattaactactctcccagcttccagggacacgtgaccatctccgccgacaaaagcatcaatacagcgtatcttcagtggaactctctgaaggcttccgatacggccatgtactattgcgcccgcggcggcagagactttggggatagcttcgactactggggacagggcaccctcgtcacagtg

SEQ ID NO: 39199 - RNA, 750 nt, synthetic construct
  misc_feature 1..750: note = derived and/or modified sequence opt5 from Efungumab_HeavyChain_LightChain
  source 1..750: mol_type = other RNA
atggccgaggtgcagctggtcgaaagcggcgctgaggttaagaaacccggggaatccctcagaatctcttgcaagggaagcggctgtattatctcctcttactggattagctgggtgcggcaaatgcctgggaaaggactggagtggatgggcaagatcgacccgggggattcctatattaactactctcccagcttccagggacacgtgaccatctccgccgacaaaagcatcaatacagcgtatcttcagtggaactctctgaaggcttccgatacggccatgtactattgcgcccgcggcggcagagactttggggatagcttcgactactggggacagggcaccctcgtcacagtgtcttccgggggaggcgggagcggaggcggcgggtctggaggcgggggatccgatgttgtgatgacccaaagcccttcctttctgtctgctttcgtcggcgaccggattacaatcacctgtcgcgccagctccgggattagcagatatcttgcttggtaccagcaggcccccggaaaggcgcctaaactgctcatctacgccgcttctacactgcagaccggcgtgccctcccggtttagcggctctgggagcggaacggagttcaccctgacaattaattccctccaacctgaagattttgccacctattactgccagcatctgaactcttatccgcttacattcggcgggggaaccaaggttgacatcaaacgcgctgccgcgctggag

SEQ ID NO: 39200 - RNA, 339 nt, synthetic construct
  misc_feature 1..339: note = derived and/or modified sequence opt5 from Efungumab_LightChain
  source 1..339: mol_type = other RNA
gacgtggtcatgacccagagcccctccttcctgtctgcctttgttggcgatagaatcacaattacgtgccgggctagctccgggatctctcgctacctcgcctggtatcaacaggcgcctggaaaggctccgaaactgcttatttacgccgccagcaccctgcagacaggcgtgccctccagattctctgggagcggatccggcaccgagtttacactcaccatcaacagcctgcagcctgaagacttcgctacatattactgtcaacaccttaattcttatcccctgacctttgggggaggcacgaaggtggatattaaacgggccgctgccctcgag

SEQ ID NO: 39201 - RNA, 1350 nt, synthetic construct
  misc_feature 1..1350: note = derived and/or modified sequence opt5 from Elezanumab_HeavyChain
  source 1..1350: mol_type = other RNA
gaggtgcagctggtccaaagcggcgccgaagttaagaaacccggggcttccgtgaaggtgtcttgcaaagccagcggatacaccttcacatcccacggcatctcttgggtcagacaggcgcctgggcagggactcgactggatgggctggattagcccgtattccgggaacacgaattacgctcagaagctgcaaggacgggtgaccatgacaaccgatacatctaccagcacagcctatatggagctttccagcctgcgctctgaagacaccgccgtttactattgtgctagagtgggctccggcccctactattacatggatgtctgggggcagggaacgctcgtgaccgttagctctgcctccacaaaaggccctagcgtgtttcccctggctccttcttccaagagcacctccgggggaacagccgcgcttggctgcctggtcaaggactacttccccgagcctgtgaccgtgtcttggaacagcggggccctcacgtccggagtccatacatttccggctgttctgcagagctctggcctgtattccctcagctctgtggtgaccgtccccagctcctctctgggcacacagacctacatctgtaatgtgaaccacaaacctagcaataccaaggttgataaaaaggtggaacccaaatcctgcgacaagacacatacgtgtcctccctgcccggcccctgaggctgccgggggacccagcgtcttcctttttcctcccaagcccaaagatcaactgatgatttctcggacccctgaggtgacatgtgttgtggtcgacgtgtcccacgaagatccggaggtcaagttcaactggtatgtggacggcgttgaagtgcataatgcgaaaaccaagccccgcgaggagcagtacaacagcacatatagagtcgtgtctgttctcaccgtgctgcaccaggattggcttaatgggaaagaatacaagtgcaaagtctccaacaaggccctgcctgctcccatcgagaagacgattagcaaagccaagggacagcctcgggaaccccaagtgtatacactcccgccttcccgcgaggaaatgaccaaaaatcaggtgtctctgacctgtctggttaagggcttttaccccagcgacatcgctgtcgagtgggagtccaacgggcagcctgaaaataactacaaaacaacaccccctgtgctcgattctgacggcagcttctttctgtattccaagctgaccgtggacaagagcagatggcaacagggaaatgtcttctcttgctccgtgcttcacgaggccctccataaccactacacgcagaaaagcctgtctctttcccccggcaag

SEQ ID NO: 39202 - RNA, 645 nt, synthetic construct
  misc_feature 1..645: note = derived and/or modified sequence opt5 from Elezanumab_LightChain
  source 1..645: mol_type = other RNA
cagagcgccctgacccaacccagatccgtgtctggcagccctgggcagtccgtcacaatctcttgcacgggaaccagctcctctgttggcgacagcatttacgtgtcctggtatcagcagcacccggggaaggctcccaaactcatgctgtacgatgtgacaaagcggcctagcggagtccccgaccgcttctctggctccaaaagcgggaacaccgcctctcttacaatctccggactgcaagcggaggatgaagctgactattactgttatagctacgccggcaccgatacactctttggcgggggaaccaaggtgacggttctgggccagcctaaagccgctccctctgtgacccttttccctccgtccagcgaggaactgcaggccaataaggctacactcgtctgcctgatttccgacttttatcccggggccgtgaccgttgcgtggaaggccgattctagccctgtgaaagctggagtcgagacaaccacgccctccaagcagagcaacaataaatacgccgcttcttcctacctgagcctcacacctgaacaatggaagtctcatagaagctattcctgtcaggtgacccacgagggctctacagtggagaaaaccgtcgcccccaccgaatgcagc

SEQ ID NO: 39203 - RNA, 1359 nt, synthetic construct
  misc_feature 1..1359: note = derived and/or modified sequence opt5 from Emapalumab_HeavyChain
  source 1..1359: mol_type = other RNA
gaggtgcagctgctcgaaagcggcgggggactggtccaacccggcgggtcccttagactgtcttgcgccgctagcggattcaccttttcctcttacgccatgagctgggttcggcaggcgcctggcaaggggctcgagtgggtgtccgctatctctggaagcggcggctccacatattacgccgacagcgtgaaagggcgcttcacgatttctagagataactccaagaataccctgtatcttcagatgaacagcctgcgggccgaagacacagctgtctactattgtgccaaagatggatcttccggctggtacgtgccgcactggtttgacccctgggggcagggaaccctcgttacagtgagctctgcttccaccaagggccctagcgtcttccccctggccccttcctctaaaagcacatccgggggaaccgcggccctgggctgcctcgtgaaggattattttcccgagcctgttacggtgagctggaactctggcgctctgacctccggggtccatacattcccggccgtgcttcaaagctctggactgtacagcctctcctctgtggtcaccgttcccagctccagcctgggcacacagacctacatctgtaatgtgaatcacaagccttctaacacgaaagtggacaagcgcgtcgaacccaaatcctgcgataagacacatacctgtcctccctgcccggctcctgagcttctcgggggacccagcgtgtttctgttccctcccaaacccaaggacacactgatgatttctagaacccctgaggttacctgtgtggtcgtggatgtttcccacgaagacccggaggtgaagtttaattggtatgtcgatggcgtggaagtccataacgccaaaacaaagccccgggaggagcagtacaatagcacgtatcgcgtggtttccgtgctgaccgtcctccaccaggactggctgaacgggaaagaatacaagtgcaaagtgtctaataaggcgcttcctgcccccatcgagaaaacaattagcaaggctaagggacaacctagagaaccccaggtttataccctgccgccttcccgggaggaaatgacaaagaaccaggtgtctctcacctgtctggtcaagggcttctaccccagcgatatcgccgtggagtgggagtccaatggccagcctgaaaacaattataaaacgacaccccctgtgcttgacagcgacgggtcctttttcctgtactctaagctcaccgttgataaaagccgctggcaacagggaaacgtcttttcttgctccgtgatgcacgaggctctgcataaccactacacccagaaaagcctgtctctcagccccggcaag

SEQ ID NO: 39204 - RNA, 651 nt, synthetic construct
  misc_feature 1..651: note = derived and/or modified sequence opt5 from Emapalumab_LightChain
  source 1..651: mol_type = other RNA
aacttcatgctgacccagccccacagcgtgtccgagtctcctggcaagacagtcacgatcagctgcaccagatcctctgggagcattgcctccaattacgttcaatggtatcagcagcggccgggatctagccccacaaccgtgatctacgaagacaaccagcgcccttccggcgtgcccgatagatttagcgggtctattgactccagctctaattccgctagcctcacaatctctggactgaaaaccgaggatgaagccgactattactgtcaatcctatgatggcagcaaccggtggatgttcgggggaggcacaaaacttaccgtcctgggccagcctaaggcggctccctccgtgacgctctttcctccgtctagcgaggaactgcaggccaataaggccacccttgtttgcctgatttccgacttctaccccggggctgtgacagtcgcctggaaagctgatagctctcctgtgaaggccggagttgagaccacaaccccctccaagcagagcaacaataaatatgcggcctctagctacctctccctgacgcctgagcaatggaagtctcatcgcagctactcctgtcaggtgacacacgaaggcagcaccgtcgagaaaacagtggctcccaccgaatgctct

SEQ ID NO: 39205 - RNA, 1341 nt, synthetic construct
  misc_feature 1..1341: note = derived and/or modified sequence opt5 from Enoblituzumab_HeavyChain
  source 1..1341: mol_type = other RNA
caggtggagctggtcgaaagcggcgggggactcgttcaacccggcgggtccctgagactttcttgcgccgctagcggattcacctttacatcctactggatgtcttgggtgcggcaggcccctggcaaggggctggagctcgtgagctccatcacgtcttatggcagcttcacctactatgcggactccgtcaaaggacgctttacaattagcagagataactctaagaataccctgtaccttcagatgaactccctgcgggctgaagacacagccgtgtattactgtgcccgcaatatgtatacccacttcgatagctggggccaggggacactcgttaccgtgtcttccgctagcacgaaaggaccgtctgtctttcccctggccccttccagcaagtccacctctggcgggacagctgccctgggatgcctcgtgaaagactacttccccgagcctgttaccgtgagctggaactccggcgcgctgacaagcggggtccatacctttcccgccgtgcttcaatcttccggactgtacagcctctctagcgtggtcacggttccttcctctagcctgggcacacagacctatatctgtaatgtgaaccacaagccgtccaatacaaaggtggataaaaaggtcgaacccaaaagctgcgacaagacccatacctgtcctccctgccctgctcccgagcttctgggcgggccgtctgtgttcctctttcctcccaaacctaaggatacactgatgatttccagaacgcccgaggttacctgtgtggtcgtggacgttagccacgaagatcccgaggtgaagttcaactggtacgtcgacggagtggaagtccataatgccaaaacaaagcctcgggaggagcagtataactctacctaccgcgtggtttccgtgctgacagtcctccaccaggattggctgaatggcaaagaatataagtgcaaagtgagcaacaaggcccttccggctcccatcgagaaaaccatttccaaggcgaaggggcaacctagagaaccccaggtttacacgctgcctccctctcgggacgagctcaccaaaaatcaggtgagcctgacatgtcttgtcaagggattttatccgtccgatatcgccgtggaatgggagtctaacggccagcctgagaataactacaaaaccacaccccctgtgctggacagcgacgggtccttctttctctacagcaagctgaccgttgataaatctcgctggcaacagggaaacgtcttctcctgcagcgtgatgcacgaagctctgcataatcactatacacagaagtctctctccctgagccccggcaag

SEQ ID NO: 39206 - RNA, 648 nt, synthetic construct
  misc_feature 1..648: note = derived and/or modified sequence opt5 from Enoblituzumab_LightChain
  source 1..648: mol_type = other RNA
gacatcgtgctgacccagccccctagcgtctccggcgccccggggcaaagagttacaatttcttgcagcggatcctctagcaacatcggctccaattctgtgagctggtaccagcagctccccgggacggctcctaagctgcttatttatgataactccaaacggcccagcggagtgcctgaccgcttctctggctccaagagcgggacctctgcctccctggcgatcacaggactccagagcgaggatgaagctgactactattgtcaatctagagatacctacggctattactgggtctttggcgggggaacaaaactgaccgtgcttggccagcccaaggccgccccttccgttacactgttcccgcccagctccgaggaactccaggctaataaagccaccctggtgtgcctgatttctgacttttatcctggggctgtcacggtggcctggaagggagatagctcccccgttaaggcgggcgtggagaccacaacccctagcaaacagtctaacaataagtacgccgcttccagctacctctctctgacacccgaacaatggaaaagccaccggtcctattcttgtcaggtcacccatgaggggagcacggtggagaagacagtggccccgaccgaatgctcc

SEQ ID NO: 39207 - RNA, 1323 nt, synthetic construct
  misc_feature 1..1323: note = derived and/or modified sequence opt5 from Eptinezumab_HeavyChain
  source 1..1323: mol_type = other RNA
gaggtgcagctggtcgaaagcggcgggggactcgttcagcccggcgggtccctgagactttcttgcgccgtgagcggaatcgacctgtccggctactatatgaactgggtgcggcaggctcctgggaagggactcgagtgggtcggcgtgattggcatcaatggggccacctactatgcgtcttgggctaaaggacgcttcacaattagcagagataactccaagacgaccgtttacctgcagatgaatagccttcgggccgaagacacagccgtgtatttttgtgctcgcggcgatatctgggggcagggaaccctggtcacagtgagctccgccagcaccaaaggcccgtctgttttccccctcgctccttccagcaagtctacatccgggggaaccgccgcgctgggctgcctggtgaaagactactttcccgagcctgtcacggtgagctggaactctggcgccctcacctccggggtgcacacattccccgctgtcctgcaaagctccggactttattctctgagctccgttgtgaccgtgccttcttcttccctcggcacacagacctacatttgtaatgtcaaccataagccgagcaatacgaaggtggatgccagagttgaacccaaatcttgcgacaagacacacacctgtcctccctgccctgctcccgagctgcttgggggaccgagcgtgacactgtttcctcccaaacctaaggataccctcatgatctcccggacccccgaggtcacatgtgtggttgtggacgtctctcatgaagatcccgaggtgaaattcaactggtacgtcgacggcgtggaagttcacaatgccaagacgaagcctcgcgaggagcagtatgcgagcacctacagagtggtctccgtgctgacagttctgcatcaggattggctcaacgggaaagaatataagtgcaaagtgagcaataaggccctgccggctcccatcgagaaaaccatttctaaggccaaaggacaacctcgggaaccccaggtctacacacttcctccctcccgcgaggaaatgaccaagaaccaggtgagcctgacgtgtctcgtgaagggcttttatccgtctgacatcgctgttgagtgggagtccaatggccagcctgaaaacaattacaaaacaacaccccctgtcctggatagcgacgggtccttctttctttattctaagctgaccgtggacaaaagcagatggcaacagggaaacgtgttctcctgctctgtcatgcacgaggccctccacaaccattacacccaaaagagcctgtccctgagccccggcaaa

SEQ ID NO: 39208 - RNA, 657 nt, synthetic construct
  misc_feature 1..657: note = derived and/or modified sequence opt5 from Eptinezumab_LightChain
  source 1..657: mol_type = other RNA
caggtgctgacccaaagcccctcctctctcagcgcctccgtcggcgaccgggttacaatcaactgccaggcttctcagagcgtgtaccacaatacgtatctggcctggtaccagcaaaagcctgggaaagtgccgaagcagcttatttatgatgcgtccaccctggcttctggagtccccagccggttctccggcagcgggtctggaacagactttaccctcacaatctccagcctgcagcctgaggatgtggccacctactattgtcttggctcttacgactgcacaaacggggattgtttcgtttttggaggcggcaccaaagtggaaattaagcgcacggtcgccgctccctccgtgttcatctttcctcccagcgacgagcagctgaaatctgggaccgcctccgttgtgtgcctcctgaataacttctatcctagagaagctaaggtccaatggaaggtggataatgccctgcagagcggaaactcccaggagtctgtgacagaacaggacagcaaagattccacctacagcctctcttccacactgacccttagcaaggcggactacgagaaacataaggtctatgcctgtgaggttacgcaccaaggcctgtctagcccggtgacaaaatcctttaatagaggggaatgc

SEQ ID NO: 39209 - RNA, 1368 nt, synthetic construct
  misc_feature 1..1368: note = derived and/or modified sequence opt5 from Erenumab_HeavyChain
  source 1..1368: mol_type = other RNA
caggtgcaactggtcgagagcggcgggggagttgtgcagcccggcagatccctccggctgtcttgcgccgctagcgggttcaccttttcctctttcggaatgcactgggtgcgccaggcccctggcaaggggcttgaatgggtcgcggtgatcagctttgacggatccattaaatactctgttgatagcgtgaagggcagattcacaatctcccgggacaacagcaaaaatacgctgtttctccagatgaactctctgcgcgctgaggataccgccgtctattactgtgccagagaccggcttaattattacgattccagcggctattaccattataagtactacgggatggctgtgtggggacaaggcacaaccgttacagtgtcttccgccagcaccaaagggccgtctgtcttccccctggctccttgctcccgcagcacatccgaatctaccgccgcgctcggatgtctggtgaaggactattttcccgagcctgtgacggtcagctggaactccggcgccctgaccagcggggttcacacattccccgctgtgctccagtcttccggactgtacagcctttctagcgtggtcaccgtgccttcctctaattttggcacacagacctatacgtgcaacgttgatcataagccgagcaatacaaaagtggacaagaccgtcgaaagaaaatgttgcgtggagtgtcccccttgccccgcccctcccgttgctggcccgtccgtgttcctgtttcctcccaagcctaaagatacactcatgattagccggacccccgaggtcacctgtgtggtcgtggacgtttctcacgaagatcccgaggtgcagttcaactggtacgtcgacggggtggaagttcataatgccaagacaaagcctcgcgaggagcaatttaactccacgttcagagtggtcagcgtgctgaccgtggttcaccaggattggcttaatggaaaagaatataagtgcaaagtctctaacaagggcctgccggcgcccatcgagaaaacaatttccaagaccaaagggcagcctcgggaaccccaggtgtacacactccctcccagccgcgaggaaatgaccaagaatcaagtgtccctgacgtgtctggtcaagggattctatccgtctgacatcgccgtggagtgggagagcaacggccagcctgaaaataactacaaaacaacaccccctatgctcgactccgatgggagctttttcctgtactctaaacttaccgttgacaagtccagatggcagcaaggaaacgtgtttagctgctctgtcatgcacgaggctctgcataatcactatacccagaagtccctcagcctgtctcccggcaaa

SEQ ID NO: 39210 - RNA, 648 nt, synthetic construct
  misc_feature 1..648: note = derived and/or modified sequence opt5 from Erenumab_LightChain
  source 1..648: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgacaataacaagagacccagcgggattcctgatcggttctccggaagcaaatctggcacctccacaaccctggggatcacaggactccaaaccggcgacgaggcggattattactgtggcacatgggacagccgcctgtctgctgtggtctttgggggaggcaccaaacttacggtgctggggcagcccaaggccaatcctaccgttacactcttcccgccctccagcgaggaactgcaggccaacaaggctaccctggtgtgcctcatttctgatttttatcctggagccgtcacagtggcttggaaggccgacggctcccccgttaaagcgggggtggaaaccacgaagcctagcaaacagtccaataacaagtacgccgcttctagctatctgtcccttacacccgagcaatggaaaagccacagatcttactcctgtcaggtcacccatgaaggaagcacagtggagaagaccgtggccccgaccgagtgctct

SEQ ID NO: 39211 - RNA, 1344 nt, synthetic construct
  misc_feature 1..1344: note = derived and/or modified sequence opt5 from Fremanezumab_HeavyChain
  source 1..1344: mol_type = other RNA
gaggtgcagctggtcgaaagcggcgggggactcgttcaacccggcgggtccctgagactttcttgcgccgctagcggattcaccttttccaactactggatctcttgggtgcggcaggcccctggcaaggggctggagtgggtggcggaaattcgcagcgagtccgacgcttctgccacacactatgccgaagctgtcaaaggaagattcacgatcagccgggataatgccaagaactccctctacctgcagatgaatagccttcgcgctgaggacaccgccgtgtattactgtctggcgtattttgattacggcctcgccattcagaactattggggccaagggacactggttaccgtgtcttccgctagcacaaaaggaccgtctgtcttccccctggccccttgctccagaagcacctctgagtccacagctgccctcggctgtctggtgaaggactactttcccgaacctgttaccgtgagctggaactccggggcgcttacgtctggagtccataccttccccgccgtgctgcagagctccggcctctacagcctgtcttccgtggtcacagttcctagctctaattttgggacccagacatatacctgcaatgtggatcacaaaccgagcaacacgaaggtggacaagacagtcgagcggaaatgttgcgtggaatgtcccccttgccccgctcctcccgttgccggaccgtccgtgttcctttttcctcccaagcctaaagataccctgatgatctctcgcacacccgaggtcacctgtgtggttgtggacgtcagccatgaggatcccgaagtgcagttcaattggtacgtcgacggcgtggaggttcacaacgctaagaccaaacctagagaggaacaatttaattccacattccgggtggtcagcgtgctcacggttgtgcatcaggattggctgaacggcaaggaatataagtgcaaagtctctaataaggggctgccgtccagcattgagaaaaccatctctaagacaaaaggacagccccgcgagcctcaggtgtacaccctgcccccttccagagaagagatgacaaagaaccaagtgagcctcacctgtcttgttaaaggcttttatccctccgacatcgccgtcgaatgggagtctaatgggcagccggaaaacaactacaagacgacacctcccatgctggatagcgacggatccttcttcctctattctaagctgaccgtggacaaaagccggtggcagcaaggcaatgtgttttcctgcagcgtcatgcacgaggcccttcacaaccattacacccagaagtctctgtccctcagccctgggaaa

SEQ ID NO: 39212 - RNA, 642 nt, synthetic construct
  misc_feature 1..642: note = derived and/or modified sequence opt5 from Fremanezumab_LightChain
  source 1..642: mol_type = other RNA
gagatcgtgctgacccagagccccgccacactctccctgtctcctggcgaaagagctacgcttagctgcaaggcctccaaacgggtcaccacatacgtttcttggtatcaacagaagccggggcaggcgccccgcctgctcatttacggagctagcaacagatatctgggcatccctgcccggttctccgggtctggaagcggcaccgactttacacttaccatttccagcctggagcccgaagatttcgccgtgtactattgttctcagtcctacaattatccttacacatttgggcaaggaaccaaactcgagatcaagcgcacggtggctgcccccagcgtcttcatttttcctccgtctgacgaacagctgaaatccggcaccgctagcgtggtttgcctgctcaacaatttctaccccagagaggccaaggtgcagtggaaggtcgataacgcgctgcagtctggcaattcccaagagagcgtgacagaacaggactccaaagattctacctatagcctttccagcacactgaccctctctaaggccgactacgagaaacacaaggtttatgcttgtgaagtgacgcatcaggggctgtccagccctgtcacaaaatcttttaaccggggagagtgc

SEQ ID NO: 39213 - RNA, 1371 nt, synthetic construct
  misc_feature 1..1371: note = derived and/or modified sequence opt5 from Frunevetmab_HeavyChain
  source 1..1371: mol_type = other RNA
caggtgcaactggtcgagagcggcgccgaactcgttcagcccggggagtccctgagacttacctgcgctgcctctggattcagcctgacaaacaataacgtgaattgggtgcggcaggcgcctggcaaggggctcgaatggatgggaggcgtctgggctgggggagccacggactacaactccgccctgaaatctcgccttaccatcacaagagataccagcaagaatacagtgtttctgcagatgcactccctccaatctgaggacaccgctacatattactgtgcccgggatggcggctatagctccagcaccctgtacgctatggacgcctgggggcagggaacgaccgttacagtgtctgcggcctccaccacagctccgagcgtcttccccctggccccttcttgcggcaccacgtccggggctacagtggccctcgcgtgtctggttcttggatattttcccgaacctgtgaccgtcagctggaactctggcgccctgacatccggggtgcataccttccccgctgtgctccaggccagcggactgtactccctttctagcatggtcaccgttccttccagccgctggctgtctgatacatttacgtgcaatgtggctcacccgccctccaacaccaaagtggacaagacagtcagaaaaaccgatcatcctcccggccctaagccctgtgactgcccgaagtgtcctccccctgagatgctcggcgggcccagcattttcatctttccccctaaaccgaaggatacactgtctattagccggacccccgaggtgacgtgcctggttgtggacctcggacctgatgactccgatgtccagatcacatggttcgtggacaatacccaagtttataccgccaaaacatctccccgcgaagaacagtttaacagcacctacagagtggtctccgtgctgcctattcttcaccaggactggctgaagggcaaagagttcaagtgtaaggtcaatagcaaatctctcccctccccgatcgagcggacaatcagcaaggccaaagggcagcctcatgagccccaagtgtacgttctgcctcccgctcaggaggaactttctcgcaacaaggtgtccgtcacgtgcctgattaagagctttcaccctcccgatatcgcggtggaatgggagattaccggacagccggaacctgagaataactatagaacaacccctccccaactcgactccgatggcacatacttcgtttattctaaactgagcgtggaccggtcccactggcagcgcgggaatacctacacgtgttctgtcagccatgaggccctgcactcccatcacacccagaaaagcctcacacagtctcccggaaag

SEQ ID NO: 39214 - RNA, 651 nt, synthetic construct
  misc_feature 1..651: note = derived and/or modified sequence opt5 from Frunevetmab_LightChain
  source 1..651: mol_type = other RNA
gacatcgagatgacccagagccccctgtccctctctgtgacacctggcgaaagcgtctccatttcttgcagagccagcgaggatatctacaacgctctggcctggtatcttcaaaagccggggcggtctccccgcctgctcatttacaatacggacaccctgcacacaggagttcctgatagattctccggcagcgggtccggaaccgactttacacttaaaatcagccgggtgcagaccgaagatgtgggcgtctatttctgtcagcattactttcactatccccgcacattcgggcagggaaccaagctggagctcaaaagatctgacgcgcaaccttccgtgtttctgttccagcccagcctggatgaactccatacgggctctgcttccattgtttgcatcctgaacgacttttaccctaaggaggtgaatgtcaaatggaaggtggatggcgttgtgcagaacaaggggatccaggagagcaccacagaacaaaattctaaagactccacctatagcctttcctctacactgaccatgagctccacggagtaccagagccacgaaaagttctcttgtgaggtcacacataaatccctcgccagcaccctggtgaagtcttttaaccggagcgagtgccagcgcgaa

SEQ ID NO: 39215 - RNA, 1341 nt, synthetic construct
  misc_feature 1..1341: note = derived and/or modified sequence opt5 from Gatipotuzumab_HeavyChain
  source 1..1341: mol_type = other RNA
gaggtgcagctggtcgaaagcggcgggggactcgttcaacccggcgggtccatgagactgtcttgcgtggccagcggattccctttttccaactactggatgaattgggtgcggcaggctccgggcaaggggcttgagtgggtcggagaaatccgcctgaaatctaacaattataccacacactacgccgagagcgtgaagggcagattcacgatttcccgggacgattctaaaaacagcctctatctgcagatgaactcccttaagaccgaagacacagcggtttactattgtacccgccattactattttgattactggggccaggggacactggtgaccgtcagctctgcttccacaaaaggacccagcgtgttccctctcgccccctcttccaagagcacctctggcgggacggccgctctgggatgcctggttaaggactactttcctgagcccgtgaccgtctcctggaatagcggcgccctcacatccggggtgcacaccttccctgctgtgctgcaatctagcggactttattccctgagctctgtcgttacagtgccgtccagctctctcggcacccagacgtacatctgtaatgtgaaccataaacccagcaatacaaaggtcgataaaaaggtggagcctaaatcctgcgacaagacccacacatgtcccccttgccccgccccggaactgcttggcgggccttctgtttttctgtttccccctaagcccaaagataccctcatgattagcagaacccccgaggtgacatgtgtcgtggttgacgtgtcccatgaagatcctgaggtcaagttcaactggtatgtggacggagtcgaggtgcacaatgcgaaaacgaagccgcgggaggaacagtacaacagcacctatcgcgttgtgtctgtcctgacagtgctgcaccaggattggctcaatggcaaagaatacaagtgcaaagtttccaacaaggccctgcccgctcctatcgagaagaccattagcaaagccaaggggcaacccagagaacctcaggtgtatacacttcccccgtctcgggacgagctgaccaaaaatcaggtctccctcacgtgtctggtgaagggattctaccctagcgatatcgctgtggagtgggaatccaacggccagcccgagaacaattacaaaacaacccctcccgttcttgactctgacgggagctttttcctgtattccaagctcaccgtcgataagtctcgctggcaacagggaaacgtgtttagctgctccgtgatgcatgaaggcctgcacaatcattacacacagaaaagcctgtctctctcccctggcaag

SEQ ID NO: 39216 - RNA, 657 nt, synthetic construct
  misc_feature 1..657: note = derived and/or modified sequence opt5 from Gatipotuzumab_LightChain
  source 1..657: mol_type = other RNA
gacatcgtgatgacccagagccccctgtccaaccctgtcacaccgggcgagcccgcctctattagctgcagatcctctaagagcctcctgcactccaatgggatcacgtacttcttttggtatcttcaaaaacctggacagtctccccagctgctcatttaccagatgagcaacctggcttccggcgttcctgatcggttcagcgggtctggatccggcaccgactttacacttcgcatcagcagagtggaagccgaggatgtgggggtctattactgtgcgcaaaatctggaactgccccctaccttcggacagggcacaaaggtggagattaaacggaccgttgctgccccgtctgtgtttatctttcccccttccgacgaacagctcaagagcggcacagcctctgtcgtgtgcctgctcaacaatttctatccccgcgaggctaaagttcagtggaaggtggataacgccctgcaatccgggaatagccaggagtccgtcaccgaacaggactctaaggatagcacgtactcccttagctctaccctgacactctccaaagctgactatgagaagcataaagtgtacgcctgtgaagtgacccaccagggactgagctctcctgtcacaaagagcttcaacagaggcgagtgc

SEQ ID NO: 39217 - RNA, 1365 nt, synthetic construct
  misc_feature 1..1365: note = derived and/or modified sequence opt5 from Gedivumab_HeavyChain
  source 1..1365: mol_type = other RNA
gaggtgcagctggtcgaaagcggcgggggagttgtgcaacccggcaagtccctcagactgtcttgcgccgctagcgggcttaccttctcctcttacgccgtgcactgggtccggcaggcgcctggaaaaggcctggagtgggtgacactcatcagctatgacggggctaaccagtactatgccgattccgttaagggacgctttacgatttctagagacaatagcaaaaacaccgtgtacctgcagatgaactcccttcggccggaagatacagccgtctattactgtgctgtgcccggccctgttttcggcatctttcccccttggagctatttcgacaattgggggcaaggcattctggtgaccgtctcttccgccagcacaaagggaccctctgtgtttcctctcgctccgtccagcaaatctacctccgggggaacagccgcgctgggctgcctggtgaaggattacttccccgagcctgtcaccgttagctggaactccggggccctcacgtctggagtgcatacctttcccgctgtgctgcagagctccggcctttacagcctgtcttccgtcgtgacagttcctagctctagcctcggcacccagacatatatctgtaatgtgaatcacaagccctccaacaccaaagtcgacaagaaagtggaaccgaagtcttgcgataaaacgcatacatgtcctccctgccctgcccccgagctgcttgggggacccagcgttttcctgtttcctccgaagcccaaggacaccctcatgatttcccgcacacctgaggtgacctgtgtcgtggtcgatgtgagccacgaagaccccgaggttaaattcaattggtacgtggatggcgtcgaagtgcataacgctaagaccaaacctagagaggagcagtataattctacataccgggttgtgtccgtcctgacggtgctgcaccaagactggctcaacgggaaggaatataaatgcaaggtgagcaataaagccctgcccgcgccgatcgagaagaccatctctaaggccaaaggacagcctcgcgaaccccaggtttacacacttcctccctccagagaggaaatgaccaagaaccaggtcagcctgacatgtctcgtgaaaggcttttatccttccgatattgctgtggagtgggagtctaatgggcaacccgaaaacaactacaagaccacgccgcctgtcctggacagcgacggatccttctttctttactctaaactgacagtggataagagccggtggcagcagggcaatgttttctcctgcagcgtgatgcacgaggccctccataaccactatacccaaaagtctctgtccctgagccccggcaaa

SEQ ID NO: 39218 - RNA, 648 nt, synthetic construct
  misc_feature 1..648: note = derived and/or modified sequence opt5 from Gedivumab_LightChain
  source 1..648: mol_type = other RNA
gagatcgtgctgacccagagccccgccacactctccgtctctcctggcgaaagagctacgctgagctgccgggcctcccaagttatttctcacaaccttgcgtggtaccagcagaagccggggcaggctccccgcctgctcatctatggagccagcaccagagcctccggcattcctgctcggttctctgggagcggatccggcacagactacaccctgacaatcaccagccttcaatctgaggattttgccgtgtattactgtcagcattattccaattggccccctcgcctgacattcgggggaggcaccaaagtggaaattaagagaacggtcgctgcccccagcgtgtttatcttccctccgtctgacgagcagctcaaatccggcaccgcgagcgttgtgtgcctgctgaacaatttttacccccgggaagccaaggtccagtggaaagtggataacgctctccaatctggaaattcccaggagagcgttacagagcaggactccaaggattctacctatagcctgtccagcacacttaccctgtctaaggccgactacgaaaaacacaaggtgtacgcttgtgaggtcacgcatcaggggctctccagccctgtgacaaaatctttcaaccgcggcgaatgc

SEQ ID NO: 39219 - RNA, 1329 nt, synthetic construct
  misc_feature 1..1329: note = derived and/or modified sequence opt5 from Gemetuzumab_HeavyChain
  source 1..1329: mol_type = other RNA
gaggtgcagctggtccaaagcggcgccgaagttaagaaacccgggtcctctgtgaaggtgagctgcaaggcttccggatacaccatcacagactctaacattcactgggtcagacaggcccctggccagagcctcgagtggatcgggtatatttacccgtataatggaggcacggattacaaccagaaattcaaaaatcgggcgaccctgacagtggacaaccccaccaatacagcttatatggaactttcctctctgcgcagcgaggataccgccttttactattgtgttaacgggaatccttggctcgcctactggggacaaggcacactggtgaccgtctccagcgcttctacgaagggcccctccgtgttccctcttgccccctgcagcagatctacctccgaaagcacagctgccctggggtgtctcgttaaggactactttcctgagccggtgaccgtctcttggaactccggagcgctgacaagcggcgtgcataccttccccgccgtgctgcagtcctctgggctctatagcctgtccagcgtcgttacggtgccttcttccagccttggaacaaaaacctacacatgcaatgtggatcacaagccctctaacaccaaagtcgacaagcgggtggagagcaaatatggccctccctgtccgccttgccccgctcctgaatttctcgggggaccctccgttttcctgtttccccctaagccgaaggataccctgatgatctctcgcacacccgaggtgacgtgtgtcgtggttgacgtgagccaggaagatcctgaggtccagttcaattggtacgtggacggcgtcgaggtgcataacgccaaaaccaagcccagagaggaacaatttaattccacatatcgggttgtgagcgtccttaccgtgctgcaccaggattggctcaacggcaaagaatacaagtgcaaagtttctaataaggggctgccttccagcattgagaaaacaatctctaaggctaagggacagccccgcgaacctcaggtgtataccctgccgccctcccaagaggagatgacgaaaaaccaggtcagcctcacatgtctggtgaagggcttctacccttccgacatcgccgtggaatgggagtctaacgggcagcccgaaaataactacaaaaccacccctcccgttcttgatagcgacggatcctttttcctgtattctagactcacagtcgacaagagccggtggcaagagggcaatgtgttttcctgcagcgtgatgcatgaagcgctgcacaaccactacacccagaaatctctttccctgagcctcgggaag

SEQ ID NO: 39220 - RNA, 654 nt, synthetic construct
  misc_feature 1..654: note = derived and/or modified sequence opt5 from Gemetuzumab_LightChain
  source 1..654: mol_type = other RNA
gacatccagctgacccaaagcccctccacactctctgccagcgtgggcgatagagtcacgattacctgccgggcttccgagtctctggacaactacgggatccgcttccttacatggtttcagcagaagcctggaaaagccccgaagctgctcatgtatgcggctagcaatcagggctccggggttccctctagattcagcggatccggcagcgggaccgaatttacactgaccatttcttcccttcaacctgatgacttcgccacatactattgtcagcagaccaaagaggtgccctggagctttggacagggcacgaaggtggaagtcaaacggaccgtggccgctccttctgttttcatctttcccccttccgatgagcaactcaagagcggcacagcctctgtggtctgcctgctgaacaatttctacccgcgcgaagctaaggtgcagtggaaagttgacaacgccctgcagtccgggaatagccaggagtccgtgaccgagcaagattctaaggacagcacatattccctcagctctaccctgacgctttccaaagcggattacgaaaagcacaaagtctatgcctgtgaggtgacacatcagggactgagctctcccgtgaccaagagctttaacagaggcgaatgc

SEQ ID NO: 39221 - RNA, 1365 nt, synthetic construct
  misc_feature 1..1365: note = derived and/or modified sequence opt5 from Gilvetmab_HeavyChain
  source 1..1365: mol_type = other RNA
gaggtgcagctggtccaaagcggcggggacctcgttaagcccggaggctccgtgagactgtcttgcgtggctagcgggttcaacatcaaaaatacctacatgcactgggtccggcaggctcctggaaagggccttcagtggattgggcgcatcgccccggcgaacgtggatacaaaatatgctcccaagtttcagggaaaagccacgatttccgccgacaccgctaagaatacagcctacatgcaactgaactctctcagagctgaagataccgccgtttattactgtgtgctgatctattacgactatgatggcgacattgatgtctggggccaggggacacttgtgaccgttagctccgcgtctacaaccgcccctagcgtgttccccctggctccttcctgcggaagcacgtctggctccaccgtcgccctcgcttgtctggtgagcgggtactttcccgagcctgtgacagtctcttggaactccggaagcctgacctctggcgttcatacattcccgtccgtgctccagagctccgggctgtactctcttagctccatggtgaccgtccccagctctcggtggccttccgaaacgtttacatgcaatgtggcccaccccgcgagcaagaccaaagttgacaagcctgtgcccaaacgcgagaatggaagagtcccgcggcctcccgattgtcctaagtgccccgcccccgaaatgctgggcggcccttctgtgttcatctttccgcccaaacctaaggacacactcctgatcgctcgcacccccgaggttacctgtgtggtcgtggcccttgatcctgaggaccccgaagtccagattagctggttcgtggatgggaagcaaatgcagacagctaaaacgcagccgagagaggaacagtttgccggaacctatcgggttgtgtccgtcctgcctatcggccatcaagactggctcaaggggaaacagttcacatgcaaggtgaacaataaagccctgccctctcctattgagcgcaccatcagcaaggctagaggacaggcgcaccaaccctccgtttacgtgctgcctcccagccgggaggaactctctaaaaacacagtctccctgacctgtcttattaaggactttttcccgcctgatatcgacgtggagtggcagagcaatggccagcaggaacccgagtctaagtatcgcacgacaccccctcaactggatgaagacgggtcctactttctctatagcaaactgtccgtggataagtctagatggcagcggggagacaccttcatttgcgccgttatgcatgaggcccttcacaaccactacacccaggagagcctgtcccattctccgggcaaa

SEQ ID NO: 39222 - RNA, 654 nt, synthetic construct
  misc_feature 1..654: note = derived and/or modified sequence opt5 from Gilvetmab_LightChain
  source 1..654: mol_type = other RNA
gacatcgtgatgacccagacacccctgagcctctccgtctctctgggcgagcctgccagcatttcctgccacgcttctcaaaacatcaatgtttggcttagctggtacagacagaagccggggcagattccccagctgctcatctataaagcctcccatctgcacacgggagtgcctgatcggttctctggcagcgggtccggaaccgactttacacttcgcattagcagagtggaagcggatgacgctggcgtctactattgtcaacaggggcagtcttggcccctgaccttcggacagggcacaaaggtggagatcaaacggaacgatgcccaacctgccgtttacctctttcagccctcccctgaccagctgcataccggcagcgcttctgtggtctgcctgctcaattccttctatccgaaggatatcaacgtgaaatggaaggttgacggggtgattcaggatacaggaatccaagaaagcgtcaccgagcaggactctaaggattccacgtacagcctgtcctctacccttacaatgagctccaccgaatatctgagccacgagctctactcttgtgagattacacataaatccctgcccagcacccttatcaagtcttttcagcgcagcgaatgccaaagagtggac

SEQ ID NO: 39223 - RNA, 1344 nt, synthetic construct; identical to SEQ ID NO: 38506
  misc_feature 1..1344: note = derived and/or modified sequence opt5 from Ifabotuzumab_HeavyChain
  source 1..1344: mol_type = other RNA

SEQ ID NO: 39224 - RNA, 642 nt, synthetic construct; identical to SEQ ID NO: 38507
  misc_feature 1..642: note = derived and/or modified sequence opt5 from Ifabotuzumab_LightChain
  source 1..642: mol_type = other RNA

SEQ ID NO: 39225 - RNA, 1323 nt, synthetic construct
  misc_feature 1..1323: note = derived and/or modified sequence opt5 from Iratumumab_HeavyChain
  source 1..1323: mol_type = other RNA
caggtgcaactgcagcagtggggcgccgggctcctgaagcccagcgagaccctttccctgacatgcgctgtctacggaggctctttcagcgcctattactggtcctggatcagacagcctccggggaaaggactcgaatggattggcgacatcaaccacgggggaggcacgaattataacccctctctgaagtctcgggttaccatttccgtggatacatctaaaaatcaatttagccttaagctgaactccgtgaccgcggctgacacagccgtctactattgtgccagcctcaccgcttactggggccaggggtctctggtgacagtttccagcgcctctaccaaaggaccttccgtgttccccctggctcctagctctaagtccacgagcggcgggaccgccgcgctcggatgcctggtcaaggattattttcccgagcctgtgacagtttcctggaactctggcgcccttaccagcggggtgcatacattcccggctgtcctgcagtccagcggactctactctctgtccagcgtggtgaccgtcccctctagctcccttggcacgcagacatacatctgtaatgttaatcacaaaccttctaacaccaaggtggacaaaaaggtggaacccaaaagctgcgataagacacatacctgtcctccctgcccggcccctgagctgctcggcgggccctccgtctttctgttccctcccaagcccaaagacaccctgatgattagccgcacacctgaagtgacgtgtgttgtggtcgatgtgtctcacgaggacccggaggttaagtttaattggtatgtggatggagtcgaagtgcataacgctaaaaccaagcccagagaggaacaatacaattccacatatcgggtcgtgagcgttctcaccgtgctgcaccaggactggcttaacggcaaagagtacaagtgcaaagtctctaataaggccctgcctgcgcccatcgagaagacaatctccaaagccaaggggcagcctcgcgaaccccaggtgtataccctcccgcctagcagagatgagctgacgaaaaaccaagtttcccttacatgtctggtgaagggattctacccctctgacattgctgtcgaatgggagagcaatggccagcctgaaaacaactataaaaccacaccccctgtgctcgattccgacgggagctttttcctgtacagcaagctgaccgtggacaagtcccggtggcagcaaggaaatgtttttagctgctctgtcatgcacgaggccctccataaccacacccagaaatccctgagcctttctcccggcaag

SEQ ID NO: 39226 - RNA, 642 nt, synthetic construct
  misc_feature 1..642: note = derived and/or modified sequence opt5 from Iratumumab_LightChain
  source 1..642: mol_type = other RNA
gacatccagatgacccaaagccccacatccctgtctgccagcgtgggcgatagagtcacgattacctgccgggcttcccaggggatctctagctggctcacatggtaccagcagaagcctgagaaagccccgaagtccctgatttatgcggcttctagccttcaatccggagttcccagccgcttctctggctccgggagcggaaccgactttacactgaccatctcttccctccagcctgaagatttcgccacatactattgtcagcagtacgacagctatcccattacctttggccaagggacgagactggagatcaaacggaccgtggccgctccttctgtgttcatctttcccccttccgatgaacagcttaagagcggaacagcctccgtcgtgtgcctgctcaacaatttctacccgcgcgaggctaaagttcagtggaaggtggacaacgccctgcagtctggcaatagccaagaatccgtcaccgagcaggatagcaaggactctacatattccctgagctctaccctcacgctgagcaaagcggattacgagaagcacaaagtgtacgcctgtgaagttacacatcagggcctttcctctcccgtgaccaagagctttaacagaggggagtgc

SEQ ID NO: 39227 - RNA, 1344 nt, synthetic construct
  misc_feature 1..1344: note = derived and/or modified sequence opt5 from Lacnotuzumab_HeavyChain
  source 1..1344: mol_type = other RNA
caggtgcagctgcaggagagcggccccgggctcgtcaagccttcccagaccctgtctcttacatgcacggttagcgactactccatcacctctgattatgcctggaactggattagacagttcccgggaaaaggcctggaatggatggggtacatcagctattccggatctacaagctacaatccctccctcaagagccggattaccatctctcgcgacacatccaaaaaccaatttagcctgcagcttaattctgtgaccgctgccgatacagcggtgtattactgtgcttccttcgactatgcccacgccatggattactggggccaggggaccacggtcaccgtgagctctgcttccacaaagggacctagcgtttttcccctggccccttcctctaaaagcacctccggcggcacagctgccctcgggtgcctggtgaaggactacttccccgagcctgtcaccgtgagctggaactctggagcgctgacgtccggcgttcatacatttccggccgtgctccagagctctgggctgtatagcctttcctctgtcgtgaccgtgcccagctccagcctgggaacacaaacctacatttgtaatgtcaaccacaagccttctaataccaaagttgataagagagtggaacccaaatcctgcgacaagacacatacgtgtcctccctgcccggctcctgagctcctgggcgggcccagcgtgttcctttttcctcccaaacccaaggataccctgatgatctctcggacacctgaagtcacctgtgtggttgtggacgtctcccacgaggatccggaggtgaagttcaactggtatgttgacggagtggaagtccataatgccaaaacaaagccccgcgaggaacagtacaacagcacctatagagtggtctccgtgctcacggttctgcaccaggattggctgaatggcaaagagtacaagtgcaaagtgtctaacaaggctctccctgcccccatcgagaaaacaattagcaaggcgaagggccagcctcgggaaccccaagtctataccctgccgccttcccgcgaggaaatgaccaaaaatcaggtgtctcttacatgtctggttaaggggttttaccccagcgacatcgccgtggagtgggaatccaacggacagcctgagaataactacaaaaccacaccccctgtcctcgacagcgatggctctttctttctgtattccaaacttacggtggacaagagcagatggcaacaggggaacgtgttctcttgctccgttatgcacgaggctctgcataatcactacacccaaaagagcctctctctgagccccggaaag

SEQ ID NO: 39228 - RNA, 642 nt, synthetic construct
  misc_feature 1..642: note = derived and/or modified sequence opt5 from Lacnotuzumab_LightChain
  source 1..642: mol_type = other RNA
gacatcgtgctgacccagagccccgccttcctctccgtcacacctggcgagaaggttacgtttacctgccaagctagccagagcattgggacatccatccactggtaccagcagaaaaccgatcaagccccgaagctgcttattaaatatgcgtctgaaagcatctccggcattccctctagattcagcggatccgggagcggaacagactttaccctgacaatctcttccgtggaggctgaagatgccgccgactactattgtcagcagatcaacagctggcctaccacgttcggcgggggaaccaagctcgagattaaacggacagtggctgccccctctgtctttatcttccctccctccgatgaacagctgaagtctggcaccgcttctgtggtttgccttctgaataacttttaccctcgcgaggccaaggtgcaatggaaagtcgacaatgcgctccagtccggcaacagccaggagtccgtgacagaacaggattctaaggacagcacctattccctgagctctacgctgacactctccaaagccgattacgagaagcataaagtttatgcttgtgaagtgacccaccaagggctgagctctccggtcacaaagagcttcaatagaggagagtgc

SEQ ID NO: 39229 - RNA, 1347 nt, synthetic construct
  misc_feature 1..1347: note = derived and/or modified sequence opt5 from Larcaviximab_HeavyChain
  source 1..1347: mol_type = other RNA
gaggtgcagctgcaagaaagcggccccgagctcgaaatgcctggggcctccgtcaagatctcttgcaaagctagcggatcctctttcaccggctttagcatgaactgggttaagcagtccaatgggaaatctctggagtggattggaaacatcgacacatactatggcgggacgacctacaatcagaagttcaaaggaaaggccacacttaccgtggataagagctccagcacagcgtatatgcagctgaaatctctcacctccgaagacagcgctgtgtactattgtgccagatctgcctactatggctccacatttgcttactggggccaagggaccctggtcacggtgagcgccgcttctaccaagggaccgtccgttttcccccttgcccctagctccaaatctacaagcggcgggaccgcggccctgggatgcctcgtgaaggattactttcccgagcctgtcacagtgtcctggaacagcggcgctctgacctctggggttcacacgttccccgccgtgctgcagtccagcggactctattctctgagctccgtcgtgacagtgccttctagctcccttggcacccagacatacatttgtaatgtcaaccataaaccgagcaataccaaggttgacaagcgggtggagcccaaatcttgcgataagacccacacatgtcctccctgccctgctcccgaactgctcggcgggccgtccgtgtttctgttccctcccaaacctaaggacacgcttatgatcagccgcacccccgaggtcacatgtgtggttgtggatgtctctcatgaagaccccgaggtgaaatttaactggtatgttgatggagtggaggtccacaatgccaagaccaaacctagagaggaacagtacaactccacatatcgggtggtcagcgtgctgaccgttctccatcaagactggctgaatggcaaggaatacaagtgcaaagtgtccaacaaggcgctgccggcccccattgagaaaacgatctctaaggctaaagggcagcctcgcgaaccccaggtctatacactccctcccagcagagatgagctgaccaagaatcaggtgtcccttacctgtctggttaagggattctacccgtctgacatcgccgtggagtgggaaagcaacggccaacctgagaataactacaaaacaacaccccctgtcctcgattccgacgggagctttttcctgtattctaaacttaccgtggacaagtcccggtggcagcagggaaacgtgtttagctgctctgttatgcacgaagctctgcacaatcattacacgcaaaagtccctcagcctgtctcccggcaaa

SEQ ID NO: 39230 - RNA, 642 nt, synthetic construct
  misc_feature 1..642: note = derived and/or modified sequence opt5 from Larcaviximab_LightChain
  source 1..642: mol_type = other RNA
gacatccagatgacccaaagccccgccagcctgtctgctagcgtgggcgagacagtcacgattacctgcagagcctccgaaaacatctactcttatctcgcgtggtaccagcagaagcaggggaaaagccctcaactgcttgtttataatgctaagacactgattgagggagtgccgtcccggttctctggcagcgggtccggaacccagtttagcctcaaaatcaactctctgcagcccgaagatttcggctcctacttttgtcagcaccatttcgggacaccttttaccttcggaagcggcacagagcttgaaattaagcgcaccgtggccgccccctctgtctttatcttccctccctccgacgagcaactgaaaagcggcacggcttctgtggtttgcctcctgaataacttttatcctagagaggccaaggtgcagtggaaggtcgataatgctctgcagtccgggaacagccaggaatccgtgaccgagcaagactctaaagatagcacatactccctcagctctaccctgacactttccaaggccgactatgaaaaacacaaggtttacgcgtgtgaggtgacccatcagggactgagctctccggtcacgaaatccttcaatcggggcgagtgc

SEQ ID NO: 39231 - RNA, 1338 nt, synthetic construct
  misc_feature 1..1338: note = derived and/or modified sequence opt5 from Lendalizumab_HeavyChain
  source 1..1338: mol_type = other RNA
caggtgcagctggtccagagcggcgccgaggttaagaaacccggggcttccgtgaaggtgtcttgcaaagccagcggatacaccttcacagactattccatggattgggtcagacaggcgcctggccaggggctcgaatggatgggagctatccacctgaacacgggctacaccaattataaccaaaagtttaaagggcgggtgacaatgacccgcgacacatctaccagcacagtttacatggagctttcctctctgagaagcgaagataccgccgtgtattactgtgcccggggattctatgacggctactccccgatggattactggggccaggggacgaccgtcacagtgagctctgcttccaccaagggacccagcgtttttcctctcgccccctgctctcgctccacaagcgagtctaccgctgccctgggctgtcttgtgaaggactatttccctgaacccgtcacggtgtcctggaatagcggggcgctgacatccggagtgcatacctttcctgccgtcctccagtctagcggcctgtactccctgagctctgttgtgacagtgccgtccagcaacttcgggacccagacctatacatgcaatgtcgatcacaaaccctctaacacgaaggtggacaaaaccgttgagagaaagtgttgcgtggagtgtcctccctgccctgctcccccggtcgccggacctagcgtgtttctctttccccctaaacccaaggatacactgatgatttcccggacccccgaagttacatgtgtggtcgtggacgtctctcaagaggatcctgaagtgcagttcaattggtacgttgacggcgtggaggtccataacgctaagaccaaaccgcgcgaggaacagttcaatagcacgtatagagtggtttccgtgcttacagtcctgcaccaggattggctcaacggcaaggagtacaaatgcaaggtgagcaataaagggctgccctcttccatcgaaaagaccattagcaaagccaagggacaacctcgggagccccaggtgtatacccttcctccctctcaggaagagatgacaaagaaccaagtttccctgacctgtctcgtcaaaggcttttacccgagcgacatcgcggtggagtgggaatccaatgggcagcctgagaacaattacaagacaacgccccctgtgctggactctgatggcagcttctttctgtattcccgcctcaccgtcgacaaatctagatggcaggaaggaaacgtgttcagctgctccgttatgcatgaggccctgcacaaccactacacacaaaagagcctttctctgtccctcgggaaa

SEQ ID NO: 39232 - RNA, 654 nt, synthetic construct
  misc_feature 1..654: note = derived and/or modified sequence opt5 from Lendalizumab_LightChain
  source 1..654: mol_type = other RNA
gacatccagatgacccaaagccccagctctctgagcgcctccgtgggcgatagagtcacaattacgtgccgggcttctgagagcgttgactcctacgggaactctttcatgcactggtatcagcagaagcctggaaaagccccgaagctcctgatctaccgcgcgagcaatcttgaatccggcgtgcccagcagattttctgggtccggaagcggcaccgatttcacactgaccatttcttccctccagcctgaggactttgctacatattactgtcaacagagcaacgaagatccctataccttcgggggaggcacaaaagtggagatcaagcggaccgtcgccgccccttctgtgtttatttttcccccttccgacgaacagctgaaaagcggcacggcttccgttgtgtgccttctgaataacttctacccgcgcgaggccaaggtccagtggaaggtggataatgctctccaatctgggaacagccaggagtccgttaccgaacaggacagcaaagattctacatattccctgagctctaccctgacactcagcaaggccgactacgagaaacataaggtgtacgcgtgtgaagtcacccaccagggactgtcctctcccgtgacgaaatccttcaatagaggcgagtgc

SEQ ID NO: 39233 - RNA, 1359 nt, synthetic construct
  misc_feature 1..1359: note = derived and/or modified sequence opt5 from Lesofavumab_HeavyChain
  source 1..1359: mol_type = other RNA
gaggtgcagctggtccaaagcggcgccgaagttaagaaacccggggagtccctcaagatctcttgcaaagtgagcggatactccttcacctctcagtggattggctgggtgagacagatgcctgggaagggactggaatggatcggcatgatgtatccgggggagagcgaaacaatttactccccctcttttcagggacaagtcacgatcagcgctgacaactccattagcaccgcctatcttcagtggtcttccctgaaagcgagcgatacagctatctactattgtgcctctggccctggctactccgggtatcactacggatggttcgacacctggggccaggggacactcgtgaccgttagctctgcctccacaaagggacccagcgtgtttcctctggctccctcctctaagagcacctccggcgggacggccgctcttggatgcctggtcaaagattacttccctgagccggtgaccgttagctggaatagcggcgccctcacatccggcgtgcatacctttcccgcggtcctgcagagctctgggctgtatagcctctcctctgtggtgacagtccctagctccagcctgggaacccaaacgtacatctgtaacgttaatcacaagccctctaacacaaaagtggacaagaaagtggagcctaagtcctgcgataagacccatacatgtcccccgtgccctgcccccgaacttctgggcgggcctagcgtcttcctctttcctcccaaacccaaggacaccctgatgatttctcggaccccggaggtgacatgtgttgtggtcgatgtgtcccacgaagaccccgaggttaaattcaattggtatgtggatggagtcgaggtgcataacgctaagacgaaacctcgcgaggaacagtacaatagcacctatagagtcgtgtccgttcttacagtgctgcaccaggactggctcaacggcaaggaatacaaatgcaaggtctctaataaggccctgcccgctcctatcgagaaaaccattagcaaggccaaagggcagccccgggaaccgcaagtgtatacactgcctccctcccgcgaggagatgaccaagaaccaggtttctctcacgtgtctggtgaaaggattttaccctagcgatatcgcggtcgaatgggagtccaatggccagcccgaaaacaattacaagacaacccctcccgtgcttgacagcgatggctctttctttctgtattccaagctcaccgtggacaaaagcagatggcaacaggggaacgttttctcttgctccgtcatgcacgaggccctgcataatcactacacacagaagtctctttctctgagcccgggaaaa

SEQ ID NO: 39234 - RNA, 657 nt, synthetic construct
  misc_feature 1..657: note = derived and/or modified sequence opt5 from Lesofavumab_LightChain
  source 1..657: mol_type = other RNA
gacatcgtgatgacccagagccccctgtccctccctgtcacaccgggcgagcccgcctctattagctgccggtcctctcaaagcctgcttcggtccaacgggtacaattatctggattggtacctccagaagcctggacagtctccccagctgcttatctatctgggcagcaaccgcgcttccggggttcctgacagattcagcggatctggctccgggacggattttaccctcaaaattagccgggtggaagccgaggacgtgggagtctactattgtatgcaagcgctgcagacaccctacaccttcggccagggcacaaagctggaaatcaaacgcaccgtggctgccccttctgtttttattttcccgccctccgatgagcagctcaagagcgggacagcctctgtggtctgcctgcttaataacttttatcctagagaagctaaagtgcaatggaaggttgacaatgccctgcagtccggaaacagccaggagtccgtgaccgagcaggattctaaggacagcacgtactccctcagctctaccctgacactttccaaagctgattacgaaaagcacaaagtctatgcctgtgaggtgacccatcaaggcctgagctctcccgtgacaaagagcttcaatagaggggaatgc

SEQ ID NO: 39235 - RNA, 1059 nt, synthetic construct
  misc_feature 1..1059: note = derived and/or modified sequence opt5 from Letolizumab_HeavyChain
  source 1..1059: mol_type = other RNA
gaggtgcagctgctcgaaagcggcgggggactggtccaacccggcgggtcccttagactgtcttgcgccgctagcggattcacctttaactgggagctcatgggctgggcccggcaggcgcctgggaagggactggaatgggtttccggcatcgagggcccgggggacgtgacatactatgctgattctgtgaaaggacgcttcacgattagcagagacaattccaagaacaccctttacctgcagatgaactctctccgggccgaagatacagccgtctattactgtgtgaaagttggcaaggacgctaaaagcgattatcgcgggcagggaaccctggtgacagtctccagcgcctctaccgagcccaagtccagcgacaagacacacacctctcctccctcccctgctcccgagctgctcggcgggagctctgtgtttctgttccctccgaaacccaaggatacgcttatgatctccagaacccctgaagttacatgcgtggtcgtggacgtgagccatgaggatcccgaagtcaaatttaattggtacgttgacggagtggaggtgcacaatgccaagaccaaacctcgggaggaacaatataactccacataccgcgtcgtgtctgttctgaccgtgctccatcaggattggctgaatggcaaggagtacaagtgtaaagtcagcaacaaggcgcttcccgccccgattgaaaagacgatctccaaggctaaaggccagcctagagagccccaggtgtatacactgcctcccagccgggacgaactcaccaagaatcaagtttctctgacatgcctggtgaaagggttctacccctccgatattgccgtcgagtgggagagcaacggacagcctgaaaataactataagaccaccccgcccgtgctcgactctgacggcagctttttcctgtactccaaacttacagtcgataaatctcgctggcagcaggggaatgtgtttagctgttccgttatgcacgaggctctgcataaccactatacgcaaaagagcctctctctgtcccctggaaaa

SEQ ID NO: 39236 - RNA, 1338 nt, synthetic construct
  misc_feature 1..1338: note = derived and/or modified sequence opt5 from Losatuxizumab_HeavyChain
  source 1..1338: mol_type = other RNA
gaggtgcagctgcaagaaagcggccccgggctcgtcaagccttcccagaccctgtctcttacatgcacggttagcggatactccatctctagagacttcgcctggaactggattcggcagccgcccggcaaagggctggagtggatgggatatatcagctacaatggcaacacccgctatcagccttccctcaagtctagaattacaatcagccgggatacctccaaaaatcaatttttcctgaaacttaacagcgtgacagctgccgacaccgcgacatactattgtgtgaccgcttctcgcgggtttccctactggggacagggcacgctggtcaccgtgtccagcgcctctacaaagggcccttccgttttccccctcgcccctagctctaagtccaccagcgggggaacagctgccctgggctgcctggtgaaggattattttccggaacccgtcaccgtgtcctggaactctggggctctcacgagcggagttcacacattccctgccgtgctgcagtccagcggcctttactctctgtccagcgtcgtgaccgtgccctctagctccctcgggacacagacctacatttgtaatgtcaatcataaaccttctaacaccaaggttgacaaaaaggtggagcccaaaagctgcgataagacacacacgtgtccgccttgccccgcgcctgaactgcttggaggcccctccgtgtttctgtttccccctaagccgaaagacaccctcatgatcagcagaacacccgaggtcacctgtgtggttgtggatgtctctcatgaggaccctgaagtgaagtttaattggtatgttgatggcgtggaggtccacaacgccaaaacaaagccccgggaggaacaatacaattccacctatcgcgtggtcagcgtgctgacggttctgcatcaggactggctcaacgggaaagagtacaagtgcaaagtgtctaataaggctctgcctgcccccatcgaaaagacaatttccaaagctaagggacagccgagagagcctcaggtctatacccttccccctagccgggaagagatgaccaaaaaccaagtgtccctgacatgtctcgttaagggcttctacccctctgatatcgccgtggaatgggagagcaatgggcagcctgagaacaactataaaaccacacccccggtcctggactccgatggatctttcttcctttacagcaagctgacggtggacaagtcccgctggcagcaaggcaatgtgtttagctgctctgttatgcacgaagcgctccacaaccattacacccagaaatccctgagcctgtctcctgggaag

SEQ ID NO: 39237 - RNA, 642 nt, synthetic construct; identical to SEQ ID NO: 38415
  misc_feature 1..642: note = derived and/or modified sequence opt5 from Losatuxizumab_LightChain
  source 1..642: mol_type = other RNA

SEQ ID NO: 39238 - RNA, 1338 nt, synthetic construct
  misc_feature 1..1338: note = derived and/or modified sequence opt5 from Lupartumab_HeavyChain
  source 1..1338: mol_type = other RNA
gaggtgcagctgctcgaaagcggcgggggactggtccaacccggcgggtcccttagactgtcttgcgccgctagcggattcaccttttccaacgcctggatgtcttgggttcggcaggcgcctggcaaggggctcgagtgggtgagctacatctcctctagcggatccacaatttattacgctgacagcgtgaaaggccgcttcacgatctctagagataattccaagaacaccctgtatcttcagatgaatagcctgcgggccgaagacacagccgtctactattgtgctcgcgagggcctctgggcctttgattactgggggcagggaaccctggtgacagtttcttccgctagcaccaaaggcccgtctgtgttccccctggccccttccagcaagtccacatctgggggaaccgcggccctcggctgcctggtcaaagactattttcccgaacctgtgacggttagctggaactccggggctcttaccagcggagtgcacacattccccgccgtcctgcaatcttccggcctctacagcctgtctagcgtggtgaccgtcccttcctctagccttggcacacagacctacatttgtaatgttaaccataagccgtccaatacgaaggtggataaaaaggtggagcccaaaagctgcgacaagacacacacctgtcctccctgccctgctcccgagctgctcgggggaccgtctgtctttctgttccctcccaaacctaaggatacactgatgatctccagaacccccgaagtgacctgtgttgtggtcgacgtgagccatgaggatcccgaagttaagtttaactggtatgtggacggcgtcgaggtgcacaatgccaaaacaaagcctcgggaggaacagtacaactctacgtatcgcgtcgtgtccgttctcaccgtgctgcatcaggattggcttaatgggaaagagtacaagtgcaaagtcagcaacaaggcgctgccggcccccattgagaaaacaatctccaaggctaagggacaacctagagaaccccaggtgtataccctccctccctctcgggacgaactgaccaaaaatcaggttagccttacatgtctggtgaagggcttctacccgtccgatatcgccgtcgagtgggagtctaacgggcagcctgaaaataactataaaacgacaccccctgtgctcgacagcgacggatcctttttcctgtacagcaagctgaccgtggataaatctcgctggcaacagggcaacgtcttttcctgcagcgttatgcacgaggctctccacaatcattacacccagaagtctctgtcccttagccccggc

SEQ ID NO: 39239 - RNA, 651 nt, synthetic construct
  misc_feature 1..651: note = derived and/or modified sequence opt5 from Lupartumab_LightChain
  source 1..651: mol_type = other RNA
gagagcgtgctgacccagcccccttccgtctctggcgccccggggcaaagagttacaatcagctgcacgggatcctctagcaacattggcgctgggtacgtggtgcactggtatcagcagctccccggaaccgcccctaagctgcttatctacgacaataacaaacggccctccggcgtccctgatcgcttctctgggagcaagtccggaacaagcgcgtctctggctatttccggcctcagaagcgaagacgaggccgattattactgtgccgcttgggacgatcggctgaatggccccgtgtttgggggaggcaccaaacttacagttctggggcagcctaaggccgctccgtctgtgaccctctttcccccttccagcgaggaactgcaagccaacaaagcgacactggtctgcctcatctctgacttctatcccggagccgtgaccgttgcttggaaggccgattccagccctgtgaaggctggcgtcgaaacgaccacaccctccaaacagtctaataacaagtacgccgcgagctcctatctgagccttaccccggagcagtggaaatctcatcgctcctacagctgtcaggtgacacacgaggggtctaccgtggaaaagacggtcgcccctacagagtgcagc

SEQ ID NO: 39240 - RNA, 1731 nt, synthetic construct
  misc_feature 1..1731: note = derived and/or modified sequence opt5 from Lutikizumab_HeavyChain
  source 1..1731: mol_type = other RNA
gaggtgcagctggtcgaaagcggcgggggagttgtgcaacccggcagatccctccggctgtcttgcagcgcctccgggttcatcttttctcgctacgacatgagctgggtgagacaggctcctggaaagggccttgagtgggtcgcctatatttcccacgggggagcgggcacctactatccggattctgtgaaaggccggttcacaatcagccgcgacaactccaagaatacgctgtttctccagatggatagcctgagacccgaagacaccggggtttacttctgtgctcggggaggcgtgacaaaagggtattttgatgtctggggacagggcacccctgtgacagtttcttccgccagcaccaaggggccccaagtgcagcttgtcgagtctggaggcggcgtggtgcagcctgggcgctccctgagactcagctgcacagcctctggattcaccttttccatgttcggcgtccattgggttcggcaggctcccgggaaaggactggaatgggtggccgctgtgagctacgacggctccaacaagtattacgccgagtctgtcaaggggcgctttacgattagcagagataattccaaaaacatcctgttcctccaaatggacagcctgcggcttgaggataccgcggtgtactattgtgcccgcggaagacctaaggttgtgattccggctcccctggcccactggggccagggcacactcgtcaccttttcttccgctagcacaaaagggccttctgtgttccccctggcccctagctccaagtctaccagcggaggcacggcggcccttgggtgcctggttaaagactactttcccgaaccggtgacagtctcctggaatagcggagctctcacctctggcgtgcatacattccctgccgtcctgcagtccagcgggctgtattctctctccagcgtggttaccgtgccctcctctagcctgggcacccagacatacatctgtaacgtcaatcacaagccttccaacacgaaggtggataaaaaggttgagcccaaatcttgcgacaagacccatacatgtcccccttgcccggctcccgaagccgccggaggccctagcgtgttcctttttccccctaaacccaaggataccctgatgatctcccggacaccggaggtcacctgtgtggtggttgacgtcagccacgaggaccctgaagtgaaattcaattggtatgtggatggggtcgaggtgcacaacgctaagacgaagccccgcgaggaacaatacaattctacatatagagttgtgtccgtcctcaccgtgctgcatcaggactggcttaacggaaaagaatacaagtgcaaagttagcaataaggcgctgcctgcccccattgagaaaaccatctctaaggctaagggccagcctcgggagccccaagtgtacacactcccgccttccagagaagagatgaccaaaaaccaggtcagcctgacatgtctggtgaaggggttttatccctctgatattgccgttgaatgggagagcaatggacagcccgaaaacaactacaaaacgacccctccggtgctcgactccgatggcagcttctttctgtattctaaacttacagtcgacaagtcccgctggcagcaagggaatgtgttcagctgctccgtgatgcacgaggccctgcataaccactacacccagaagtctctcagcctgtcccccggcaag

SEQ ID NO: 39241 - RNA, 981 nt, synthetic construct
  misc_feature 1..981: note = derived and/or modified sequence opt5 from Lutikizumab_LightChain
  source 1..981: mol_type = other RNA
gacatccagatgacccaaagcccctcctctctgagcgcctccgtgggcgatagagtcacaattacgtgccgggcttctgggaacatccacaattacctcacctggtatcagcagacacctggaaaggccccgaaactgcttatttacaacgcgaagaccctggctgacggcgttcccagccgcttctccgggtctggaagcggcacagattatacctttacaatctccagcctccagcctgaggacattgccacctactattgtcaacatttctggtctatcccctacacgtttgggcagggaaccaaactgcagatcacaagaaccgtggccgctcctgatattcagatgacacaatcccccagctctgtgtccgccagcgtcggcgaccgggtgaccatcacgtgccgcgcttctcagggcatttccagctggcttgcctggtatcagcagaagcctgggaaagcgccgaagctgctcatctacgaagcctccaatctggagacaggagttccctctagattcagcggctccgggagcggatctgattttaccctgacaatttccagcctccaacctgaagacttcgctacctactattgtcagcagacctctagctttctgctttccttcggcgggggaacaaaggtggagcacaaacggacggtcgccgctccctctgtgtttatcttccctcccagcgatgaacaactgaagtccggcaccgccagcgttgtgtgcctcctgaacaatttttacccgcgcgaggcgaaagtccagtggaaggtggacaacgcccttcagtctggcaattcccaggagagcgtgacagaacaagattctaaagactccacctatagcctgtcctctacactcaccctgagcaaggctgattacgagaagcataaagtctatgcctgtgaagttacgcaccaggggctgtcctctcctgtgacaaagagcttcaacagaggagagtgc

SEQ ID NO: 39242 - RNA, 1341 nt, synthetic construct
  misc_feature 1..1341: note = derived and/or modified sequence opt5 from Oleclumab_HeavyChain
  source 1..1341: mol_type = other RNA
gaggtgcagctgctcgaaagcggcgggggactggtccaacccggcgggtcccttagactgtcttgcgccgctagcggattcaccttttcctcttacgcctatagctgggttcggcaggcgcctggcaaggggctcgagtgggtgtccgctatctctggaagcggcggccgcacatactatgccgactccgtgaaagggagattcacgattagccgggataactctaagaataccctgtaccttcagatgaactccctgcgcgccgaagacacagctgtctattactgtgccagactcggatatggccgggtggatgagtgggggcgcggaaccctggttacagtgagctctgcttccaccaaaggcccgagcgtctttcccctggccccttcttccaagagcacatccgggggaaccgcggccctcggctgcctggtgaaagactacttccccgaacctgttacggtgtcttggaatagcggcgctcttacctccggggtccacacatttcccgccgtgctgcagagctctggactctactccctgagctctgtggtcaccgttcctagctcctctcttggcacacaaacctatatctgtaacgtgaatcataagccgagcaacacgaaggtggataaaagagtcgagcccaagtcctgcgacaaaacacacacctgtcctccctgccctgctcccgagttcgaagggggaccgagcgtgtttctgttccctcccaagcctaaagatacactcatgatttctcggacccccgaggttacctgtgtggtcgtggacgtttcccatgaagatcccgaggtgaagtttaattggtacgtcgacggcgtggaggtccacaacgccaagacaaaacctcgcgaggaacagtataatagcacgtacagagtggtttctgtgctgaccgtcctgcatcaggattggctcaacgggaaggaatataaatgcaaggtgtccaataaagcgctgccggccagcatcgagaagacaatttccaaagctaagggacagccccgggaacctcaagtttacacccttcccccttctcgcgaggagatgacaaagaaccaggtgagcctgacctgtctcgtcaaaggcttctatccctccgacatcgccgtggaatgggagtctaatggccagccggaaaacaattacaagacgacacctcccgtgctggatagcgacgggtcctttttcctttacagcaaactgaccgttgacaagtctagatggcagcaaggaaacgtcttttcctgcagcgtgatgcacgaggctctccacaaccattatacccagaaatctctgtccctgagccctggcaag

SEQ ID NO: 39243 - RNA, 648 nt, synthetic construct
  misc_feature 1..648: note = derived and/or modified sequence opt5 from Oleclumab_LightChain
  source 1..648: mol_type = other RNA
cagagcgtgctgacccaacccccttccgcctctggcacaccggggcagagagtcacgatcagctgctccggatctctcagcaacattggccggaatcccgttaactggtaccagcagctgcctgggaccgctcccaaacttctgatctatctcgacaatctgcgcctttccggagtgcctgatagattctctggcagcaagtccgggacaagcgcctctctggcgatttccggactccaaagcgaggacgaagctgattactattgtgccacctgggacgattctcaccccggctggacatttggcgggggaaccaagctgacagtgctgggccagcctaaagccgctccgtccgtcaccctctttccccctagctctgaggaactgcaggccaacaaggctacgcttgtgtgcctgatctccgacttctaccccggggccgttaccgtggcgtggaaagccgatagctcccctgtcaaggctggagtggagacaaccacaccctctaagcagagcaataacaaatatgccgcttccagctacctctctctgaccccggaacaatggaagtcccatcggagctattcttgtcaggttacgcacgagggcagcacagtggagaaaaccgtcgcccctacagaatgctcc

SEQ ID NO: 39244 - RNA, 1449 nt, synthetic construct; identical to SEQ ID NO: 38859
  misc_feature 1..1449: note = derived and/or modified sequence opt5 from Otlertuzumab_HeavyChain
  source 1..1449: mol_type = other RNA

SEQ ID NO: 39245 - RNA, 339 nt, synthetic construct
  misc_feature 1..339: note = derived and/or modified sequence opt5 from Ozoralizumab_HeavyChain
  source 1..339: mol_type = other RNA
gaggtgcagctggtcgaaagcggcgggggactcgttcaacccggcgggtccctgagactttcttgcgccgctagcggattcaccttttccgactactggatgtattgggtgcggcaggcccctggcaaggggctggagtgggtgtctgaaatcaacacaaatggactcattacgaaatacccggatagcgtcaagggccgcttcaccatctccagagacaacgcgaaaaatacactgtatcttcagatgaactctctgcggcccgaggataccgctgtgtactattgtgcccgcagcccttccggctttaatagagggcagggaacactcgttaccgtg

SEQ ID NO: 39246 - RNA, 1089 nt, synthetic construct; identical to SEQ ID NO: 38864
  misc_feature 1..1089: note = derived and/or modified sequence opt5 from Ozoralizumab_HeavyChain_HeavyChain_HeavyChain
  source 1..1089: mol_type = other RNA

SEQ ID NO: 39247 - RNA, 1494 nt, synthetic construct
  misc_feature 1..1494: note = derived and/or modified sequence opt5 from Pasotuxizumab_HeavyChain_LightChain_HeavyChain_LightChain
  source 1..1494: mol_type = other RNA
caggtgcaactggtcgagagcggcgggggactcgttaagcccggcgaatccctgagactttcttgcgccgctagcgggttcaccttttccgactactatatgtactgggtgcggcaggcccctggaaaaggcctggagtgggtggcgatcatttctgatgggggatattacacatattacagcgacatcattaagggccgcttcacgatctccagagataacgctaaaaattctctctatctgcagatgaacagccttaaggccgaagacaccgccgtctactactgtgctcggggctttccgctgctccgccacggggccatggattattggggacagggcacactggtgaccgtttccagcgggggaggcgggtctggaggcggcgggtccggaggcgggggaagcgacattcaaatgacacagtctccctccagcctgtctgcttccgtgggcgatagagtcaccatcacatgcaaagccagccagaatgtggacaccaacgttgcgtggtaccagcaaaagcctgggcaggcccccaagtccctcatctattctgctagctaccggtattccgatgtgcctagccgcttctctggatccgccagcggcacggactttaccctgacaatttctagcgtccagtccgaggatttcgctacctactattgtcagcaatacgactcttacccctatacatttggcgggggaaccaaacttgaaatcaagagcggcgggggaggctccgaggtgcagctggtggagagcgggggcggactcgtccagcctggcgggtctctgaaactttcctgcgccgcgagcggattcacgtttaataagtacgccatgaactgggttagacaagctccgggcaaagggctggaatgggtggcccggattcgctctaagtataataactacgctacatattacgccgattccgtgaaggacagattcaccatcagccgggacgattccaaaaatacagcctatctccagatgaacaatctgaagaccgaggacaccgctgtctactactgtgtgcgccatggaaactttggcaattcttatattagctactgggcgtattgggggcagggcacactggttacggtgtcctctggaggcgggggaagcggcgggggaggctccgggggcggaggcagccagaccgtcgtgacacaagaaccctctctcaccgtttcccctgggggaacagtgaccctgacgtgcggcagctctacaggggccgtcacctccggaaactaccccaattgggtgcagcagaaacctggccaggctcccagagggcttatcggcggaaccaagttcctggccccgggcacccctgcccggtttagcgggtctctcctgggaggcaaagctgcccttacactgagcggggtccaacccgaggatgaggcggaatattactgtgtgctctggtattccaaccgctgggttttcggaggcggcacaaagctgacggtgctg

SEQ ID NO: 39248 - RNA, 357 nt, synthetic construct
  misc_feature 1..357: note = derived and/or modified sequence opt5 from Pasotuxizumab_HeavyChain1
  source 1..357: mol_type = other RNA
caggtgcaactggtcgagagcggcgggggactcgttaagcccggcgaatccctgagactttcttgcgccgctagcgggttcaccttttccgactactatatgtactgggtgcggcaggcccctggaaaaggcctggagtgggtggcgatcatttctgatgggggatattacacatattacagcgacatcattaagggccgcttcacgatctccagagataacgctaaaaattctctctatctgcagatgaacagccttaaggccgaagacaccgccgtctactactgtgctcggggctttccgctgctccgccacggggccatggattattggggacagggcacactggtgaccgtt

SEQ ID NO: 39249 - RNA, 369 nt, synthetic construct
  misc_feature 1..369: note = derived and/or modified sequence opt5 from Pasotuxizumab_HeavyChain2
  source 1..369: mol_type = other RNA
gaggtgcagctggtcgaaagcggcgggggactcgttcaacccggcgggtccctgaaactttcttgcgccgctagcggattcacctttaacaagtacgccatgaattgggtgagacaggcgcctggcaaggggctggagtgggtggctcggatccgctccaaatataacaattacgccacatattacgccgactctgtcaaggatagattcacgattagccgggacgattccaaaaacaccgcttatctccagatgaataacctgaagacagaagacaccgccgtgtactattgtgttcgccacggaaattttggcaactcttacatcagctactgggcttattggggccaggggacacttgtgaccgtc

SEQ ID NO: 39250 - RNA, 321 nt, synthetic construct
  misc_feature 1..321: note = derived and/or modified sequence opt5 from Pasotuxizumab_LightChain1
  source 1..321: mol_type = other RNA
gacatccagatgacccaaagcccctcctctctgagcgcctccgtgggcgatagagtcacaattacgtgcaaggcttctcagaacgttgacaccaatgtggcctggtaccagcagaaacctgggcaagcgcccaagagcctcatctattccgcttcttaccggtatagcgatgtgccgtcccgcttcagcggatctgcctccggcacagactttaccctgacaattagctctgtccagtccgaggatttcgccacctactattgtcagcagtacgacagctatccttacacatttgggggaggcaccaaacttgaaatcaag

SEQ ID NO: 39251 - RNA, 327 nt, synthetic construct
  misc_feature 1..327: note = derived and/or modified sequence opt5 from Pasotuxizumab_LightChain2
  source 1..327: mol_type = other RNA
cagaccgtggtcacacaagagcccagcctgacggtttcccctggcgggaccgtgacactgacctgcggatctagcacaggcgccgtgacctccgggaactacccgaattgggtccagcagaagcccggacaggctcctagaggcctcatcgggggaacaaaattccttgcccccggcacccctgcgcggttttctggcagcctgctcgggggaaaggctgccctgacgctttccggcgtgcaacccgaagacgaggccgaatattactgtgttctgtggtattctaaccgctgggtgttcgggggaggcaccaaactcacagtcctg

SEQ ID NO: 39252 - RNA, 1023 nt, synthetic construct; identical to SEQ ID NO: 38908
  misc_feature 1..1023: note = derived and/or modified sequence opt5 from Placulumab_HeavyChain
  source 1..1023: mol_type = other RNA

SEQ ID NO: 39253 - RNA, 1353 nt, synthetic construct
  misc_feature 1..1353: note = derived and/or modified sequence opt5 from Porgaviximab_HeavyChain
  source 1..1353: mol_type = other RNA
gaggtgcagctgcaagaaagcggcgggggactcatgcagcccggcgggtccatgaagctgtcttgcgtcgccagcggattcaccttttccaactactggatgaattgggttagacagtctcctgagaaaggccttgaatgggtggctgagatccggctgaagtccaacaattatgccacacactacgcggaatccgtgaaagggcgcttcacgatttctagagacgatagcaagcggtccgtctatctccagatgaacaccctgcgcgctgaggacacaggaatctactattgtaccagaggcaatggcaactaccgggccatggattattgggggcaaggaacaagcgtgaccgtttcttccgccagcacaaaaggcccgtctgtgtttccccttgctccttccagcaagtctacctccgggggaacggccgctctgggctgcctcgtcaaggactacttccccgagcctgtgaccgttagctggaatagcggggccctgacatctggagtgcatacctttcccgcggtcctgcagagctccggcctctacagcctgtcttccgtggtgacagtccctagctctagccttggcacccagacgtatatttgtaacgttaatcacaaaccgtccaacacaaaggtggataaacgcgtggaacccaagtcttgcgacaaaacccatacatgtcctccctgccctgcccccgagctgctcgggggaccgagcgtcttcctgtttcctcccaagcctaaggatacccttatgatctccagaacccccgaagtgacatgtgttgtggtcgacgtgagccacgaggatcccgaggttaaattcaattggtacgtggacggcgtcgaagtgcataacgctaagacgaaacctcgggaggaacagtataattctacctaccgcgtcgtgtccgttctgacagtgctccaccaagattggctgaacgggaaggagtataaatgcaaggtcagcaataaagccctgccggctcccattgaaaagaccatctctaaggccaaaggacagcctagagagccccaggtgtacacactccctccctcccgggacgagctgaccaagaaccaggttagccttacgtgtctggtgaaaggcttttatccgtccgatatcgcggtcgaatgggagtctaacgggcaacctgaaaataactacaagacaacaccccctgtgctcgacagcgacggatccttctttctgtactctaaacttaccgtggataagagccgctggcagcagggcaatgttttctcctgcagcgtcatgcacgaggccctgcataaccactatacccaaaagtctctctccctgagccccggcaaa

SEQ ID NO: 39254 - RNA, 642 nt, synthetic construct
  misc_feature 1..642: note = derived and/or modified sequence opt5 from Porgaviximab_LightChain
  source 1..642: mol_type = other RNA
gacatccagatgacccaaagccccgcctccctgtctgtgagcgtcggcgagacagtttccattacgtgccgggcttctgaaaacatctacagctccctcgcctggtatcagcagaagcaggggaaatctcctcaactgcttgtgtacagcgcgaccattctggctgatggagtgccgtcccggttcagcggctctgggtccggaacacagtatagcctcaagatcaattctctgcagtccgaggactttggcacctactattgtcagcacttctgggggacaccctacacctttggaggcggcacaaaacttgaaattaagcgcaccgtcgccgcccctagcgtgttcatctttcccccttctgatgagcaactgaaatccgggacggctagcgttgtgtgcctcctgaacaatttctatcccagagaagccaaggtccagtggaaggtggacaacgctctgcagtccggaaattctcaggagagcgttaccgagcaagattccaaagacagcacatactctctctccagcaccctgacactttctaaggccgattacgaaaaacataaggtgtatgcgtgtgaggtcacccaccagggcctgagctcccctgtgacgaaatcttttaacagaggggaatgc

SEQ ID NO: 39255 - RNA, 1341 nt, synthetic construct
  misc_feature 1..1341: note = derived and/or modified sequence opt5 from Prezalumab_HeavyChain
  source 1..1341: mol_type = other RNA
gaggtgcagctggtcgaaagcggcgggggactcgttcaacccggcgggtccctgagactttcttgcgccgctagcggattcaccttttcctcttactggatgagctgggtgcggcaggcccctggcaaggggctggagtgggtggcgtatatcaaacaggacggaaacgaaaagtactatgtcgattccgtgaaaggccgcttcacaatttctagagacaatgctaagaacagcctctacctgcagatgaactcccttcgggccgaggatacggccgtttattactgtgctcgcgaaggcatcctgtggtttggggacctcccgaccttctggggacaaggcacactggtgaccgtcagctctgcctccacaaaagggcccagcgtgtttcctctggctccctgctctagatccaccagcgagtctacagccgcgctcggatgtctggttaaggattatttccctgagcccgtgaccgtctcctggaatagcggcgcccttacgtccggggtgcacacctttcctgctgtgctgcagtctagcggactctactccctgagctctgtcgttacagtgccgtccagcaatttcggcacccagacatatacctgcaacgtggaccataagccctctaatacgaaagtcgataagacagtggaacggaaatgttgcgttgagtgtcctccctgccctgctcccccggtggctggccctagcgtctttctttttccccctaagcccaaagacaccctgatgatttcccgcacacccgaagtgacctgtgttgtggtcgatgtgtctcacgaggaccctgaggtccagttcaactggtacgtggatggggttgaagtgcataatgccaagaccaagccgagagaggaacaattcaacagcacatttcgggtcgtgtccgttctcacggtggtccaccaggactggctgaatggaaaagagtacaagtgcaaagtgagcaacaagggcctgcccgcgcctatcgaaaagaccatttctaagacaaaagggcagccccgcgagcctcaggtgtataccctgcccccgtccagagaggaaatgacaaagaatcaagttagcctcacctgtcttgtcaagggattctacccttctgatatcgccgtggagtgggaatccaacggccagcccgagaataactataaaacgacacctcccatgctggacagcgacgggtccttctttctctactctaagctgaccgtggataaaagccggtggcagcaaggaaacgtcttctcctgctctgtgatgcatgaagcccttcacaatcactatacccagaaaagcctgtccctcagccctggcaaa

SEQ ID NO: 39256 - RNA, 642 nt, synthetic construct
  misc_feature 1..642: note = derived and/or modified sequence opt5 from Prezalumab_LightChain
  source 1..642: mol_type = other RNA
gacatccagatgacccaaagccccagctctctgagcgcctccgtgggcgatagagtcacaattacgtgccgggcttctcaggggatcagcaactggctcgcctggtaccagcagaagcctgagaaagcgccgaagtccctgatttatgctgcctctagccttcaatccggagttcccagccgcttctctggctccgggagcggaaccgactttacactgaccatctcttccctccagcctgaagatttcgccacatactattgtcagcagtacgacagctatcccagaacctttggccaagggacaaaagtggagattaagcggaccgtggctgccccttctgtcttcatctttcccccttccgatgaacagctgaaaagcggaacggcttccgtggtttgccttctgaataacttctacccgcgcgaggccaaggtgcagtggaaggtcgacaatgcgctccagtctggcaacagccaagaatccgtgaccgagcaggatagcaaagactctacatattccctgagctctaccctgacactcagcaaggccgattacgagaaacacaaggtttacgcttgtgaagtgacccatcagggcctgtcctctcccgtcacgaaatcctttaatagaggggagtgc

SEQ ID NO: 39257 - RNA, 342 nt, synthetic construct
  misc_feature 1..342: note = derived and/or modified sequence opt5 from Radretumab_HeavyChain
  source 1..342: mol_type = other RNA
gaggtgcagctgctcgaaagcggcgggggactggtccaacccggcgggtcccttagactgtcttgcgccgctagcggattcaccttttcctctttcagcatgtcctgggttcggcaggcccctggcaaggggctcgagtgggtgtctagcatctccggaagctctggcacaacgtactatgcggactccgtgaaaggccgctttaccattagcagagataactctaagaatacactgtaccttcagatgaactccctgcgggctgaagacaccgccgtctattactgtgccaaaccgttcccctattttgattactgggggcagggaacactcgtgaccgtt

SEQ ID NO: 39258 - RNA, 1071 nt, synthetic construct; identical to SEQ ID NO: 38927
  misc_feature 1..1071: note = derived and/or modified sequence opt5 from Radretumab_HeavyChain_LightChain
  source 1..1071: mol_type = other RNA

SEQ ID NO: 39259 - RNA, 693 nt, synthetic construct
  misc_feature 1..693: note = derived and/or modified sequence opt5 from Radretumab_LightChain
  source 1..693: mol_type = other RNA
gccagcgagatcgtgctgacccagtcccccggcacactctctctgagccctggggaaagagctacgctttcctgccgggcctctcaaagcgtctcctctagcttcctggcgtggtaccagcagaagccgggacaggctccccgcctcctgatttattacgcctccagcagagccaccggcatccctgaccggttttctgggtccggaagcggcacagatttcacccttacaatttctcgcctggagcccgaagactttgctgtttattactgtcaacagaccgggagaatccctcccacattcggacagggcaccaaagtggagattaagtccggcgggagcggaggccctcgggccgctccggaagtgtatgcctttgcgacgcccgagtggcctgggtctcgcgataaaagaaccctcgcctgcctgatccagaacttcatgcccgaggacatctccgtccaatggctgcacaatgaagtgcagctccctgatgctcggcatagcacaacccagccccgcaagacaaaaggatccggctttttcgtgttttctagactggaggttacccgggccgaatgggagcagaaggacgagttcatttgtcgcgctgtccacgaagccgcgagcccgtcccaaacggtgcagagagccgttagcgtgaaccctgagtcttcccggcgcgggggatgc

SEQ ID NO: 39260 - RNA, 1359 nt, synthetic construct
  misc_feature 1..1359: note = derived and/or modified sequence opt5 from Ranevetmab_HeavyChain1
  source 1..1359: mol_type = other RNA
gaggtgcagctggtcgaaagcggcgggggactcgttcaacccggcgggtccctgagactttcttgcgtggccagcggattctccctgaccaacaataacgtgaattgggtccggcaggctcctggcaaggggctcgagtgggtgggaggcgtttgggccggcggggcgacagactacaactctgctctgaaaagccgctttacgatctccagagataatgccaagaacaccgtgttccttcagatgcactctctgcggagcgaagacacagccgtctattactgtgctcgcgatggaggctattccagctctaccctctacgccatggacgcttgggggcagggaacatccgtgaccgttagctctgcctccacaaccgcgccgagcgtgtttcccctggccccttcttgcggctccacgagcgggtccaccgtcgctctggcctgtctcgtgtctggatatttccccgagcctgtgacagtcagctggaactccggcagcctgacctctggcgttcatacatttccctccgtgcttcaaagctctgggctgcacagcctctcctctatggtgaccgtccctagctccagatggccgagcgaaacgttcacatgcaatgtggttcatcccgcttctaataccaaagtggataagcctgtctttaacgagtgtcggtgcacagacacacccccttgtcccgtgccggagcctctgggaggcccctccgttcttattttccctcccaaacccaaggatatcctgcgcattaccagaacccctgaagtgacgtgcgtcgtgctcgacctggggcgggaggatccggaagtccagatcagctggtttgtggacggaaaggaggttattaccgccaaaacacagtctcgcgagcagcaattcaatggcacctaccaggtggtctccgtgctgcccatcgaacaccaggattggctcacagggaaggagtttaaatgtagagttaaccatatcgacctgcctagccccattgaacggaccatctccaaggcgcgcggcagagcccacaaaccttctgtgtatgtccttcccccgagccctaaggagctgtcctctagcgatacggtgtccattacatgcctcatcaaggacttctatccccctgacattgatgtggaatggcagagcgttggacaacaggagcccgagcggaaacaccgcatgacccctccccagctggacgaagatggctcttactttctttactccaagctgagcgtcgacaaatctagatggcaacagggggatccgttcacctgtgctgtgatgcatgagacactccagaatcactacaccgacctgtccctgagccattctcctggaaag

SEQ ID NO: 39261 - RNA, 1359 nt, synthetic construct
  misc_feature 1..1359: note = derived and/or modified sequence opt5 from Ranevetmab_HeavyChain2
  source 1..1359: mol_type = other RNA
gaggtgcagctggtcgaaagcggcgggggactcgttcaacccggcgggtccctgagactttcttgcgtggccagcggattctccctgaccaacaataacgtgaattgggtccggcaggctcctggcaaggggctcgagtgggtgggaggcgtttgggccggcggggcgacagactacaactctgctctgaaaagccgctttacgatctccagagataatgccaagaacaccgtgttccttcagatgcactctctgcggagcgaagacacagccgtctattactgtgctcgcgatggaggctattccagctctaccctctacgccatggacgcttgggggcagggaacatccgtgaccgttagctctgcctccacaaccgcgccgagcgtgtttcccctggccccttcttgcggctccacgagcgggtccaccgtcgctctggcctgtctcgtgtctggatatttccccgagcctgtgacagtcagctggaactccggcagcctgacctctggcgttcatacatttccctccgtgcttcaaagctctgggctgcacagcctctcctctatggtgaccgtccctagctccagatggccgagcgaaacgttcacatgcaatgtggttcatcccgcttctaataccaaagtggataagcctgtctttaacgagtgtcggtgcacagacacacccccttgtcccgtgccggagcctctgggaggcccctccgttcttattttccctcccaaacccaaggatatcctgcgcattaccagaacccctgaagtgacgtgcgtcgtgctcgacctggggcgggaggatccggaagtccagatcagctggtttgtggacggaaaggaggttctgaccgccaaaacacagtctcgcgagcagcaattcaatggcacctaccaggtggtctccgtgctccccattgaacaccaggattggctgacagggaaggagtttaaatgtagagttaaccatatcgaccttcctagccccatcgaacggaccatttccaaggcgcgcggcagagcccacaaaccttctgtgtatgtcctgcccccgagccctaaggagctctcctctagcgatacggtgtccatcacatgcctgattaaggacttctatccccctgacatcgatgtggaatggcagagcgttggacaacaggagcccgagcggaaacaccgcatgacccctccccagcttgacgaagatggctcttactttctgtactccaagctcagcgtcgacaaatctagatggcaacagggggatccgttcacctgtgctgtgatgcatgagacactgcagaatcactacaccgacctgtccctcagccattctcctggaaag

SEQ ID NO: 39262 - RNA, 651 nt, synthetic construct
  misc_feature 1..651: note = derived and/or modified sequence opt5 from Ranevetmab_LightChain
  source 1..651: mol_type = other RNA
gacatcgtgatgacccagagccccgcctccctgtctctcagccaaggcgagacagtcacgattacctgcagagcttccgaagatatctacaacgccctggcgtggtatcagcagaagcctgggcaggctccgaaacttctgatttacaatacagacaccctccacacaggagttccctctcggttcagcggctccgggtctggaaccgattttagcctgacaatctccagccttgagcctgaagacgtggccgtgtattactgtcaacattatttccactacccccgcacctttggccaggggacgaaggtcgagctgaaaagaaacgatgcccagcctgctgtgtatctcttccagccctctcctgaccaactgcataccggatccgccagcgttgtgtgcctgctcaattctttttacccgaaggatattaacgtcaaatggaaggtggacggcgttatccaggatacaggcatccaggaatccgtgaccgagcaggacaaggatagcacatactctctgtccagcacccttacgatgtcctctacagagtatctgagccacgaactctactcctgtgagattacccataaaagcctgccctctacacttatcaagtccttccaacggagcgaatgccagcgcgtcgac

SEQ ID NO: 39263 - RNA, 1761 nt, synthetic construct
  misc_feature 1..1761: note = derived and/or modified sequence opt5 from Remtolumab_HeavyChain
  source 1..1761: mol_type = other RNA
gaggtgcagctggtcgaaagcggcgggggactcgttcaacccggcagatccctgcggctttcttgcgccgctagcgggttcacctttgacgattacgccatgcactgggtgcgccaggcgcctggaaagggcctggagtgggtgtccgctatcacatggaactctgggcatattgactatgccgatagcgtcgaaggaagattcacgatctcccgggacaatgccaaaaactctctctacctgcagatgaatagccttcgcgctgaggataccgccgtgtattactgtgctaaggtttcctatctgagcacagcctcttccctcgactactggggccagggcaccctggtgacagtcagctctgggggaggcgggtccggaggcgggggaagcgaagtgcaactggttcagtctggcgcggaggtgaaaaagccgggctccagcgtcaaagtgtcctgcaaggcctctgggggcagctttggagggtatggaattggctgggtgagacaggctcccgggcagggactcgagtggatgggcggcatcacccctttctttgggttcgccgattacgctcaaaagtttcagggacgggtcacaattaccgccgacgaatccacgaccacagcgtacatggagctgagcggccttacctctgatgacacagccgtttattactgtgctcgcgatcccaacgagttctggaatgggtattactccacccacgactttgatagctggggacagggcacgacagtgaccgtgtctagcgcctccacaaaagggccttctgtcttccccctggctcctagctccaagagcacctctggcggaaccgccgccctcggctgcctggtgaaagactattttccggaacccgttacagtgtcctggaacagcggggctcttacgtctggagtccataccttccctgcggtgctgcagtccagcggcctctactccctgtctagcgttgtgacagtcccctcctctagcctggggacccaaacatatatctgtaatgtgaaccacaagccttccaataccaaagtcgacaagaaggtggagcccaaaagctgcgataagacgcatacatgtccgccttgccccgcccctgaactcctgggaggcccctctgtttttctttttccccctaaaccgaaggacaccctgatgatctccagaacccccgaggtgacatgtgtcgtggttgatgtgagccacgaagaccctgaggtcaaattcaactggtacgtggatggggtggaagttcacaatgctaagaccaaaccccgggaggagcagtacaactctacatatcgcgtcgtgtccgtgctcacggtcctgcatcaggactggcttaatggcaaggaatacaagtgcaaagtgagcaacaaggccctgcctgcccccattgagaaaaccatctctaaggctaaaggacaaccgagagaacctcaggtttatacactgccccctagccgggatgagctcaccaagaatcaggtgtccctgacatgtctcgtcaagggcttctaccccagcgacattgccgtggaatgggagtctaacgggcagcctgagaacaattataaaaccacgcccccggttctggattccgacggcagcttctttctttactccaagctgaccgtggataaatctcgctggcaacagggaaacgtcttcagctgctccgtgatgcacgaagcgctccataatcactatacacagaagtctctgagcctttcccctgggaaa

SEQ ID NO: 39264 - RNA, 993 nt, synthetic construct
  misc_feature 1..993: note = derived and/or modified sequence opt5 from Remtolumab_LightChain
  source 1..993: mol_type = other RNA
gacatccagatgacccaaagcccctcctctctgagcgcctccgtgggcgatagagtcacaattacgtgccgggcttctcaggggatccgcaactacctcgcctggtatcagcagaagcctggaaaagcgccgaagctgcttatttacgctgccagcaccctgcaatccggcgttccctctagattcagcgggtccggaagcggcacagactttaccctcacaatctcttccctgcagcctgaggatgtggccacctattactgtcagcggtataatcgcgctccctacacattcgggcagggaaccaaagtggaaattaagagaggcggcagcgggggaggcgggtctggagagatcgtccttacgcaatcccctgactttcagagcgtgacccccaaagaaaaggttacaattacctgccgggcctctcaggatatcggctccgagctgcactggtatcagcaaaagcctgaccagccgcccaaactcctgatcaagtacgctagccattccacatctggggtgcctagccgcttctccggaagcggctctggcaccgattttacgctgacaattaacgggctcgaagccgaggacgcgggaacctactattgtcaccagacagattccctgccctacaccttcggccctgggaccaaagtcgacatcaagagaacagtggccgctcccagcgtttttattttcccgccttctgatgagcaacttaaaagcggaacggcctccgtggtctgcctgctcaataacttttatccccgggaagctaaggtgcagtggaaggtggacaatgccctgcagtctggcaacagccaggagtccgtcaccgaacaagatagcaaagactctacatactcccttagctctaccctgacactctccaaggcggactatgagaaacataaggtttacgcctgtgaggtgacccaccaggggctgagctcccctgtgacgaaatctttcaatcgcggagaatgc

SEQ ID NO: 39265 - RNA, 1341 nt, synthetic construct
  misc_feature 1..1341: note = derived and/or modified sequence opt5 from Rosmantuzumab_HeavyChain
  source 1..1341: mol_type = other RNA
caggtgcaactggtccagagcggcgccgaggttaagaaacccggggcttccgtgaaggtgtcttgcaaagccagcggatacaccttcacagactattccatccactgggtcagacaggcgcctggccaggggctcgaatggattggatacatctatccgtctaacggcgatagcgggtacaatcaaaagtttaaaaaccgggtgacgatgacccgcgacacatccacctctacagcttatatggagctgagcagacttcggtccgaagataccgccgtttactattgtgccacatacttcgctaataactttgactactggggacagggcaccacgctgaccgtgagctctgcctccacaaagggccccagcgtcttccctctcgctccctcttccaagagcacctctgggggaacagccgcgctgggctgccttgtgaaagattattttcctgagcccgttaccgtgtcctggaatagcggggccctgacgtccggagtccatacattccctgctgtgctccagtctagcggcctgtactccctgagctctgtggtcaccgttccgtccagctctctcgggacacagacctatatttgtaacgtgaatcacaagcccagcaacaccaaagtggacaagcgcgtcgaacctaaatcctgcgataagacacatacgtgtcccccttgccccgccccggagctgcttggaggcccttctgtgtttctgtttccccctaagcccaaagacaccctcatgatcagcagaacacccgaggttacctgtgtggtcgtggatgtttcccacgaagaccctgaggtgaagttcaattggtacgtcgatggcgtggaagtccataacgctaaaacaaagccgcgggaggagcaatataatagcacctaccgcgtggtttctgtgctgacggtccttcaccaggactggctgaacgggaaagaatataagtgcaaagtgtccaataaggccctccccgcgcctattgagaagacaatcagcaaagccaagggacagcccagagaacctcaggtttacaccctgcccccgtctcgggaggaaatgaccaaaaaccaagtgtccctgacatgtctcgtcaagggcttctaccctagcgatatcgctgtggagtgggagtccaatgggcagcccgaaaacaactataaaaccacacctcccgtgctggactctgacggcagctttttcctttactccaagctgacggttgataagtctcgctggcagcaaggaaatgtctttagctgctccgtgatgcacgaggccctccataaccactatacccagaaaagcctgtctctttcccctgggaag

SEQ ID NO: 39266 - RNA, 654 nt, synthetic construct
  misc_feature 1..654: note = derived and/or modified sequence opt5 from Rosmantuzumab_LightChain
  source 1..654: mol_type = other RNA
gacatccagatgacccaaagcccctcctctctgagcgcctccgtgggcgatagagtcacaattacgtgcaaggcttctcagagcgttgactacgatggggactcctatatgaactggtaccagcagaaacctggaaaggccccgaaactcctgatctatgcggcttctaatcttgagagcggcgtgccctcccggttcagcgggtctggatccggcaccgattttacactgaccattagccctgtgcaagccgaagacttcgccacatactattgtcagcagtctaacgaggatcccctcacctttggggctggaacaaagctggaacttaaacgcaccgtcgccgctccttccgtgttcatctttccccctagcgacgagcagctgaagtctggcacggcctccgttgtgtgcctcctgaataacttctacccgagagaagcgaaggtccaatggaaagtggataatgccctgcagagcggcaactcccaggagtctgttaccgagcaggacagcaaggattccacatatagcctctcttccaccctgacacttagcaaagctgactacgaaaagcacaaagtgtacgcctgtgaggtcacccatcaagggctgtctagccccgtgacgaagtcctttaatcggggagaatgc

SEQ ID NO: 39267 - RNA, 1332 nt, synthetic construct
  misc_feature 1..1332: note = derived and/or modified sequence opt5 from Rozanolixizumab_HeavyChain
  source 1..1332: mol_type = other RNA
gaggtgcccctggtcgaaagcggcgggggactcgttcagcctggcgggtccctgagactttcttgcgccgtgagcggattcaccttttccaactacggcatggtgtgggtccggcaagctccggggaagggactggagtgggtggcctatatcgactctgatggcgacaatacatactatcgcgatagcgttaaaggcagattcacgatttcccgggacaacgcgaagtctagcctctacctgcagatgaactcccttcgcgctgaagataccgccgtgtattactgtacaaccgggatcgtcagaccctttctgtattggggacagggcacactcgtgaccgttagctctgcctccacaaaagggcctagcgtgttccccctggctccttgctctcggtccaccagcgagtctacggccgctctgggatgtctcgtcaaggactactttcccgaacctgtgaccgtgtcctggaatagcggcgccctgacatccggggtccacaccttcccggcggttcttcagtctagcggactgtactccctcagctctgtggtgacagtcccctccagctctctgggcaccaaaacgtatacatgcaatgtggatcataagcctagcaacaccaaggttgacaaacgcgtggagtccaagtacgggcccccttgtcccccgtgccctgcccccgagtttcttggcggaccttctgtcttcctgtttcctcccaaacccaaggatacactcatgattagcagaaccccggaagtgacctgtgttgtggtcgacgtgtcccaagaggatcccgaagtccagttcaattggtatgtggacggcgttgaggtgcacaacgctaaaacaaagcctcgggaggaacagtttaatagcacgtaccgcgtcgtgtctgttctgaccgtgctgcatcaggattggctcaacgggaaggagtataaatgcaaggtctccaataaaggactgcccagctctatcgaaaagacaatttccaaagccaagggccaacctagagagccccaggtgtacacccttccgcctagccaggaagagatgaccaaaaaccaggtgtccctgacatgtctcgttaaggggttctatccctctgacatcgctgtcgagtgggaaagcaatggacaacctgagaacaattacaagacgacaccccctgtgctggactccgatggcagctttttcctttactctcggctgaccgtggacaaatcccgctggcaggaaggcaacgtcttcagctgctctgtgatgcacgaggccctccataaccactatacccagaagtccctgagcctgtctctcgggaaa

SEQ ID NO: 39268 - RNA, 657 nt, synthetic construct
  misc_feature 1..657: note = derived and/or modified sequence opt5 from Rozanolixizumab_LightChain
  source 1..657: mol_type = other RNA
gacatccagatgacccaaagcccctcctctctgagcgcctccgtgggcgatagagtcacaattacgtgcaagtctagccagtccctcgttggggcttctggaaaaacctacctgtattggcttttccagaagcctggcaaagccccgaagcggctgatctacctcgtgagcacactggactccgggattcccagccgcttttctggatccggcagcgggaccgagttcacacttaccatctcttccctgcagcctgaagattttgcgacatattactgtctccaaggaacccacttcccccatacgtttggccagggcaccaaactggagattaagagaacagtggctgcccctagcgtcttcatctttcccccttctgacgaacagctgaagtccgggaccgccagcgtggtttgcctcctgaacaatttctatccgcgggaggctaaagtgcagtggaaggtcgataacgcccttcaatccggaaattctcaggaaagcgtgacagagcaggactccaaagatagcacctactctctgtccagcacgctcacactgtctaaggctgactatgagaaacacaaggtttacgcctgtgaagtgacccatcagggccttagctcccccgtcacaaagtcttttaaccgcggggagtgc

SEQ ID NO: 39269 - RNA, 1329 nt, synthetic construct
  misc_feature 1..1329: note = derived and/or modified sequence opt5 from Sapelizumab_HeavyChain
  source 1..1329: mol_type = other RNA
caggtgcaactgcaggagagcggccccgggctcgtcaagccttccgaaaccctgtctcttacatgcgccgttagcggacactccatctctcatgaccacgcttggagctgggtgagacagccgcccggcgaggggctggaatggattggattcatctcctactctggcattacgaactataatcctagcctccaggggcgggtgaccatctcccgcgataacagcaaaaatacactgtaccttcaaatgaactctctgagagccgaggacaccgcggtctattactgtgctcggtccctcgcccgcacaaccgccatggattattggggagaaggcacactggtgaccgttagctctgcttccacgaagggccccagcgtgtttcctctggccccctcttccaaaagcacctccgggggaacagctgccctcggctgcctggtcaaggactacttccctgagccggtgaccgtttcttggaatagcggggcgcttacatccggagtgcatacctttcccgccgtcctgcagagctctggcctctattccctgagctctgtggtgacggtccctagctccaacttcgggacacagacctacacatgtaatgttgatcacaaaccctctaacaccaaggtggacaagaccgtggagagaaaaagctgcgtcgaatgtcctccctgcccggctcctcccgtggccggaccttccgtttttcttttccctcccaagcccaaagatacactgatgattagccggacgccggaggtgacctgtgtcgtggttgacgtgtctcaggaagatcccgaggtccaatttaattggtacgtggacggcgtcgaggtgcataacgctaagacaaaacctcgcgaggaacagttcaattccacctttagagttgtgagcgtcctcacagtggttcaccaggattggctgaacggcaaggaatataagtgcaaagtgtctaataaggggctgcccgcccctatcgagaaaaccatctccaagacgaaaggacagccccgggaaccgcaagtctacacactccctcccagccaggaggagatgaccaagaaccaggtgtccctgacctgtcttgtgaaaggcttctatccttctgacattgcggttgaatgggagagcaatgggcaacccgaaaacaactacaagacaacccctcccatgctggattccgacggatctttctttctctatagcaagctgacagtcgacaaatcccgctggcaggagggcaatgtgtttagctgctctgtgatgcacgaagcccttcatgctcactacacgcagaagtccctgagcctctctccg

SEQ ID NO: 39270 - RNA, 642 nt, synthetic construct
  misc_feature 1..642: note = derived and/or modified sequence opt5 from Sapelizumab_LightChain
  source 1..642: mol_type = other RNA
gacatccagatgacccaaagcccctcctctctgagcgcctccgtgggcgattctgtcacaattacgtgccaggctagcaccgacatctcctctcacctcaactggtaccagcagaagcctgggaaagccccggagctgcttatttattacggaagccatctgctctccggcgttcccagccggttctctgggtccggaagcggcacagattttaccttcacaatctcttccctggaagcggaggacgctgccacctattactgtgggcaaggaaatcggcttccttatacatttggccagggcaccaaggtggaaattgagcgcacggtggccgctcccagcgtcttcatctttcctccctctgatgaacagctgaaatccgggaccgccagcgtggtttgcctcctgaacaatttctaccctagagaggctaaggtgcagtggaaagtcgacaacgccctgcaatccggaaattctcaggagagcgtgacagaacaggattccaaggacagcacctattctctctccagcacactgaccctttctaaggcggattacgagaaacacaaggtttacgcctgtgaagtgacgcatcagggcctgagctccccggtcacaaaatcttttaacagaggggagtgc

SEQ ID NO: 39271 - RNA, 1356 nt, synthetic construct
  misc_feature 1..1356: note = derived and/or modified sequence opt5 from Selicrelumab_HeavyChain
  source 1..1356: mol_type = other RNA
caggtgcaactggtccagagcggcgccgaggttaagaaacccggggcttccgtgaaggtgtcttgcaaagccagcggatacaccttcacaggctattacatgcactgggtcagacaggcgcctgggcagggactcgaatggatgggctggatcaacccggactccgggggaacgaattatgctcaaaagtttcagggccgggtgaccatgacacgcgatacctctattagcacagcctacatggagctgaacagacttcggtccgacgataccgccgtttattactgtgctcgcgaccagcccctgggctattgcacaaatggggtgtgttcttacttcgattactggggacagggcaccctcgtcacggtgagctccgccagcaccaaagggccttctgtttttcccctggctccttgctccagaagcacatctgaatccaccgccgcgcttggatgtctggtgaaggactatttccccgagcctgtcacagtgagctggaactctggcgccctcacctccggggtgcatacgtttccggctgtcctgcaaagctccggactgtactctctcagctccgttgtgacagtgcccagctctaatttcggcacccagacatatacctgcaacgtcgatcacaagccttccaataccaaagtggacaagacagttgaacggaaatgttgcgtggagtgtcccccttgccccgccccgcctgtcgctggccccagcgtgtttctgttccctcccaagcccaaagatacgcttatgatctctcgcacccctgaggttacatgtgtggtcgtggacgtcagccatgaagatccggaggtgcagtttaactggtacgttgacggggtggaagtccacaatgccaagaccaagcccagagaggagcagttcaactccacatttcgggtggtttctgtgctgaccgtcgtgcatcaagattggctcaatggaaaagaatataagtgcaaagtgagcaacaagggcctgcctgcgcccattgagaaaacgatctccaagacaaaagggcagcctcgcgaaccccaggtttacacccttccgcctagcagagaggaaatgaccaagaatcaagtctctctgacatgcctcgtgaagggattctatccctccgacattgccgtggagtgggagagcaacggccagcctgaaaataactacaaaaccacaccccctatgctggactctgatgggtcctttttcctgtacagcaagctcacggtcgacaaatcccggtggcagcagggaaacgtgttctcttgtagcgttatgcacgaggctctgcacaatcattatacccaaaagtccctttctctgagccccggcaaa

SEQ ID NO: 39272 - RNA, 642 nt, synthetic construct
  misc_feature 1..642: note = derived and/or modified sequence opt5 from Selicrelumab_LightChain
  source 1..642: mol_type = other RNA
gacatccagatgacccaaagcccctcctctgtgagcgcctccgtcggcgatagagttacaattacgtgccgggcttctcaggggatctacagctggctggcctggtatcagcagaagcctggaaaagcgccgaacctcctgatttacaccgcttccacacttcaatctggcgtgcccagccgcttctccgggagcggatctggcaccgactttacactgaccatctccagcctccagcctgaggatttcgccacatattactgtcagcaggccaatatttttcccctgaccttcgggggaggcacgaaggtggaaatcaaaagaaccgtcgctgccccttctgtgtttatctttcccccttccgacgagcaacttaagagcggcacagcttctgttgtgtgcctgctcaacaatttctatccgcgggaagccaaagtccagtggaaggtggataacgcgctgcagtccgggaatagccaggagtccgttaccgaacaagactctaaggatagcacatactccctgagctctaccctcacgctgtccaaagccgactatgagaagcacaaagtgtacgcttgtgaggtcacacatcagggacttagctctcccgtgaccaagagcttcaaccgcggcgaatgc

SEQ ID NO: 39273 - RNA, 354 nt, synthetic construct
  misc_feature 1..354: note = derived and/or modified sequence opt5 from Solitomab_HeavyChain1
  source 1..354: mol_type = other RNA
gaggtgcagctgctcgaacaaagcggcgccgagctggtcagacccgggacctccgttaagatctcttgcaaagctagcggatacgccttcacaaactattggcttggctgggtgaagcagcggcctgggcacggactggaatggattggcgacatctttccggggtccggaaatattcattacaacgagaaattcaagggcaaagcgacgctcaccgctgataagtctagctccacagcctatatgcagctgtctagccttacctttgaagactccgccgtgtacttctgtgctcgcctgagaaattgggatgagcccatggactattggggccaggggacaaccgtcacagtg

SEQ ID NO: 39274 - RNA, 375 nt, synthetic construct
  misc_feature 1..375: note = derived and/or modified sequence opt5 from Solitomab_HeavyChain2
  source 1..375: mol_type = other RNA
gacgtgcagctggtccaaagcggcgccgaggttaagaaacccggggcttccgtgaaggtgtcttgcaaagccagcggatacaccttcacaagatatacgatgcactgggtccggcaggcgcctggccaggggctcgaatggatcggatacattaacccgtcccgcggctataccaattacgctgattctgtgaaggggagatttacaatcaccacagacaaaagcacctccacagcctatatggagctgtctagccttcggtccgaagataccgccacgtactattgtgctcgctactacgacgatcattattgcctggactactggggacagggcaccacagttaccgtgagctctggcgaggggacatccacc

SEQ ID NO: 39275 - RNA, 1488 nt, synthetic construct
  misc_feature 1..1488: note = derived and/or modified sequence opt5 from Solitomab_LightChain_HeavyChain_HeavyChain_LightChain
  source 1..1488: mol_type = other RNA
gagctggtgatgacccagagcccctcctctctcacagtcacggccggcgaaaaggttaccatgagctgcaaatcctctcaaagcctgcttaactccgggaatcagaagaactacctgacatggtatcagcagaaacctggacaaccgcccaagctcctgatctactgggcttctaccagagagagcggcgtgcctgaccggttcacagggtccggaagcggcaccgattttacacttaccatttcttccgtgcaggccgaagacctggcggtctattactgtcagaatgattatagctaccccctcacgttcggggctggaaccaaactggagatcaagggcggcgggggatctggcgggggaggctccgggggaggcggcagcgaagtgcagctgctcgagcaatctggggccgagctggttcgccctggaacatccgtgaagattagctgcaaagcctccggctatgcttttaccaactactggcttgggtgggtcaagcagagacccggacacggcctggaatggatcggggacattttccctggatctggcaatatccattacaacgagaaatttaagggcaaagccacactcaccgctgataagagctccagcacggcctatatgcagctgtcttcccttacattcgaagacagcgcggtgtacttttgtgcccggctgcgcaattgggatgagccgatggactattgggggcagggaaccacagttaccgtgtctagcggcgggggaggctccgatgtccaactcgtgcagtctggggctgaggtgaagaaacccggcgccagcgtcaaggtttcctgcaaagctagcggatacaccttcacaagatatacgatgcactgggtgcggcaggcccctggccaagggctggaatggatcggatacattaacccctctcgcggctataccaattacgcggactccgtgaaggggagatttacaatcaccacagataaaagcacctctacggcctacatggagctgtccagcctccggtccgaagacacagctacctattactgtgcccgctattacgatgaccattattgcctggactactggggacagggcaccacagtcaccgtgtctagcggggagggcacatccacgggatctggcgggagcggaggctccgggggagctgatgacattgttcttacccagagccctgccacactgtctctctcccccggcgaaagagccaccctgagctgtcgggcttctcagtccgtgagctatatgaactggtaccaacagaagccggggaaagcgcctaagcgctggatctacgatacatctaaggtcgccagcggcgtgcccgctagattctccggaagcggctctgggaccgactattcccttacgattaatagcctggaggccgaggatgccgctacctactattgccagcagtggtcctctaaccctctcacatttggaggcgggaccaaagttgaaatcaag

SEQ ID NO: 39276 - RNA, 339 nt, synthetic construct
  misc_feature 1..339: note = derived and/or modified sequence opt5 from Solitomab_LightChain1
  source 1..339: mol_type = other RNA
gagctggtgatgacccagagcccctcctctctcacagtcacggccggcgaaaaggttaccatgagctgcaaatcctctcaaagcctgcttaactccgggaatcagaagaactacctgacatggtatcagcagaaacctggacaaccgcccaagctcctgatctactgggcttctaccagagagagcggcgtgcctgaccggttcacagggtccggaagcggcaccgattttacacttaccatttcttccgtgcaggccgaagacctggcggtctattactgtcagaatgattatagctaccccctcacgttcggggctggaaccaaactggagatcaag

SEQ ID NO: 39277 - RNA, 324 nt, synthetic construct
  misc_feature 1..324: note = derived and/or modified sequence opt5 from Solitomab_LightChain2
  source 1..324: mol_type = other RNA
gccgacgatatcgtgctgacccagagccccgctacactctccctgtctcctggcgagagagccacgcttagctgccgggcgtcccaatctgtcagctacatgaactggtatcagcagaagccggggaaagctcccaagcgctggatttacgacacctccaaagttgcctctggagtgcctgccagattcagcggctccgggagcggaacagattattctctgaccatcaattccctcgaagctgaggacgccgctacatactattgtcagcaatggagctctaaccccctgacctttggcgggggaacaaaggtggaaattaaa

SEQ ID NO: 39278 - RNA, 1359 nt, synthetic construct
  misc_feature 1..1359: note = derived and/or modified sequence opt5 from Suptavumab_HeavyChain2
  source 1..1359: mol_type = other RNA
gaggtgcagctggtcgaaagcggcggggacctcgttcaacccggaagatccctgcggctttcttgcgtggccagcggcttcacctttgatgactacgctatgcactgggtgcgccaggcccctgggaagggactggagtgggtctccggcgtgtcttggagcgggtccacagttggatatgcggattctgtgaaaggcagattcacggtcagccgggacaacgctcagaagtccctctacctgcagatgaatagccttcgcgccgaagataccgccctgtattactgtgtgaaagacgcttataagtttaactactattactacggcctcgatgtttgggggcaaggaacaaccgtgacagtctcttccgccagcaccaaaggcccgtctgtgttccccctggctccttccagcaagtctacatccgggggaaccgccgcgctgggctgcctcgtgaaggactattttcccgagcctgtcacggttagctggaactccggggccctgacctctggagtgcatacattccccgctgtgcttcagagctccggcctgtacagcctctcttccgtcgtgaccgttcctagctctagcctgggcacacagacctatatctgtaatgtgaatcacaaaccgtccaacacgaaggtcgataaaaaggtggaacccaaatcttgcgacaagacacatacctgtcctccctgccctgcccccgagcttctcgggggaccgagcgtttttctgttccctcccaagcctaaagatacactgatgatttccagaacccccgaggtgacctgtgtcgtggtcgacgtgagccacgaagatcccgaggttaagtttaattggtacgtggacggcgtcgaagtgcataacgctaaaacaaagcctcgggaggagcagtataattctacgtaccgcgttgtgtccgtcctgaccgtgctccaccaagactggctgaacgggaaagaatataagtgcaaagtgagcaataaggcccttccggcgcccatcgagaagacaatttctaaagccaagggacagcctagagaaccccaggtttacaccctgcctccctcccgggatgagctcaccaaaaaccaggtcagcctgacatgtcttgtgaagggcttctacccgtccgacatcgctgtggaatgggagtctaatgggcaacctgagaacaattataaaacgacaccccctgtcctggatagcgacggatcctttttcctctactctaagctgaccgtggataagagccgctggcagcagggcaacgtgttttcctgcagcgttatgcacgaagccctgcataaccactatacccaaaaatctctctccctgagccccggcaag

SEQ ID NO: 39279 - RNA, 1356 nt, synthetic construct
  misc_feature 1..1356: note = derived and/or modified sequence opt5 from Suvratoxumab_HeavyChain
  source 1..1356: mol_type = other RNA
gaggtgcagctggtcgaaagcggcgggggactcgttcaacccggcgggtccctgagactttcttgcgccgctagcggattcaccttttcctctcacgacatgcattgggtgcggcaggccacaggcaaggggctggagtgggtgagcggaatcggcacggcgggcgatacctactatcctgactccgtcaaagggcgcttcacaatttctagagaaaacgctaagaatagcctctacctgcagatgaactcccttcgggccggagataccgccgtgtattactgtgctcgcgacagatatagcccgacaggccactactatgggatggatgtttggggacagggcaccacagtgaccgtctcttccgccagcacgaaagggccctctgtgtttcctctggctccctccagcaagtctacctccggaggcacagccgcgctcggctgcctggttaaagactacttccctgagcccgtgaccgtcagctggaatagcggggccctgacatctggagtgcatacctttcctgctgtgctccaaagctccggcctgtacagcctttcttccgtcgttacggtgccgagctctagcctggggacacagacctatatctgtaacgtgaatcacaagccctccaacacaaaggtcgataaacgggtggaacctaagtcttgcgacaaaacccatacctgtcccccttgccccgccccggagctcctgggaggccctagcgttttcctttttccccctaagcccaaagatacactgtacattacgcgcgagcccgaagtgacctgtgtcgtggttgacgtgtcccacgaggatcctgaagtcaagttcaattggtatgtggacggggtcgaggtgcacaacgctaagacaaaaccgagagaggaacagtacaatagcacctatcgggttgtgtctgtcctcacagtgctgcatcaggattggctgaacggaaaggagtacaaatgcaaggtttccaataaagccctccccgcgcctatcgaaaagaccattagcaaagccaagggccaaccccgcgagcctcaggtgtatacgctgcccccgtctagagaagagatgacaaagaaccaggtctcccttacctgtctggtgaaaggcttttaccctagcgacatcgctgtggagtgggaatccaatgggcagcccgagaacaattacaagaccacacctcccgttctcgactctgatggatccttctttctgtattccaaacttaccgtcgacaagtctcggtggcaacagggcaacgtgttcagctgctccgtgatgcacgaagccctgcataaccactacacacagaaaagcctctctctgtcccctgggaag

SEQ ID NO: 39280 - RNA, 639 nt, synthetic construct
  misc_feature 1..639: note = derived and/or modified sequence opt5 from Suvratoxumab_LightChain
  source 1..639: mol_type = other RNA
gacatccagatgacccaaagcccctccacactgtctgccagcgtgggcgatagagtcacgattacctgccgggcttcccagtctatcagctcctggctcgcctggtaccagcagaagcctgggaaagcgccgaagctgcttatttataaggcttctagcctggagtccggagttcccagccgcttctctggctccgggagcggaacagaatttaccctcacaatctcttccctgcaacctgacgatttcgccacctactattgtaaacagtacgccgactattggacatttggccaggggaccaaagtggagattaagagaacggtggctgcccccagcgtcttcatctttcctccctctgatgaacagcttaagtccggaaccgctagcgtggtttgcctgctcaacaatttctaccctcgggaggccaaagtgcaatggaaggtcgacaacgcgctgcagtccggcaattctcaggaaagcgtgacagagcaggattccaaagacagcacctattctctgtccagcacactcaccctgtctaaggccgattacgagaaacacaaggtttacgcttgtgaagtgacgcatcaaggccttagctccccggtcacaaagtcttttaaccgcggggagtgc

SEQ ID NO: 39281 - RNA, 642 nt, synthetic construct
  misc_feature 1..642: note = derived and/or modified sequence opt5 from Tadocizumab_LightChain
  source 1..642: mol_type = other RNA
gacatccagatgacccaaacacccagcacgctgtccgcctctgtgggcgatagagtcaccattagctgccgggcttcccaggacatcaacaattacctcaactggtatcagcagaaacctgggaaagccccgaagctgcttatttactatacatctaccctgcacagcggagttccctcccgcttctctggcagcgggtccggaacagattacaccctcacaatcagctctctgcaacctgacgattttgcgacctatttctgtcagcagggcaatacgcttccctggacctttgggcagggaacaaaagtggaggtgaagagaaccgtcgctgccccttccgtgttcatttttccccctagcgacgaacaactgaaatctggcacagcctccgttgtgtgcctcctgaacaatttctacccgcgggaggctaaggtccagtggaaggtggataacgccctgcagagcggcaattctcaggaatccgttaccgagcaagacagcaaagattccacgtattctctcagctccacactgacccttagcaaggctgactacgaaaaacataaggtgtacgcctgtgaggtcacacaccaggggctgtcttcccccgtgaccaagagctttaaccgcggagagtgc

SEQ ID NO: 39282 - RNA, 1341 nt, synthetic construct
  misc_feature 1..1341: note = derived and/or modified sequence opt5 from Tanezumab_HeavyChain
  source 1..1341: mol_type = other RNA
caggtgcaactgcaggagagcggccccgggctcgtcaagccttccgaaaccctgtctcttacatgcacggttagcggattctccctgatcggctacgacctcaactggattagacagccgcccgggaaaggactggagtggatcggcattatctggggagatgggaccacagactataattctgccgtgaagtctcgggtgaccatttccaaagatacatctaagaaccagtttagccttaaactgtccagcgtcaccgctgccgacacagcggtgtactattgtgctcgcggcggctactggtatgccacctcttactatttcgattactgggggcaaggaacgctcgttaccgtgtccagcgcctctacaaagggcccttccgtctttcccctggctccttgcagcagatctacctccgaaagcacagccgctctggggtgtctcgtgaaggactacttccccgagcctgttaccgtgtcctggaactctggagccctgacgagcggcgtccacacatttccggcggtgcttcagtccagcgggctgtattctctctccagcgtggtcaccgttccctctagcaatttcggaacacagacctatacctgcaatgtggatcataaaccttccaacacaaaggtggacaaaacggtcgaacggaagtgttgcgtggagtgtcccccttgccccgccccgcctgttgctggcccctctgtgtttctgttccctcccaaacccaaggatacccttatgatcagccgcacacctgaggtcacctgtgtggttgtggacgtctcccacgaagatccggaggtgcagtttaattggtacgtcgacggcgtggaagttcataacgccaagacaaaacccagagaggagcaattcaatagcacctttcgggtggtctctgtgctgacggttgtgcaccaggattggctcaacgggaaggaatacaaatgcaaggtctccaataaaggactgcctagctctatcgagaagacaatttccaaaaccaagggccagccccgcgaacctcaggtgtataccctgcccccgagcagagaggaaatgacaaagaaccaagtgtccctcacctgtctggttaaagggttctacccttctgacatcgctgtcgagtgggagagcaatggacagcccgaaaacaattataagacaacgcctcccatgcttgactccgatggcagctttttcctgtacagcaaactcaccgtggacaagtcccggtggcagcaagggaacgtgttcagctgctctgtcatgcatgaggccctgcacaaccactacacacagaaatcccttagcctgtctcctggaaag

SEQ ID NO: 39283 - RNA, 642 nt, synthetic construct
  misc_feature 1..642: note = derived and/or modified sequence opt5 from Tanezumab_LightChain
  source 1..642: mol_type = other RNA
gacatccagatgacccaaagcccctcctctctgagcgcctccgtgggcgatagagtcacaattacgtgccgggcttctcagagcatctccaacaatctcaactggtaccagcagaagcctgggaaagccccgaagctgcttatttattacacctctcgcttccacagcggagttccctccagatttagcggctctgggtccggaacagacttcacctttacaatcagctctctgcaacctgaggatattgcgacctattactgtcagcaggaacatacactcccctataccttcggccaggggacgaaactggagatcaagcggaccgtggctgccccttccgtgtttatctttccccctagcgacgaacaacttaaatctggaacagcctccgtcgtgtgcctgctcaataacttctacccgcgcgaggctaaggttcagtggaaggtggataatgccctgcagagcggcaactcccaggaatctgtcaccgagcaagacagcaaagattccacatatagcctgtcttccaccctcacgctgagcaaggctgactacgagaaacacaaggtgtacgcctgtgaagttacacatcagggcctttctagccccgtgaccaaatccttcaatagaggggagtgc

SEQ ID NO: 39284 - RNA, 1353 nt, synthetic construct
  misc_feature 1..1353: note = derived and/or modified sequence opt5 from Tavolixizumab_HeavyChain
  source 1..1353: mol_type = other RNA
caggtgcaactgcaggagagcggccccgggctcgtcaagccttcccagaccctgtctcttacatgcgccgtttacggaggcagcttctcctctgggtattggaactggatcagaaaacacccgggaaagggcctggaatacattgggtatatcagctacaatggaattacgtatcataacccctccctcaaatctcggatcaccattaatcgcgacacaagcaagaaccagtactccctgcaacttaatagcgtgacccctgaggatacagctgtgtattactgtgccagatacaaatatgactacgatggcggccacgcgatggactattgggggcagggaaccctggtcacagtgtcttccgctagcaccaagggcccctctgtttttcctctcgccccctccagcaagtctacgtccgggggaaccgccgctctgggctgcctggtgaaagattacttccctgaaccggtcacagtgagctggaactccggggccctcacctctggagttcatacatttcccgctgtgctgcagagctccggcctttatagcctgtcttccgtcgtgaccgtgcctagctctagcctcggcacgcagacatacatctgtaatgtcaaccacaagccctccaataccaaagttgacaagcgggtggagcctaaatcttgcgataagacacatacctgtcccccgtgccctgcccccgaactgcttgggggacctagcgtgttcctgtttcctcccaagcccaaagacaccctcatgatctcccgcacaccggaggtcacgtgtgtggttgtggatgtcagccacgaggaccccgaagtgaagttcaactggtatgttgatggcgtggaggtccacaatgcgaaaaccaagcctcaagaggaacagtacaactctacatacagagtggtctccgtgctgaccgttctgcatcaggactggctcaatgggaaagagtataagtgcaaagtgagcaacaaggccctgcccgctcctattgaaaagacaatctctaaagccaagggacagccccgggagccgcaagtctacacccttcctccctcccgcgaagagatgacgaaaaatcaggtgagcctgacatgtctcgttaagggcttttatccttccgatattgctgtggaatgggagtctaacgggcagcccgagaacaattacaaaaccacccctcccgtcctggacagcgacggatccttctttctttattctaagctgacagtggataagagcagatggcaacagggcaacgtgttctcctgcagcgttatgcacgaagccctccataatcactacacccagaaatctctgtccctgagcccgggcaag

SEQ ID NO: 39285 - RNA, 642 nt, synthetic construct
  misc_feature 1..642: note = derived and/or modified sequence opt5 from Tavolixizumab_LightChain
  source 1..642: mol_type = other RNA
gacatccagatgacccaaagcccctcctctctgagcgcctccgtgggcgatagagtcacaattacgtgccgggcttctcaggacatcagcaactacctcaattggtatcagcagaagcctgggaaagccccgaagctgcttatttactatacctccaaactgcactctggagttcccagccgcttctccggcagcgggtctggaacagattacaccctcacaatctccagcctgcaacctgaggactttgcgacctattactgtcagcagggctctgcccttccctggacattcgggcagggaaccaaggtggaaattaaaagaacggtggctgccccttccgtctttatctttccccctagcgatgagcaactgaagtctggcaccgcttccgtggtttgcctcctgaacaatttctatccgcgggaagccaaggtgcagtggaaagtcgacaacgctctgcagagcggcaattcccaggagtctgtgacagaacaagatagcaaggactccacctacagcctctcttccacactgacccttagcaaagccgattacgagaagcataaagtttatgcgtgtgaggtgacgcaccaggggctgtctagccccgtcacaaagtccttcaaccgcggagaatgc

SEQ ID NO: 39286 - RNA, 1335 nt, synthetic construct
  misc_feature 1..1335: note = derived and/or modified sequence opt5 from Telisotuzumab_HeavyChain
  source 1..1335: mol_type = other RNA
caggtgcagctggtccagagcggcgccgaggttaagaaacccggggcttccgtgaaggtgtcttgcaaagccagcggatacatcttcaccgcgtatacaatgcactgggtcagacaggctcctggccaggggctcgaatggatgggatggattaagccgaacaatggcctggccaactacgcccaaaaatttcaggggcgggtgacgatgacccgcgacacatccatctctaccgcttatatggagcttagcagactgcggtccgatgacacagccgtttactattgtgctcgctctgaaattaccacagagttcgattactggggacagggcaccctcgtgacggtcagctccgccagcaccaagggcccctctgtgtttcctctggcgccctccagcaagtctacatccgggggaaccgccgctcttggctgcctggttaaagactatttccctgaacccgtgacagtcagctggaatagcggggccctcacctccggagtgcatacgtttcctgctgtgctgcagagctccggcctgtactctctcagctccgtcgttacagtgccgtcttcttccctggggacccaaacatacatctgtaacgtgaatcacaagcccagcaacaccaaagtcgataagagagtggagcctaaatcttgcgactgtcattgtcccccttgccccgccccggagcttctgggaggccctagcgttttcctctttccccctaagcccaaggataccctgatgatttcccggacacccgaagtgacgtgcgtcgtggttgacgtgtctcacgaggatcctgaagtcaaattcaattggtatgtggacggcgtcgaggtgcataacgcgaagaccaaaccgcgcgaggaacagtacaatagcacatatagagttgtgtccgtccttaccgtgctgcaccaggattggctcaacgggaaggagtacaaatgtaaggttagcaataaagccctgcccgctcctatcgaaaagacaatctctaaggccaaaggacagccccgggagcctcaagtgtataccctgcccccgtcccgcgaagagatgacgaagaaccaggtcagcctcacatgcctggtgaaaggcttttacccttctgacattgctgtggagtgggaatccaatgggcagcccgagaacaattataagaccacccctcccgttcttgatagcgacggatccttctttctgtactctaaactcacagtcgacaagagcagatggcaacagggcaacgtgttctcctgttctgtgatgcacgaagccctgcataaccactacacccaaaagagcctttccctgagccctggg

SEQ ID NO: 39287 - RNA, 654 nt, synthetic construct
  misc_feature 1..654: note = derived and/or modified sequence opt5 from Telisotuzumab_LightChain
  source 1..654: mol_type = other RNA
gacatcgtgatgacccagagccccgattccctggccgtctctctcggcgagagagctacaattaactgcaagagctccgaatctgttgacagctacgccaattccttcctgcactggtatcaacagaaacctgggcagccgcccaaacttctgatctaccgggcgtctacgcgcgagagcggagtgcctgatagattttccggcagcgggtctggaaccgacttcacactcaccatttccagcctgcaggctgaagatgtggccgtctattactgtcaacagtctaaggaggacccccttacatttggcgggggaaccaaggtggaaatcaaacggacagttgccgctccttccgtgttcatttttccccctagcgatgagcagctgaagtctggcaccgcctccgtcgtgtgcctcctgaacaatttctatccgcgcgaggctaaggttcagtggaaagtggacaacgccctgcaaagcggcaattcccaggaatctgtcacggagcaggatagcaaggactccacctacagcctctcttccacactgacccttagcaaagcggattatgaaaagcataaagtgtacgcctgtgaggtgacacaccaggggctgtctagccccgtcaccaagtcctttaacagaggagagtgc

SEQ ID NO: 39288 - RNA, 1335 nt, synthetic construct; identical to SEQ ID NO: 39286
  misc_feature 1..1335: note = derived and/or modified sequence opt5 from Telisotuzumab_vedotin_HeavyChain
  source 1..1335: mol_type = other RNA

SEQ ID NO: 39289 - RNA, 654 nt, synthetic construct; identical to SEQ ID NO: 39287
  misc_feature 1..654: note = derived and/or modified sequence opt5 from Telisotuzumab_vedotin_LightChain
  source 1..654: mol_type = other RNA

SEQ ID NO: 39290 - RNA, 1350 nt, synthetic construct
  misc_feature 1..1350: note = derived and/or modified sequence opt5 from Timigutuzumab_HeavyChain
  source 1..1350: mol_type = other RNA
gaggtgcagctggtcgaaagcggcgggggactcgttcagcccggcgggtccctgagactttcttgcgccgctagcggattcaacatcaaggacacctacattcactgggtgcggcaggcccctggcaaagggctggagtgggtggcgcgcatctatccgacaaatggatacacgagatatgctgattccgtcaagggccggtttaccatttctgccgacacaagcaaaaacaccgcctacctccagatgaatagcctgcgcgctgaagatacagccgtgtattactgttctagatggggcggggacggattctatgctatggattactggggccaggggacccttgttacagtgagctccgccagcaccaagggaccctctgtctttcctctggcgccctccagcaaatctacgtccggcgggaccgccgctctcggatgcctggtgaaggactacttccctgagcccgttacagtgagctggaactctggcgccctgacctccggcgtccatacatttcctgctgtgctccaaagctccgggctgtattctcttagctccgtggtcaccgttccgtcctcttccctgggaacgcagacatacatctgtaatgtgaaccacaagcccagcaataccaaagtggataagaaagtcgaacctaagtcttgcgacaaaacacatacctgtcccccttgccccgccccggagctcctgggcgggcctagcgtgttcctttttccccctaagcccaaggataccctgatgatttcccggacacccgaggttacgtgtgtggtcgtggacgtttctcacgaagatcctgaggtgaaattcaactggtatgtcgacggagtggaagtccataatgcgaagaccaaaccgcgcgaggagcagtacaacagcacatatagagtggtttccgtgctcaccgtcctgcaccaggattggctgaatggcaaggaatacaaatgcaaggtgagcaacaaagccctccccgctcctatcgagaagacaatctctaaggccaaagggcaaccccgggaacctcaggtttataccctgcccccgtcccgcgacgagcttacgaagaatcaggtgagcctgacatgtctcgtcaaaggattttacccttctgacattgctgtggaatgggagtccaacggccagcccgagaataactacaagaccacccctcccgtgctggatagcgacggctccttctttctttattctaaactgacagttgataagagcagatggcaacaggggaacgtcttctcctgctctgtgatgcacgaaggactccataatcactacacccaaaagagcctgtccctgagccctggcaaa

SEQ ID NO: 39291 - RNA, 642 nt, synthetic construct; identical to SEQ ID NO: 38952
  misc_feature 1..642: note = derived and/or modified sequence opt5 from Timigutuzumab_LightChain
  source 1..642: mol_type = other RNA

SEQ ID NO: 39292 - RNA, 1332 nt, synthetic construct; identical to SEQ ID NO: 38336
  misc_feature 1..1332: note = derived and/or modified sequence opt5 from Timolumab_HeavyChain
  source 1..1332: mol_type = other RNA

SEQ ID NO: 39293 - RNA, 642 nt, synthetic construct; identical to SEQ ID NO: 38337
  misc_feature 1..642: note = derived and/or modified sequence opt5 from Timolumab_LightChain
  source 1..642: mol_type = other RNA

SEQ ID NO: 39294 - RNA, 1347 nt, synthetic construct
  misc_feature 1..1347: note = derived and/or modified sequence opt5 from Tomuzotuximab_HeavyChain
  source 1..1347: mol_type = other RNA
caggtgcaactgaagcagagcggccccgggctcgtccagccttcccagtctctgagcattacctgcacagtttccggattctctcttacgaactacggcgtgcactgggtgagacaaagcccggggaaaggactggagtggctcggcgtcatctggtccgggggaaataccgactataacacaccctttacctctcggctgagcatcaataaggataactccaaaagccaggtgttctttaagatgaactctcttcagtccaatgacacagccatttactattgtgctcgcgccctgacctactatgattacgagttcgcgtattggggccagggcacactcgttaccgtgagcacggcttctaccaaagggccttccgtctttcccctggcccctagctctaagtccacaagcggaggcaccgccgctctggggtgcctcgtgaaggactacttccccgaacctgttacagtgtcctggaactctggagccctgaccagcggcgtccatacgtttccggctgtgcttcaatccagcgggctgtactctctctccagcgtggtcacagttccctctagctccctgggaacccagacatatatctgtaatgtgaatcacaaaccttctaacaccaaggtggataaaaaggtcgaacccaaaagctgcgacaagacccatacatgtcctccctgcccggcccctgagcttctgggcggcccctccgtgttcctctttcctcccaagcccaaagatacgctgatgattagcagaacccctgaagttacatgtgtggtcgtggacgtttctcacgaggatccggaggtgaagttcaattggtacgtcgacggggtggaagtccataacgcgaaaaccaagccccgggaggaacagtataattccacataccgcgtggttagcgtgctgaccgtcctccaccaggattggctgaacggaaaagagtataagtgcaaagtgtctaataaggcccttcctgctcccatcgagaagacgatctccaaagccaagggccaacctagagaaccccaggtttacacactgccgcctagccgggacgagctcaccaaaaaccaggtgtccctgacctgtcttgtcaaggggttttatccctctgatattgctgtggaatgggagagcaacggacaacctgaaaataactacaaaacaacaccccctgtgctggactccgacggctctttctttctctacagcaagctgaccgttgataagtcccgctggcagcaggggaatgtcttcagctgctctgtgatgcacgagggactgcataaccactatacgcagaaatccctcagcctgtctcccggcaag

SEQ ID NO: 39295 - RNA, 642 nt, synthetic construct; identical to SEQ ID NO: 38367
  misc_feature 1..642: note = derived and/or modified sequence opt5 from Tomuzotuximab_LightChain
  source 1..642: mol_type = other RNA

SEQ ID NO: 39296 - RNA, 1347 nt, synthetic construct; identical to SEQ ID NO: 39095
  misc_feature 1..1347: note = derived and/or modified sequence opt5 from Trastuzumab_duocarmazine_HeavyChain
  source 1..1347: mol_type = other RNA

SEQ ID NO: 39297 - RNA, 642 nt, synthetic construct; identical to SEQ ID NO: 38952
  misc_feature 1..642: note = derived and/or modified sequence opt5 from Trastuzumab_duocarmazine_LightChain
  source 1..642: mol_type = other RNA

SEQ ID NO: 39298 - RNA, 1368 nt, synthetic construct
  misc_feature 1..1368: note = derived and/or modified sequence opt5 from Varisacumab_HeavyChain
  source 1..1368: mol_type = other RNA
caggtgcaactggtccagagcggcgccgaggttaagaaacccggggcttccgtgaaggtgtcttgcaaagccagcggaggcaccttctcctcttacgcgatcagctgggtcagacaggctcctgggcagggactcgaatggatgggcgggtttgacccggaggatggagaaacaatttatgcccaaaagttccagggccgggtgacgatgaccgaggacacatccaccgatacagcctacatggaactgtctagccttcgctccgaggacaccgctgtttattactgtgccacaggcagaagcatggtgcgcggggtcatcattccctttaacggaatggatgtgtggggccaggggaccacggttaccgtgtcttccgctagcacaaaaggaccttctgtcttccccctggccccttccagcaagtctacctccggcgggacagcggccctcggatgcctggtgaaggactattttcccgagcctgtgaccgtcagctggaactccggcgctcttacgtctggcgttcacacattcccggccgtgctgcagagctccgggctctacagcctgtcttccgtggtcaccgtgcccagctctagcctgggaacacaaacctatatctgtaatgttaatcataaaccttccaacaccaaggtggataaaaaggtcgaacccaaatcttgcgacaagacacacacgtgtcctccctgcccggctcctgagctcctgggcgggcccagcgtgtttcttttccctcccaagcccaaagataccctgatgatttcccggacacctgaagttacctgtgtggtcgtggacgtcagccatgaggatccggaggtgaagtttaattggtacgttgacggagtggaagtccacaacgccaaaacaaagcccagagaggaacagtacaattctacctatcgggtggtttccgtgctcacggtcctgcatcaggattggcttaacggcaaagagtacaagtgcaaagtgagcaataaggcgctgcctgcccccatcgaaaagacaatctctaaagctaaggggcagcctcgcgagccccaagtgtataccctcccgccttccagagacgagctgaccaaaaaccaggttagcctgacatgtctcgtcaagggattctacccctccgacattgccgtggaatgggagtctaatggccagcctgaaaacaattataaaaccacaccccctgtgctggatagcgacggctcctttttcctttactctaagctgacggtcgataagagccggtggcaacaggggaacgtgttttcctgcagcgttatgcacgaggctctccacaatcattatacccagaaatctctgtcccttagccccggaaag

SEQ ID NO: 39299 - RNA, 642 nt, synthetic construct
  misc_feature 1..642: note = derived and/or modified sequence opt5 from Varisacumab_LightChain
  source 1..642: mol_type = other RNA
gacatcagaatgacccagagcccctcctctctgagcgcctccgtgggcgatcgggtcacaattacgtgccgcgcttctcaaagcatctcctcttacctcaactggtatcagcagaaacctgggaaagccccgaagctgcttatttacgcggctagctccctgcagagcggagttccctctagattctccggcagcgggtctggaaccgactttacactcaccatctccagcctgcaacctgaggatttcgccacatattactgtcagcagtcttattccacaccccttacctttggcgggggaaccaaagtggaaattaagcggacggtggccgctcctagcgtcttcatctttcccccttccgacgagcagctgaaatctggcaccgccagcgtggtttgcctcctgaataacttctacccgcgcgaagctaaggtgcaatggaaggtcgataatgccctgcagtccggcaacagccaggagtctgtgacagaacaggactccaaagatagcacctattctctcagctccacactgaccctttctaaggcggactacgagaaacacaaggtttacgcctgtgaggtgacgcatcaagggctgagctcccccgtcacaaagagctttaatagaggagaatgc

SEQ ID NO: 39300 - RNA, 1359 nt, synthetic construct
  misc_feature 1..1359: note = derived and/or modified sequence opt5 from Vunakizumab_HeavyChain
  source 1..1359: mol_type = other RNA
gaggtgcaactggtccaaagcggcgccgaagttaagaaacccggggcttccgtgaaggtgtcttgcaaagccagcggatacaccttcacagactatgaggtccactgggtgagacaggcgcctggccaggggctcgaatggatgggagttatcgatccgggcacgggaggagtggcttacaaccagaagtttgagggccgggtcaccatgacagccgacacctccacatctaccgcctatatggaactgcgcagccttagatccgatgacacagctgtgtactattgtacccggtactctctgttctatggcagctccccctacgccatggattactgggggcaaggaacgctcgttaccgtgagctctgcttccacaaaaggccctagcgtctttcccctggccccttcttccaagagcacctctgggggaacagcggcccttggctgcctggtgaaggactatttccccgagcctgtgaccgtctcctggaatagcggggctctcacgtccggagttcatacatttccggccgtgctgcagtctagcggcctgtactccctcagctctgtggtcaccgtgccctccagctctctgggcacacagacctatatttgtaacgttaatcacaaacctagcaacaccaaggtggataaaaaggtcgagcccaaatcctgcgacaagacacatacgtgtcctccctgcccggctcctgaacttctcgggggaccctctgtgttcctgtttcctcccaagcccaaagataccctgatgatcagccgcacacctgaggttacctgtgtggtcgtggacgtctcccacgaagatccggaggtgaagttcaattggtacgttgacggcgtggaggtccataacgccaaaacaaagcccagagaggaacagtataatagcacctaccgggtggtttctgtgcttacggtcctgcaccaagattggctcaacgggaaagaatataagtgcaaagtgtccaataaggcgctgcctgcccccattgagaagacaatcagcaaagctaagggacagcctcgcgaaccccaggtgtacaccctgccgccttctagagaggagatgaccaaaaaccaggtttccctcacatgtctggtcaagggcttttaccccagcgacattgccgtggaatgggagtccaatgggcaacctgaaaacaattataaaaccacaccccctgtgcttgactctgatgggagcttctttctgtactccaagctcacggtcgacaagtctcggtggcagcagggcaacgtgttcagctgctccgttatgcacgaggctctgcataatcactatacccagaaaagcctttctctgtcccccggcaag

SEQ ID NO: 39301 - RNA, 639 nt, synthetic construct
  misc_feature 1..639: note = derived and/or modified sequence opt5 from Vunakizumab_LightChain
  source 1..639: mol_type = other RNA
gagatcgtgctgacccagagccccgacttccaatccgtcacacctaaggaaaaagttacgattacctgctctgccagctcctctgtgaactacatgcactggtttcagcagaagccggatcagagccccaaactctggatctatagaacatccaatctggcttctggcgtgcctagccggttctccgggagcggatctggcaccgactacacacttaccattaactccctggaggccgaagatgcggctacatattactgtcaacagcgcagctcttatccctggacctttgggcagggaacgaagctcgagatcaaaagaaccgtcgccgccccttccgtgttcatttttccccctagcgacgaacagctgaagtctggcacagcttccgttgtgtgccttctgaataacttctacccgcgggaggccaaggtccaatggaaagtggataatgctctccagagcgggaactcccaggagtctgttaccgaacaggacagcaaggattccacatatagcctgtcttccaccctgacgctcagcaaagccgactacgagaagcataaagtgtacgcgtgtgaagtcacacaccaaggactgtctagccccgtgaccaagtcctttaatcgcggcgagtgc

SEQ ID NO: 39302 - RNA, 1341 nt, synthetic construct; identical to SEQ ID NO: 39205
  misc_feature 1..1341: note = derived and/or modified sequence opt5 from Xentuzumab_HeavyChain
  source 1..1341: mol_type = other RNA

SEQ ID NO: 39303 - RNA, 648 nt, synthetic construct; identical to SEQ ID NO: 39206
  misc_feature 1..648: note = derived and/or modified sequence opt5 from Xentuzumab_LightChain
  source 1..648: mol_type = other RNA

SEQ ID NO: 39304 - RNA, 726 nt, synthetic construct
  misc_feature 1..726: note = derived and/or modified sequence opt5 from anti-rabies_SO57_LightChain
  source 1..726: mol_type = other RNA
atgagcgtgcccaccatggcctgggctctgctcctgctttccctgctcacacagggcacggggtcttgggcccaaagcgcgctgacccagcctagatccgtctctggaagcccgggccagtccgttacaatctcttgcaccgggacaagctccgacattggaggctacaacttcgtgagctggtatcagcaacaccccgggaaggctcctaaacttatgatctacgatgccaccaagcggccctctggagtgcctgaccgcttttccggcagcaaatctggcaatacagcctccctgaccattagcgggctccaggctgaggatgaagccgactattactgttgctcttatgctggagattacacgcccggcgtcgtgttcgggggaggcaccaagctgacagttctggggcagcctaaagccgcgccgtccgtgaccctctttccccctagctccgaggaactgcaggccaacaaggctacacttgtctgtctgatctctgacttctatcccggagccgtgaccgttgcttggaaggccgatagctcccctgtgaaagcgggcgtcgagacgacaacccccagcaagcaatctaataacaaatacgccgcttccagctacctctctctgacaccggaacagtggaaaagccatagatcctattcttgccaggtgacccacgagggcagcaccgtggagaagacagtcgcccctacggaatgttcc

SEQ ID NO: 39305 - RNA, 1428 nt, synthetic construct
  misc_feature 1..1428: note = derived and/or modified sequence opt5 from anti-rabies_SO57_HeavyChain
  source 1..1428: mol_type = other RNA
atggactggacctggagattcctgtttgtggtcgccgctgccacaggcgttcagagccaagtgcagctcgtgcagtccggggcggaggtcaagaaacccggatctagcgtgaaggtttcctgcaaggcttctggcgggacgttcaaccggtacaccgtgaattgggtccgccaggcccctggacaaggcctggaatggatgggagggatcattccgatctttggcacagccaactatgctcagagattccagggccggcttaccattacagccgatgagagcacctccacagcttacatggaactgtctagcctccgctccgacgataccgccgtgtatttttgtgcgagagagaatctggacaacagcgggacgtactattacttctctggatggtttgatccctggggccaggggacccttgttacagtgtccagcgcctctaccaagggaccttccgtcttccccctggctcctagctctaaatccacaagcggcgggaccgccgctctcggatgcctggtgaaggactattttcccgaacctgtgacggtctcctggaactctggcgccctgacaagcggcgttcacaccttcccggcggtgctccaatccagcgggctgtactctctttccagcgtggtcacagtgccctctagctccctgggaacccagacctacatctgtaatgttaatcataagccttctaacacaaaagtggataagcgggtcgagcccaaaagctgcgacaagacgcacacctgtcctccctgcccggcccctgagctcctgggcgggccctccgtgtttcttttccctcccaaacccaaggatacactgatgattagccgcacccctgaagttacatgtgtggtcgtggacgtctctcatgaggatccggaagtgaagtttaattggtatgttgacggagtggaggtccacaacgctaaaaccaagcccagagaggaacagtacaattccacgtatcgggtggttagcgtgctcacagtcctgcatcaggattggctgaacggcaaagagtacaagtgcaaagtgtctaataaggccctccctgctcccatcgagaaaaccatctccaaggccaaggggcaacctcgcgaaccccaggtgtataccctgccgcctagcagagaagagatgaccaaaaaccaggtttcccttacatgtctggtcaagggattctacccctctgacattgccgtggagtgggaaagcaatggccaacctgagaacaactataaaacaacgccccctgtgctcgactccgatggctctttctttctgtacagcaaacttaccgtcgacaaatcccggtggcagcaggggaatgtgttcagctgctctgttatgcacgaagctctgcacaaccattacacacagaagtccctcagcctgtctcccggaaag

SEQ ID NO: 39306 - RNA, 696 nt, synthetic construct
  misc_feature 1..696: note = derived and/or modified sequence opt5 from anti-rabies_SOJB_LightChain
  source 1..696: mol_type = other RNA
atggcctggaccgtgctgctcctgggccttctgagccactgcacagggtccgtcacgtcttacgttctcacccagccccctagcgtgtccgtggctccgggaaagacagccagaatcaactgtggcgggaataacattgagtatcggtctgtccattggtaccaacagaaaagcggacaggcgcccgtggctgttatctatgacaattccgatcgcccttctggcattcccgaaagattcagcgggtccaagagcggaaacaccgccacactgaccatctctcgggtggaggccggcgacgaagctgattactattgccaggtctgggacatttccagcgatgtggtttttggcgggggaacaaaacttaccgtgctgggccaacctaaggccgctccctctgtcaccctcttccctccgtccagcgaggaactgcaggccaataaagcgacgctggtgtgtctcatctctgacttttaccccggggccgtgacagtcgcttggaaggccgattccagccctgttaaggctggagtggagaccacaaccccctccaaacagtctaacaataagtatgccgcgagctcctacctgagccttacgcctgagcagtggaaatctcaccgctcctacagctgccaagtgacacatgaaggctctaccgtcgagaagacagtggcccccaccgaatgtagc

SEQ ID NO: 39307 - RNA, 1554 nt, synthetic construct
  misc_feature 1..1554: note = derived and/or modified sequence opt5 from anti-rabies_SOJB_HeavyChain
  source 1..1554: mol_type = other RNA
atggacaccctgtgcagcacactcctgcttctgacgatcccctcctgggtgctctctcagattaccctgaaggagacaggccctacccttgtcaaaccgacacaaaccctgacactcacctgtacgttcagcgggttttccctgtctaccagcggagttggcgtggggtggatcagacagccccctggaaaggccctggaatgggtgacactcatttactgggatgacgataaacggtattccccctctctggagaaccgcgtcaccatcagaaaggacacaagcaaaaatcaggtggctcttaccatgacgaacatggatcctctggacacaggcacctactattgcgcccaccggcagcatatttccagcttcccctggtttgattcttgggggcaaggaacactcgttaccgtgtccagcgcgtctaccaagggcccttccgtcttcccgctggctccctgtagccgctctacatccggcgggacggccgcccttggatgcctggtgaaggactactttcctgaacccgttaccgtgagctggaactccggcgctctcacatctggggtccacaccttccctgccgtgctgcagagctccggactgtatagcctctcttccgtggtcacagttcccagctctagcctgggcacccagacgtacacatgtaatgtgaatcataaaccgtccaacaccaaggtggataaaagagtcgagcttaagacccctctgggggacacaacccacacatgcccccggtgtcctgaacccaaatcttgcgatacgccccctccgtgtccccgctgccctgagcccaagagctgtgacacccctcccccgtgccctagatgccccgagcctaagtcctgtgatacaccccctccctgcccgcggtgtcctgctcccgaactcctgggaggccccagcgtgtttcttttccctccgaaacccaaggacaccctgatgatctctcgcacacctgaggttacctgcgtggtcgtggacgtttcccatgaagatcccgaggtgcagtttaaatggtatgtcgacggcgtggaggtccacaatgccaagacgaaacctagagaggaacaattcaacagcacctttcgggtggtttctgtgctcacagtcctgcaccaggattggctgaatgggaaggaatacaaatgtaaggtgtccaacaaggcgctccccgcccctatcgagaaaaccattagcaagacaaaaggacagccccgcgaaccgcaggtttacaccctgcctccctccagagaggagatgacgaagaatcaagtgtctcttacatgcctggtcaaaggcttctatcctagcgacatcgctgtggaatgggagtcctctgggcagcccgaaaacaattacaacaccacaccgcctatgctcgatagcgacggatcctttttcctgtatagcaaacttaccgtggataagtctcggtggcagcaaggcaatattttctcctgtagcgttatgcatgaggccctgcacaaccgctttacccagaagtctctctccctgagccccgggaag

SEQ ID NO: 39308 - RNA, 702 nt, synthetic construct
  misc_feature 1..702: note = derived and/or modified sequence opt5 from anti-rabies_SOJA_LightChain
  source 1..702: mol_type = other RNA
atggaggcccccgctcagctcctgttcctgcttctgctctggctgcctgacaccacaggcgaaatcgtgcttacgcaaagcccggccaccctgtccctctctcccggggagagagcgacactggcttgccgggccagccagaccgcctcccgctacctggcttggtatcagcagaagcctggacaagcccccagactcctgatttacgatacatctaaccgggctaccggcatccctgcccgctttagcgggtccggatctggcacagacttcacccttagcatttccagcctggaacccgaggattttgcggtctattactgtcagcagagattcaattggccttggacgtttgggcagggaaccaaagttgagttcaagcggacagtggccgctccgtctgtgtttatctttcccccttccgacgaacaactcaaaagcggcaccgcctctgtcgtgtgcctgcttaacaatttctatccccgcgaggctaaggttcagtggaaagtggataacgccctgcagtccggcaatagccaggaatctgtcacagagcaagactccaaggatagcacctactccctctctagcacgctgacactgtccaaggcggactatgaaaaacacaaggtgtacgcctgtgaggttacccatcaggggctcagctctcctgtgacaaaatccttcaacagaggagagtgc

SEQ ID NO: 39309 - RNA, 1422 nt, synthetic construct
  misc_feature 1..1422: note = derived and/or modified sequence opt5 from anti-rabies_SOJA_HeavyChain
  source 1..1422: mol_type = other RNA
atggagttcggcctgagctggctctttctggtggccatccttaagggggtccagtgcgaagttcaactgctcgagtccggaggcgggctggtgcagcccggaggctctcttagactgagctgtgctgcctccgggttcaccttttctaactacgcgatgagctgggtgcggcaggctcctggaaaaggcctcgaatgggtctccgccatttctgccagcggccactccacatatctggctgacagcgtgaaggggcgcttcacgatctctagagataattccaaaaacaccctgtacctccagatgaatagcctgcgggccgaggacacagctgtttattactgcgccaaggatcgcgaagtgaccatgattgtcgtgcttaacggaggctttgactattgggggcaaggaacaagagttaccgtgtcttccgcgagcacaaaaggcccgtctgtcttccccctggccccttccagcaagtccacctctgggggaacggctgccctcggctgtctggtgaaggattactttcccgagcctgtgaccgtcagctggaactccggcgctcttacaagcggggttcataccttccccgccgtgctgcagtcttccggactctatagcctgtctagcgtggtcacagtgccttcctctagcctgggcacccagacgtacatctgcaatgttaatcacaaaccgtccaacacaaaggtggacaaacgggtcgagcccaagagctgtgataaaacccatacatgccctccctgtcctgcgcccgaactccttgggggaccgtctgtgtttctgttccctcccaagcctaaggacaccctgatgatttcccgcacccccgaggttacatgcgtggtcgtggatgtcagccacgaagaccccgaggtgaaatttaattggtacgttgatggcgtggaggtccataacgccaagacgaaacctagagaggaacagtataattctacctaccgggtggtttccgtgctcacagtcctgcaccaagactggcttaacgggaaggaatataaatgtaaggtgagcaataaagctctgccggcccccatcgagaagaccatctccaaggctaaaggacagcctcgcgaaccccaggtgtacacactccctccctctagagaggagatgaccaagaaccaggttagcctgacgtgcctggtcaaaggcttctatccgtccgatattgccgtggaatgggagtctaatggccaacctgaaaacaactacaagacaacaccccctgtgctcgacagcgacgggtcctttttcctgtatagcaaacttaccgtcgataagtctcggtggcagcagggaaatgtgttctcctgtagcgttatgcacgaggccctgcataaccactacacccaaaagtctctctccctgagccccggcaaa

SEQ ID NO: 39310 - RNA, 321 nt, synthetic construct
  misc_feature 1..321: note = derived and/or modified sequence opt5 from anti-rabies_LightChain
  source 1..321: mol_type = other RNA
gtgatgacccagagccccgccacactgtccctctctcctggcgagagagctacgctgagctgccgggcctcccaatctgtccgcaactaccttgcgtggtatcagcagaagccggggcaggctcccagactgctcatctacggagccagcaatcgggccaccggcattcctgctcgcttctccgggtctggaagcggcacagactttaccctgacaatctccagccttgaacccgaggatttcgccgtttattactgtcaacagagatctgactggcctctgtcctttgggcagggaaccaaactcgaaattaagcggaca

SEQ ID NO: 39311 - RNA, 333 nt, synthetic construct
  misc_feature 1..333: note = derived and/or modified sequence opt5 from anti-rabies_HeavyChain
  source 1..333: mol_type = other RNA
ggccccgcctgggaggtgcctgaaaccctgccggtccagcccctcgacagcccttccgttgctatggcctgcacaggggtgagacaagcgcccggaaagggcctggagtgggtggctgtcatctcttacgatgggagcaacaaatattacgccgactccgtgaagggacggttcacgatttctcgcgataatagcaaaaacaccctttatctgcagatgaactccctcagagccgaagacacagctgtttactattgtgccaaggattctaatagcggctcctactatgctcacgacctggggtactggggacagggcacccttgtgacagtc

SEQ ID NO: 39312 - RNA, 342 nt, synthetic construct
  misc_feature 1..342: note = derived and/or modified sequence opt5 from anti-rabies_LightChain
  source 1..342: mol_type = other RNA
gagctggtgatgacccagagccccctctccctgcctgtcacacttggccaaccggcctctatcagctgcagatcctctcagagcctgattcactccaacgggaatacgtacctcaactggttccagcagcggcccggacaatctcctcgcagactgatctataaggttagcgaccgggattccggcgtgcccgaccgctttagcgggtctggatccggcaccgatttcacacttaaaattagcagagtggaagctgaggacgtcggggtgtactattgtctgcagggaacccattggcctcggacatttggccagggcaccaagctcgaaatcaaacgcaca

SEQ ID NO: 39313 - RNA, 351 nt, synthetic construct
  misc_feature 1..351: note = derived and/or modified sequence opt5 from anti-rabies_HeavyChain
  source 1..351: mol_type = other RNA
gtggtccagcccggcagaagcctgcggctctcctgcgccgcttctgggttcacctttagctcctacgccatgcactgggttcgccaagcgcctggaaagggcctggagtgggtggctgtgatctcttatgacgggagcaataaatactatgccgattccgtcaagggaagattcacaatttctcgggacaatagcaaaaacacgctttacctgcagatgaactccctccgcgccgaagataccgctgtgtattactgtgccagagacaaggctctggccgcgcggcgcggctattactactattacgggacagatgtttggggacagggcacccttgtgacagtcagctct

SEQ ID NO: 39314 - RNA, 648 nt, synthetic construct
  misc_feature 1..648: note = derived and/or modified sequence opt5 from anti-RSV_5ITB_LightChain
  source 1..648: mol_type = other RNA
agcgacatccagatgacccaatccccctctacactgagcgcctccgtgggcgatagagtcacgattacctgccgggcttctcagagcatctcctcttggctcgcctggtaccagcagaagcctgggaaagcgccgaagctgcttatttatgacgctagctccctggagagcggagttccctctcgcttctccggcagcgggtctggaacagaatttaccctcacaatctccagcctgcaacctgatgacttcgccacctactattgtcagcagtacaacacatattcttggtggacctttggccaggggacgaaagtggatattaagagaaccgtggccgctccctccgtcttcatctttcctcccagcgacgagcaacttaaatccggaacagcctctgtggtttgcctgctcaataacttctaccctcgggaagctaaggtgcagtggaaggtcgataatgccctgcagagcggcaactcccaggagagcgtgaccgaacaagactctaaagattccacatatagcctgtctagcaccctcacgctgtccaaggcggactacgagaaacacaaggtttacgcctgtgaggtgacacatcagggcctttctagcccggtcaccaaatcctttaatcgcggggaatgc

SEQ ID NO: 39315 - RNA, 660 nt, synthetic construct
  misc_feature 1..660: note = derived and/or modified sequence opt5 from anti-RSV_5ITB_HeavyChain
  source 1..660: mol_type = other RNA
gtggagagcggcgggggactgatccagcccggcgggtccctcagactgtcttgcgccgtcagcggattcaccgtttcctctaagtacatgacatgggtgcggcaagctcctggcaaagggcttgaatgggtgagcgtcatttatggaggcggctccacgtactatgccgactctgtggttgggcgctttaccatcagcagagataactccaagaatacactgtacctccagatgaacagcctgcgggcggaggacaccgctgtgtattactgtgcctctcgccttggagtcagagccacaaccggcgatctggactattgggggcagggaacactcgtgaccgtttccagcgcttctacgaaaggcccgtccgtgttccccctggcccctagctctaagtccaccagcgggggaacagctgccctgggctgcctcgtcaaagattactttcccgaacctgtgaccgtgtcctggaactctggcgcgctgacaagcggggtccacaccttccccgccgttcttcagtccagcggactgtactctctctccagcgtggtgacggtcccttctagctccctgggcacacaaacctatatttgtaatgtgaatcataagccgtctaacacaaaggttgacaaacgggtggagcccaagagctgc

SEQ ID NO: 39316 - RNA, 639 nt, synthetic construct; identical to SEQ ID NO: 39280
  misc_feature 1..639: note = derived and/or modified sequence opt5 from anti-alpha-toxin_4U6V_LightChain
  source 1..639: mol_type = other RNA

SEQ ID NO: 39317 - RNA, 675 nt, synthetic construct
  misc_feature 1..675: note = derived and/or modified sequence opt5 from anti-alpha-toxin_4U6V_HeavyChain
  source 1..675: mol_type = other RNA
gaggtgcagctggtcgaaagcggcgggggactcgttcaacccggcgggtccctgagactttcttgcgccgctagcggattcaccttttcctctcacgacatgcattgggtgcggcaggccacaggcaaggggctggagtgggtgagcggaatcggcacggcgggcgatacctactatcctgactccgtcaaagggcgcttcacaatttctagagaaaacgctaagaatagcctctacctgcagatgaactcccttcgggccggagataccgccgtgtattactgtgctcgcgacagatatagcccgacaggccactactatgggatggatgtttggggacagggcaccacagtgaccgtctcttccgccagcacgaaagggccctctgtgtttcctctggctccctccagcaagtctacctccggaggcacagccgcgctcggctgcctggttaaagactacttccctgagcccgtgaccgtcagctggaactccggggccctgacatctggagtgcatacctttcctgctgtgctccaaagctccggcctgtacagcctttcttccgtcgttacggtgccgagctctagcctggggacacagacctatatctgtaatgtgaatcacaagccctccaacacaaaggtcgataaacgggtggaacctaagtcttgc

SEQ ID NO: 39318 - RNA, 879 nt, synthetic construct
  misc_feature 1..879: note = derived and/or modified sequence opt5 from anti-alpha-toxin_4U6V_Chain-A
  source 1..879: mol_type = other RNA
gccgacagcgatatcaacattaagaccggcacaacggacatcgggtccaataccacagtgaaaaccggagatctggtcacatacgacaaggagaacggcatgcacaaaaaggttttctattcttttattgatgacaaaaatcataacaagaagctcctggtgatcagaaccaaagggacaattgctggacagtaccgggtgtatagcgaagagggcgccaataagtccgggcttgcgtggccctctgctttcaaagtccaactgcagctccctgataacgaagtggcccagatcagcgactactatccgcgcaattccatcgataccaaggagtacatgtctacgctgacctatggatttaacggcaatgttacaggcgacgataccgggaaaattggaggccttatcggggccaacgtgagcattggacacacactgaagtacgtccagcccgacttcaagaccatcctcgaatcccctacggataaaaaggtgggctggaaagttatttttaataacatggtgaatcaaaactgggggccctacgacagagacagctggaatcctgtctatggaaaccagctgttcatgaagacacggaacggctctatgaaagctgccgataattttctggaccccaacaaggcttccagcctcctgtcttccggcttcagccctgattttgccaccgtgatcacaatggaccgcaaagcgtctaagcagcagaccaatattgatgtgatctacgagagagtccgggacgattatcaacttcattggacctccacaaactggaaggggacgaataccaaagacaagtggatcgatcgcagctccgagagatacaaaattgactgggaaaaggaggaaatgacaaac

SEQ ID NO: 39319 - RNA, 879 nt, synthetic construct; identical to SEQ ID NO: 39318
  misc_feature 1..879: note = derived and/or modified sequence opt5 from anti-alpha-toxin_4U6V_Chain-B
  source 1..879: mol_type = other RNA

SEQ ID NO: 39320 - RNA, 642 nt, synthetic construct
  misc_feature 1..642: note = derived and/or modified sequence opt5 from anti-IsdB_5D1Q_Chain-A
  source 1..642: mol_type = other RNA
gacatccagctgacccaaagcccctcctctgtgagcgcctccgtcggcgatagaattacaatcacgtgccgggcttctcaggacattagcaactgggttgcctggtaccagcagaagcctgggaaagcgccgaagctcctgatctattccgcttctagccttcaatccggagtgcccagccgcttctctggctccgggagcggaaccgattttacactgaccatttcttccctccagcctgaggacttcgccacatactattgtcagcaggccaatacctttccctggacattcggccaagggaccaaagtggaaatcaagagaacggtcgctgcccctagcgtgtttatctttcccccttctgatgagcagctgaaatccggaaccgctagcgttgtgtgccttctgaacaatttctacccgcgggaagccaaggtccagtggaaggtggacaacgcgctccagtccggcaattctcaagagagcgttacagaacaggattccaaagacagcacctattctctgtccagcacactgaccctctctaaggccgattacgagaaacacaaggtgtatgcttgtgaggtcacgcatcagggcctgagctcccccgtgacaaaatctttcaaccgcggggaatgc

SEQ ID NO: 39321 - RNA, 783 nt, synthetic construct
  misc_feature 1..783: note = derived and/or modified sequence opt5 from anti-IsdB_5D1Q_Chain-B
  source 1..783: mol_type = other RNA
caggtgcaactggtccagagcggcgccgaggttaagaaacccgcttcctctgtgaaggtgagctgccaggcctccgggggatctttcagcacccgcacaatctcctggctccggcaggcgcctggccaagggctggaatggatgggaggcatttctccgatctttggggctgccaactacgcccagcgcttccagggaagagtcacgattaccgctgacaaaagcacatccaccgcctatatggagcttacaagcctgacctctgaagatacagctgtgtactattgtgcccgggacagaccccctggcgcgcagtttgatacctggggccaagggacgctcgttaccgtgtccagcgcctctacaaagggaccctccgtcttccctctggctcccagctctaaatccaccagcggcgggacagccgctcttggatgcctggtgaaggactactttcctgagccggttaccgtgtcctggaactctggcgccctcacgagcggggtccacacattccccgcggtgctgcagtccagcggactgtattctctctccagcgtggtcaccgttccttctagctccctgggcacacagacctacatctgtaatgtgaatcataagccctctaacaccaaagtggataagaaagtcgaacctaagagctgcggcgggggatccggccaccatcaccatcaccaccatcaccatcacgggggagactataaagatcacgacggcgattacaaggaccatgatattgactacaaggatgacgacgataaa

SEQ ID NO: 39322 - RNA, 822 nt, synthetic construct
  misc_feature 1..822: note = derived and/or modified sequence opt5 from anti-IsdB_5D1Q_Chain-C
  source 1..822: mol_type = other RNA
gaggtgcagctggtcgaaagcggcgggggactcgttcaacccggcgggtccctgaccctttcttgcgccgctagcggactgatcttctccgactctacaatgcactgggtgagacaggccagcggccgggggctcgagtgggtggcgcgcattagatccaaggctaacaattacgccacgtctagcgataaatccgccaccgcttatctggccagcgtcaagggacggtttacaatctctcgcgacgattccaaagacaccacattccttgaaatgagctctctgaagattgaggataccgctgtgtactattgtatcgcctccagcacaaccggctggtacgttagagaagactttgattattggggccatgggacgctcgtgaccgtctcttccgcgagcacaaaaggaccttccgtgttcccgctggccccctctagcaagtccaccagcggcgggacagctgccctgggatgcctcgttaaggactactttcctgagcccgtgaccgtctcttggaactccggcgctctgacgagcggggtgcacacattccctgccgtgcttcagtctagcggactgtattccctctctagcgtcgttaccgtgccctccagctctctgggcacacagacctacatttgtaatgtgaaccataaaccttccaataccaaggtcgataaaaaggtggagccgaaaagctgcggcgggggatctggccaccatcaccaccatcaccatcaccaccatgggggagactacaaggatcacgacggcgattataaggaccatgacatcgattacaaagacgatgacgataag

SEQ ID NO: 39323 - RNA, 648 nt, synthetic construct
  misc_feature 1..648: note = derived and/or modified sequence opt5 from anti-IsdB_5D1Q_Chain-D
  source 1..648: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttagcatttctcgcctggagcccgaagacttcgccgtttattactgtctccactatggaacatcccctatgtacacctttggccaaggcacaaaactggagatcaagagaaccgtggctgcccccagcgtgttcatttttcctccgtctgatgaacagctgaaatccgggacggctagcgtcgtgtgcctcctgaacaatttctatccccgggaggccaaggttcagtggaaagtggacaacgcgcttcagtccggaaattctcaagagagcgtcaccgaacaggattccaaggacagcacatactctctgtccagcaccctcacactgtctaaggccgattacgagaaacataaggtgtatgcttgtgaagttacccaccagggccttagctcccctgtgacgaaatcttttaaccgcggggagtgc

SEQ ID NO: 39324 - RNA, 360 nt, synthetic construct
  misc_feature 1..360: note = derived and/or modified sequence opt5 from anti-IsdB_5D1Q_Chain-E
  source 1..360: mol_type = other RNA
cccggcaagatgaccgacctgcaggatacaaaatacgtggtctatgagagcgttgaaaacaatgagtccatgatggacacgttcgtgaagcaccctatcaaaaccgggatgctcaacggaaagaaatacatggtgatggaaacaaccaatgatgactattggaaggattttatggtcgagggccaaagagtgcggacaatttctaaggacgccaaaaacaatacccgcacaatcattttcccgtacgttgaagggaagaccctgtatgatgctatcgtgaaagtccatgtgaagacgattgactacgatggacagtatcacgttagaatcgtggacaaagaggcctttaccaaggcgaac

SEQ ID NO: 39325 - RNA, 657 nt, synthetic construct
  misc_feature 1..657: note = derived and/or modified sequence opt5 from anti-IsdB_5D1X_Chain-A
  source 1..657: mol_type = other RNA
gacatcgtgatgacccagagccccctgtccctccctgtcacactgggccaaccggcctctattagctgctcctctgctcagagccttgttcactccgatggggactcttacctgacgtggttccatcagagacccggacagagccctcggcgcctcatctataaggtgtccattagagatgccggcgtgcccgaccggtttagcgggtctggatccggcaccgatttcacactgaaaatcagccgcgtcgaggcggaagacgtgggggtttactattgtatgcaagctacccactggccttacacatttggacagggcaccaagctggagattaaaagaacagtggccgccccctctgtcttcatctttcctccgtccgatgaacagcttaagagcggcaccgcttctgtggtttgcctcctgaacaatttctatccccgggaggccaaagtgcagtggaaggtcgacaacgctctgcaatccgggaatagccaggaatccgtgacggagcaggattctaaggacagcacctactccctcagctctacactgaccctttccaaagccgattatgagaagcataaagtgtacgcgtgtgaagtcacacaccagggactgagctctcctgttaccaagagctttaaccgcggcgagtgc

SEQ ID NO: 39326 - RNA, 777 nt, synthetic construct
  misc_feature 1..777: note = derived and/or modified sequence opt5 from anti-IsdB_5D1X_Chain-B
  source 1..777: mol_type = other RNA
caggtgcaactggtccagagcggctccgaggttaagaaacccgggtctagcgtgaccctctcctgcaaggcctctggagacacattcaacacgcacacctacagctgggtgagacaggctcctggccagcggctggaatggatcgggggaattatgccgatctttgccgcgtccaaatctgctccccatcttcaagatcgcctgacaattaccgccaataaggccacaagaaccgcttatatggagctcacaagcctgacctccgacgatagcggcgtctactattgtgcccgggacgggcgcggagcccttcagtactggggccagggcacgctggtgaccgtttcttccgctagcacaaaagggccttctgtgttccccctcgcgccttccagcaagtctacctccggaggcacagccgctctggggtgcctggtcaaggattattttcccgaacctgtgaccgttagctggaactccggagccctcacgtctggcgtgcacacattcccggctgtcctgcagagctccgggctttacagcctgtcttccgtggtgaccgtccccagctctagcctcggaacacaaacctatatctgtaatgttaaccataaaccttccaataccaaggtggacaaaaaggtggagcccaaatcttgcggcggcgggagcggacaccatcaccaccatcaccatcaccaccatggcggggattacaaggaccacgatggagactacaaggatcatgacattgattataaagacgacgatgacaag

SEQ ID NO: 39327 - RNA, 822 nt, synthetic construct; identical to SEQ ID NO: 39322
  misc_feature 1..822: note = derived and/or modified sequence opt5 from anti-IsdB_5D1X_Chain-C
  source 1..822: mol_type = other RNA

SEQ ID NO: 39328 - RNA, 648 nt, synthetic construct
  misc_feature 1..648: note = derived and/or modified sequence opt5 from anti-IsdB_5D1X_Chain-D
  source 1..648: mol_type = other RNA
gagatcgtgctgacccagacacccgccacgctcagcctgacccctggcgaaagagctacacttacctgccgggcctcccaatctgtcagctcctcttacctggcgtggtatcagcagaagccggggcaggctccccgcctcctgatttacggagccagctccagagccacaggcatccctgaccggttctctgggagcggatccggcaccgattttacacttagcatttctcgcctggagcccgaagacttcgctgtttattactgtctccactatgggacctcccctatgtactttttcggaagaggcacggtgctggatatcaaacggaccgtggccgctcccagcgtctttattttccctccgtctgacgagcaactgaagtccggcacagccagcgtggtttgcctcctgaacaatttttatccccgcgaagcgaaagtgcagtggaaggtcgataacgcccttcagtctggaaattcccaggagagcgtgaccgagcaagactccaaagattctacatacagcctgtccagcaccctcacgctgtctaaggctgactacgaaaagcataaagtttatgcctgtgaggtgacacaccaggggctttccagccctgtcaccaagtctttcaacagaggcgaatgc

SEQ ID NO: 39329 - RNA, 354 nt, synthetic construct
  misc_feature 1..354: note = derived and/or modified sequence opt5 from anti-IsdB_5D1X_Chain-E
  source 1..354: mol_type = other RNA
aagatgaccgacctgcaggatacaaaatacgtggtctatgagagcgttgaaaacaatgagtccatgatggacacgttcgtgaagcaccccatcaaaaccggcatgctcaacgggaagaaatacatggtgatggaaacaaccaatgatgactattggaaggattttatggtcgagggacaaagagtgcggacaatttctaaggacgccaaaaacaatacccgcacaatcattttcccttacgttgaaggcaagaccctgtatgatgctatcgtgaaagtccatgtgaagacgattgactacgatgggcagtatcacgttagaatcgtggacaaagaggcctttaccaaggcgaac

SEQ ID NO: 39330 - RNA, 792 nt, synthetic construct
  misc_feature 1..792: note = derived and/or modified sequence opt5 from anti-IsdB_5D1Z_Chain-B
  source 1..792: mol_type = other RNA
gccgaggtgcagctggtcgaaagcggcgggggagttgtgcaacccggcgggtccctcagactgtcttgcgctgccagcggattcacctttaacaagttctggatgaattgggtgcggcaggcgcctggcaaagggcttgagtgggtcgctgacatccaggtggatggatccgaaaagaactacgttgactctgtgaaaggccgctttacaattagcagagataatggcaagaactccctgtatctccagatgaactctctgcgggccgaggacacgggggtctactattgtgcccgcggaagatacgattattggagcggctacctttccccgtgggggcaaggaaccctggtgacagttagctctgcttccaccaaaggccccagcgtgttccctctcgccccctcttccaagagcacatctgggggaaccgctgccctgggctgcctggtcaaggactattttcctgaacccgtgacagtgtcctggaatagcggcgcgctcacctccggggtccacacgttccctgccgttctgcagtctagcggactttactccctgagctctgtggtgaccgtcccgtccagctctctcggcacacagacctacatctgtaatgtgaaccataaacccagcaatacaaaggttgataaaaaggtggagcctaaatcctgcgggggaggctctgggcaccatcaccatcaccaccatcaccatcacggaggcgactataaggatcacgacggcgattacaaggaccatgatattgactataaagacgatgacgataag

SEQ ID NO: 39331 - RNA, 642 nt, synthetic construct
  misc_feature 1..642: note = derived and/or modified sequence opt5 from anti-IsdB_5D1Z_Chain-C
  source 1..642: mol_type = other RNA
gacatccagctgacccaaagcccctccttcctctctgccagcgtggctgatagagtcacaattacgtgccgggcctcccaggcggttcgctctagcctggcttggtaccagcagaagcctggcaaagccccgcaacttctgatctattccgcctctaccctcgagaacggggtgagctccagatttagcggatctggccccgggacagagttcaccctgacaatttccagccttcagcctgaagacgtgggaacctactattgtcagcagctgaatacatacccctttaccttcggccctgggacgaaggtcgaaatcaaacggaccgtggctgccccctctgtttttattttccctccgtccgatgagcaactcaagagcggaacagcttctgtggtctgcctgctgaacaatttttatccccgcgaagccaaagtgcagtggaaggttgacaacgcgctccagtccggcaatagccaggagtccgtgaccgagcaagattctaaggacagcacatactccctgagctctacccttacgctgtccaaagccgattatgaaaagcacaaagtctacgcttgtgaggtgacacatcagggcctcagctctcctgtgaccaagagcttcaacagaggggaatgc

SEQ ID NO: 39332 - RNA, 810 nt, synthetic construct
  misc_feature 1..810: note = derived and/or modified sequence opt5 from anti-IsdB_5D1Z_Chain-D
  source 1..810: mol_type = other RNA
caggtgcaactgcaggagagcggccccgggctcgtcaagccttccgaaaccctgtctcttatctgcacagttagcggaggctccatttctagctcctcttactattgggggtggatccggcagacgccggagcggaacctggaatggattggaatcatttacttcagcggcaccacatattacaatccctccctccagagccgcgtgtctatgtccctggacagaagcaccaaccggttttctcttcgcctgtccagcgtgacagccgctgataccgccatctattactgtgcgaaacctaagtctagagacagagggggacccggcgatgactatttcggcatggatgtctgggggcaaggaatcatggtgacagtttccagcgcttccaccaaaggcccttctgtgtttcccctcgcccctagctccaagagcacgtctgggggaaccgccgctctgggctgcctggtcaaagactacttcccggagcccgtgacagtttcctggaatagcggggccctcacctctggagtgcacacatttcctgctgtcctgcagagctccggcctttactctctgagctccgtggtgaccgtcccctctagctccctcggcacgcagacatatatttgtaacgttaatcataagcctagcaacaccaaggtggataaaaaggtggaacccaaatcttgcgggggaggctccgggcaccatcaccatcaccaccatcaccatcacggaggcgactacaaggatcacgacggggattataaagaccatgatatcgactacaaggacgatgacgataag

SEQ ID NO: 39333 - RNA, 810 nt, synthetic construct; identical to SEQ ID NO: 39332
  misc_feature 1..810: note = derived and/or modified sequence opt5 from anti-IsdB_5D1Z_Chain-F
  source 1..810: mol_type = other RNA

SEQ ID NO: 39334 - RNA, 792 nt, synthetic construct; identical to SEQ ID NO: 39330
  misc_feature 1..792: note = derived and/or modified sequence opt5 from anti-IsdB_5D1Z_Chain-G
  source 1..792: mol_type = other RNA

SEQ ID NO: 39335 - RNA, 642 nt, synthetic construct
  misc_feature 1..642: note = derived and/or modified sequence opt5 from anti-IsdB_5D1Z_HeavyChain
  source 1..642: mol_type = other RNA
gacatccagatgacccaaagcccctccttcctgtctgccagcgtgggcgatagagtcacaattacgtgccgggcttcccaggggatcaccacatacctcggatggtatcagcagcgccctggcaaggccccgcaactgcttatttacgcggcttctagcctgcagtccggggttccccctagattttctggaagcggctccgggaccgagttcacactcaccatcagctctctgcagcccgaagactttgccacatattactgtcagcaacttaacacctatccttacacgttcggacccggcacccggctggagattaaacgcacagtggccgctccttccgtgtttatcttcccgcccagcgatgaacagctcaagtctggcaccgcctccgtcgtgtgcctgctgaataacttttatcctagagaggctaaagttcagtggaaggtggacaatgccctccagagcgggaactctcaagaatccgtcacagagcaggatagcaaagactccacctactctctgagctccacgcttacactgagcaaggcggattacgagaagcacaaagtgtatgcctgtgaagttacccatcagggactctcttcccccgtgacaaagagcttcaatcggggcgagtgc

SEQ ID NO: 39336 - RNA, 471 nt, synthetic construct
  misc_feature 1..471: note = derived and/or modified sequence opt5 from anti-IsdB_5D1Z_Chain-I
  source 1..471: mol_type = other RNA
ggccccgccaaggctaccaacaatacataccctatcctgaaccaggagctcagagaagccattaaaaatccggcgatcaaggacaaagatcacagcgctcccaactcccggcctattgacttcgagatgaagaaaaaggatgggacgcaacagttttatcattacgcctctagcgtgaagcccgcccgcgtcatcttcaccgactccaaacctgaaattgagctgggacttcagtctggccagttttggagaaagttcgaagtttatgagggggataaaaagctgcccatcaaactcgtgagctacgacacagtgaaggattatgcttacatccggttttccgtctctaatggaaccaaggccgtgaaaattgttagctccacacacttcaacaataaggaggaaaaatatgactacaccctgatggagtttgctcaacctatctacaacagcgccgataagttcaaaaca

SEQ ID NO: 39337 - RNA, 324 nt, synthetic construct
  misc_feature 1..324: note = derived and/or modified sequence opt5 from anti-HIV_b12_LightChain
  source 1..324: mol_type = other RNA
gagatcgtgctgacccagagccccggcacactctccctgtctcctggggaaagagccacgttcagctgccggtcctctcacagcattcgctccagacgggtcgcttggtaccaacataagccgggacaggcgccccgccttgttatccacggcgtgtctaacagagccagcgggatttccgaccggtttagcggatctggctccgggaccgatttcacactgaccatcacacgcgtggagcctgaagactttgctctctattactgtcaggtctatggagccagctcttacaccttcggccagggcacaaaactggagagaaag

SEQ ID NO: 39338 - RNA, 381 nt, synthetic construct
  misc_feature 1..381: note = derived and/or modified sequence opt5 from anti-HIV_b12_HeavyChain
  source 1..381: mol_type = other RNA
caggtgcaactggagcagagcggcgccgaagtcaagaaacccggggcttccgttaaggtgtcttgccaggccagcggatacagattctcccactttaccgtgcattgggtccggcaggcgcctggccaacgcttcgagtggatggggtggatcaacccgtataatggaaacaaagaattttctgctaagttccaggacagagtgacatttacggccgataccagcgccaatacagcttacatggagctccggtccctgcgctctgccgacaccgctgtttattactgtgccagagtgggcgaatgggggtgggatgacagcccctatgataactactatatggacgtctggggaaaaggcacaaccgtgattgtttccagc

SEQ ID NO: 39339 - RNA, 633 nt, synthetic construct
  misc_feature 1..633: note = derived and/or modified sequence opt5 from anti-HIV_2G12_LightChain
  source 1..633: mol_type = other RNA
gtggtcatgacccagagcccctccacactgtctgccagcgttggcgacacgatcaccattacatgcagagcttcccaatctatcgagacctggctcgcctggtaccagcagaagcctgggaaagcgccgaagctgcttatttataaagctagcacactgaagaccggagtgccctcccggttctctggcagcgggtccggaacagaatttaccctcacgatcagcggcctgcagttcgatgactttgccacctaccactgtcaacattatgccgggtactctgctacattcggacagggcacccgcgtggagattaaaagaacagtcgccgctccttccgtgtttatctttccccctagcgatgaacagcttaagtctggcaccgcctccgttgtgtgcctgctcaacaatttctatccccgggaggcgaaggtccagtggaaagtggacaacgccctgcaaagcggaaattctcaggaatccgttacggagcaggatagcaaggactccacatactctctgagctccaccctcacactgagcaaagctgattatgagaagcacaaagtgtacgcctgtgaagtcacccatcaggggctttcttcccctgtgaccaagagcttcaaccgcggc

SEQ ID NO: 39340 - RNA, 672 nt, synthetic construct
  misc_feature 1..672: note = derived and/or modified sequence opt5 from anti-HIV_2G12_HeavyChain
  source 1..672: mol_type = other RNA
gaggtgcagctggtcgaaagcggcgggggactcgttaaggccggcgggtccctgatcctttcttgcggagtgagcaacttcagaatttccgctcacaccatgaattgggtgcggcgcgtccccggcgggggactggagtgggtggcctctatcagcacatcctctacgtacagagactatgcggatgctgttaaaggccggtttaccgtgagccgcgacgatctcgaagacttcgtctacctgcaaatgcataagatgagagtggaggatacagccatttattactgtgcccggaaaggctccgaccgccttagcgataacgacccttttgatgcttgggggccgggaaccgttgtgacagtctctcccgcctccaccaagggccctagcgtgttccccctggctccttcttccaaaagcacatctgggggaaccgccgcgctcggctgcctggtgaaggactattttcccgaacctgtcacggtttcctggaatagcggggccctgacctccggagtgcacacattcccggctgtgctccagtctagcggcctgtactcccttagctctgtcgtgaccgttccctccagctctctgggcacacagacctatatctgtaacgtgaatcataagcctagcaacacgaaagtcgataagaaagtggagcccaag

SEQ ID NO: 39341 - RNA, 642 nt, synthetic construct
  misc_feature 1..642: note = derived and/or modified sequence opt5 from anti-HIV_4E10_LightChain
  source 1..642: mol_type = other RNA
gagatcgtgctgacccagagccccggcacacaatccctctctcctggggaaagagccacgctgagctgccgggcttcccagtctgtcggaaacaataaacttgcctggtaccagcagcgcccgggccaagcgcccagactgctcatttatggggctagctcccggccttctggagttgccgaccgcttcagcggctccgggagcggaaccgattttacactgaccatctctagacttgagcccgaagacttcgccgtgtactattgtcagcagtacggccagtccctgagcacatttggccaagggaccaaagtggaggtcaagcggacagtggctgccccttctgttttcatttttcccccttccgatgaacagctcaaaagcggaaccgcttctgtggtctgcctgctgaacaatttctatccgcgcgaggccaaggtgcagtggaaagttgacaacgcgctccagtccggcaatagccaagagtccgtgacggaacaggattctaaggacagcacctactccctgagctctacacttaccctgtccaaggccgattatgagaaacacaaggtctacgcttgtgaagtgacacatcaggggctcagctctcccgtgaccaagagctttaacagaggagag

SEQ ID NO: 39342 - RNA, 684 nt, synthetic construct
  misc_feature 1..684: note = derived and/or modified sequence opt5 from anti-HIV_4E10_HeavyChain
  source 1..684: mol_type = other RNA
caggtgcaactggtccagagcggcgccgaggttaagagacccgggtcctctgtgaccgtgagctgcaaggcttccggaggctctttcagcacatacgccctctcctgggtccggcaggcgcctgggcgcggactggaatggatgggcggggtgatcccgcttctgacgattaccaactatgctcccagatttcagggacggatcacaattaccgccgaccgctctacaagcaccgcctacctcgagcttaattccctgagacctgaagatacagctgtttattactgtgcccgggagggcaccacgggctgggggtggctgggaaaacccatcggcgctttcgcccactgggggcaaggaaccctcgtgacagtcagctctgcgtccaccaaaggccctagcgtgtttcccctggccccttcttccaagagcacatctgggggaaccgctgccctgggctgcctcgttaaagactatttcccggaacccgtgacggtctcctggaacagcggcgctctgacatccggggtgcatacctttcctgccgtgcttcagtctagcggactgtactccctcagctctgtcgttacagtgccctccagctctctgggcacccagacctatatttgtaatgtgaaccacaagcctagcaatacaaaggtcgataaaaaggtggagcccaaa

SEQ ID NO: 39343 - RNA, 312 nt, synthetic construct
  misc_feature 1..312: note = derived and/or modified sequence opt5 from anti-HIV_VRC01_LightChain
  source 1..312: mol_type = other RNA
gaaatcgtgctgacccagagccccggcacactctccctgtctcctggggaaacggccattatcagctgcagaacctcccaatacggatctcttgcttggtatcagcagcggccgggccaggcgccccgcctggtgatttacagcgggtccacaagagccgctggaatccctgaccggttctctggcagccgctgggggcccgattataacctcaccatttccaatctggagagcggagactttggcgtttactattgtcaacagtacgagttctttggccaggggacaaaggtccaggtggatatcaaaaga

SEQ ID NO: 39344 - RNA, 363 nt, synthetic construct
  misc_feature 1..363: note = derived and/or modified sequence opt5 from anti-HIV_VRC01_HeavyChain
  source 1..363: mol_type = other RNA
caggtgcaactggtccagagcggcgggcagatgaagaaacccggagagtccatgagaatctcttgccgggccagcggctacgagttcattgactgtaccctcaactggatccgcctggctcctgggaagagaccggaatggatgggatggcttaaaccccggggcggggccgttaattatgcgcgccctctgcagggaagagtgacaatgacgcgggatgtgtactccgacaccgcttttctcgaactgcgctctcttacagtcgatgacaccgccgtgtatttctgcacaagaggcaagaactgtgattacaattgggactttgagcactggggccgggggacccccgttattgtgagctcc

SEQ ID NO: 39345 - RNA, 330 nt, synthetic construct
  misc_feature 1..330: note = derived and/or modified sequence opt5 from anti-HIV_PG9_LightChain
  source 1..330: mol_type = other RNA
cagagcgccctgacccaacccgcttccgtgtctggcagccctgggcagtccatcacaatttcttgcaacggaacgagcaatgacgtcggcgggtacgagtccgtttcttggtatcagcagcacccgggaaaggcccccaaagtggtgatctacgatgtcagcaagagaccttccggcgtgagcaaccggttctctgggtccaaaagcggaaataccgcgtctctcacaatttccggcctgcaagctgaagacgagggcgattattactgtaagagccttacctctacacgcagacgggtttttgggaccggaacaaaactgaccgtgctc

SEQ ID NO: 39346 - RNA, 408 nt, synthetic construct
  misc_feature 1..408: note = derived and/or modified sequence opt5 from anti-HIV_PG9_HeavyChain
  source 1..408: mol_type = other RNA
cagagactggtggagagcggcgggggagtcgttcaacccggctcctctctccggctgagctgcgccgcttccgggttcgacttttctcgccagggaatgcactgggtgagacaggcccctggccaggggcttgaatgggtggcgttcatcaagtacgatggaagcgagaaatatcatgctgactccgtctggggccggctgtctattagccgcgataactccaaggacaccctctacctgcaaatgaatagccttagagtggaagatacagccacgtatttttgtgttcgggaggccggcgggccggactaccgcaacggatataattactatgatttctacgacggctactataactaccactatatggatgtgtgggggaaaggaaccacagtcaccgtgtcttcc

SEQ ID NO: 39347 - RNA, 630 nt, synthetic construct
  misc_feature 1..630: note = derived and/or modified sequence opt5 from anti-HIV_VRC07_LightChain
  source 1..630: mol_type = other RNA
gagatcgtgctgacccagagccccggcacactctccctgtctcctggggaaacggccattatcagctgcagaacctcccaatacggatctcttgcttggtatcagcagcggccgggccaggcgccccgcctggtcatttacagcgggtccacaagagccgctggaatccctgaccggttctctggcagccgctgggggcccgattataccctcacaatttccaacctggagagcggagactttggcgtttactattgtcaacagtacgagttctttggccaggggaccaaggtccaggtggatatcaaaagaacagtggccgccccttctgtgttcatctttcccccttccgacgaacaacttaagagcggaaccgcttctgttgtgtgcctgctcaataacttctatccgcgggaagccaaagtccagtggaaggtggataatgctctgcagtccggcaacagccaggagtctgttacggagcaagactccaaagatagcacctactccctgtctagcacactcaccctgtccaaggccgactacgaaaagcacaaagtgtatgcgtgtgaggtcacacatcaggggcttcgcagccccgtgaccaagtcttttaatagaggagaatgc

SEQ ID NO: 39348 - RNA, 375 nt, synthetic construct
  misc_feature 1..375: note = derived and/or modified sequence opt5 from anti-HIV_VRC07_HeavyChain
  source 1..375: mol_type = other RNA
caggtgcaactggtccagagcggcgggcagatgaagaaacccggagagtccatgagaatctcttgccgggccagcggctacgagttcattgactgtaccctcaactggatccgcctggctcctgggaagagaccggaatggatgggatggcttaaaccccggggcggggccgttaattatgcgcgccctctgcagggaagagtgacaatgacgcgggatgtgtactccgacaccgcttttctcgaactgcgctctcttacaagcgatgacaccgccgtctatttctgcacaagaggcaagtactgtaccgcccgggattattacaactgggactttgagcactggggccaagggacacccgtgattgtttcctct

SEQ ID NO: 39349 - RNA, 315 nt, synthetic construct
  misc_feature 1..315: note = derived and/or modified sequence opt5 from anti-HIV_3BNC117_LightChain
  source 1..315: mol_type = other RNA
gacatccagatgacccaaagcccctcctctctgagcgcctccgtgggcgatacagtcacgattacctgccaggctaacgggtacctcaattggtatcagcagagacggggaaaggcccctaaactgcttatctacgacggctctaagctggaacgcggggttccgagcagattctccggacggcgctggggccaagaatataacctcacaattaataacctgcagcccgaggatatcgcgacctacttttgtcaggtgtatgagttcgtggtccctgggacaagacttgacctgaaacggaccgtggctgccccc

SEQ ID NO: 39350 - RNA, 387 nt, synthetic construct
  misc_feature 1..387: note = derived and/or modified sequence opt5 from anti-HIV_3BNC117_HeavyChain
  source 1..387: mol_type = other RNA
caggtgcaactgctccagagcggcgccgctgtcaccaagcccggggcctccgttagagtgtcttgcgaggcgagcggatacaacatccgggactatttcattcactggtggcgccaggctcctggccaggggctgcaatgggtgggatggatcaatccgaaaacaggccagcccaacaatcctagacagtttcaggggcgggtctcccttacgcgccatgcctcttgggatttcgacacctttagcttctacatggatctgaaggccctcagatccgacgatacagctgtgtatttttgtgcccggcaacgctctgactactgggatttcgacgtttggggaagcggcacccaggtgacagtctccagcgcttctaccaaaggcccc

SEQ ID NO: 39351 - RNA, 324 nt, synthetic construct
  misc_feature 1..324: note = derived and/or modified sequence opt5 from anti-HIV_10-1074_LightChain
  source 1..324: mol_type = other RNA
agctacgtgagacccctgtccgtcgccctcggcgagaccgctcggatctcttgcgggcgccaggccctgggaagcagagcggttcaatggtatcagcaccggcctggccaggctccgattcttctgatctacaacaatcaggaccgcccctccgggattcctgaaagattctctggaacacccgatatcaactttggcacgcgggccaccctcacaattagcggggtggaggccggagacgaagctgattattactgtcatatgtgggactcccgctctggcttcagctggtcctttggcggggccaccagactgacagtgctt

SEQ ID NO: 39352 - RNA, 396 nt, synthetic construct
  misc_feature 1..396: note = derived and/or modified sequence opt5 from anti-HIV_10-1074_HeavyChain
  source 1..396: mol_type = other RNA
caggtgcaactgcaggagagcggccccgggctcgtcaagccttccgaaaccctgtctgttacatgcagcgtgtccggagactctatgaacaattactattggacgtggatcagacagagcccgggcaaagggcttgagtggattggatacatctccgatcgggaatctgccacctataaccccagcctcaattcccgcgtggtcattagcagagacacatctaagaaccagctgtccctgaaacttaatagcgtgacccctgctgatacagccgtttactattgtgcgaccgctcggcgcggccaaagaatctacggggtggtctctttcggagagtttttctattactactccatggacgtgtggggcaagggcacaaccgttacggtgagctct

SEQ ID NO: 39353 - RNA, 633 nt, synthetic construct
  misc_feature 1..633: note = derived and/or modified sequence opt5 from anti-HIV_PGT121_LightChain
  source 1..633: mol_type = other RNA
agcgacatctccgtggcccccggcgagaccgctagaatttcttgcggggaaaagagcctgggatcccgggccgtccagtggtaccaacaccgcgcgggccaggctccttctctcatcatttataacaatcaggatagaccgagcgggatccccgagcggttctccggatctcctgacagcccctttggcacaacggccaccctgacaattacctccgttgaagccggggatgaggctgactactattgtcatatctgggatagccgcgtgcctacaaaatgggtgttcggaggcggcaccacacttaccgtcctggggcagcccaaggccgctccttctgtgacgctctttccgccctccagcgaagaactgcaagccaacaaagcgacccttgtttgcctgatctctgacttctaccctggagccgtgacagtcgcttggaaggccgattccagccccgtgaaagctggcgttgagaccacaaccccttctaagcagtccaataacaagtatgccgcgagctcctacctctctctgacgcccgaacagtggaaaagccacaagtcctatagctgtcaggtgacacatgaggggtctaccgtcgagaaaacagtggccccgaccgagtgctcc

SEQ ID NO: 39354 - RNA, 705 nt, synthetic construct
  misc_feature 1..705: note = derived and/or modified sequence opt5 from anti-HIV_PGT121_HeavyChain
  source 1..705: mol_type = other RNA
cagatgcaactgcaggagagcggccccgggctcgtgaagccttccgaaaccctgtctcttacatgcagcgtctccggagcctctatcagcgactcctactggtcttggattagacggagcccgggcaaagggctggagtggatcggatatgttcacaagtccggcgatacgaactacagcccctctctcaaatcccgcgtgaatctgagccttgacacctctaagaaccaggtgtccctgagcctcgtcgctgccacagcggctgattctgggaaatattactgtgccagaaccctgcatggacggcgcatttatggcatcgtggccttcaatgaatggtttacatacttctatatggacgtttggggcaacgggacccaggtgacagtctccagcgcttccaccaagggaccttctgtgtttcccctggcccctagctccaagagcacgtctggcgggaccgctgccctcggatgcctggttaaagattacttccccgagcctgtgacagtctcctggaatagcggcgcgcttacctctggggtgcacacatttccggccgtgctgcaaagctccggactctactctctgagctccgtcgttaccgtgccctctagctcccttggcacgcagacatatatttgtaacgtgaatcataagcctagcaacaccaaagtcgacaagagagtggaacccaaatcttgc

SEQ ID NO: 39355 - RNA, 657 nt, synthetic construct
  misc_feature 1..657: note = derived and/or modified sequence opt5 from anti-HIV_PGDM1400_LightChain
  source 1..657: mol_type = other RNA
gacttcgtgctgacccagagcccccactccctctctgtcacacctggcgagagcgcctccatctcttgcaagagctcccattctctgattcacggggatagaaacaattaccttgcttggtatgttcaaaaaccgggacggagcccccagctgctcatctacctggcctccagccgcgcgtctggcgtgcctgacagattttccgggagcggatctgataaggacttcacgcttaaaatttcccgggtggaaaccgaggatgtcggcacatattactgtatgcaggggcgcgaaagcccctggacctttggacagggcacaaaggtggacatcaaaagaaccgttgctgccccttctgtgttcatttttcccccttccgatgagcaactcaagagcggcacagcctccgtcgtgtgcctgctgaacaatttctatccgcgggaagctaaggttcagtggaaagtggacaacgccctgcagtctgggaatagccaggagtccgtcaccgagcaagatagcaaggactctacgtactccctcagctctaccctgacacttagcaaagctgattatgaaaagcataaagtgtacgcctgtgaggtgacccaccagggactgtcctctcccgtcacaaagagctttaaccgcggcgaatgc

SEQ ID NO: 39356 - RNA, 735 nt, synthetic construct
  misc_feature 1..735: note = derived and/or modified sequence opt5 from anti-HIV_PGDM1400_HeavyChain
  source 1..735: mol_type = other RNA
caggcccaactggtgcagagcggccccgaggtcagaaagcctgggacctccgttaaagtgtcttgcaaggctccgggaaacacactcaaaacgtacgacctgcactgggtgcggagcgtccccggccaggggcttcagtggatgggatggatctcccatgaaggcgataagaaagtgattgttgagcgcttcaaggccaaggtgaccatcgactgggatagatctacaaataccgcgtatctgcaactcagcgggctgacatccggagacaccgctgtctactattgtgccaaaggctctaagcaccggcttcgcgattacgccctgtatgacgatgacggcgctctcaactgggccgtggatgttgactacctgagcaatctggaattttgggggcagggaacagctgtgaccgtctccagcgcctctacgaaaggcccttccgtgttccccctcgcgcctagctctaagtccaccagcgggggaacagccgctctgggctgccttgtgaaagattattttcccgagcctgtcaccgtttcttggaactccggggccctgacaagcggagtgcataccttcccggctgtgctccagtcctctggcctgtacagcctttccagcgtcgtgacggttccctcttccagcctgggcacacagacctacatttgtaatgtgaaccacaagccttctaatacaaaggtcgacaaaaaggtggaacccaaaagctgcgat

SEQ ID NO: 39357 - RNA, 630 nt, synthetic construct
  misc_feature 1..630: note = derived and/or modified sequence opt5 from anti-HIV_N6_LightChain
  source 1..630: mol_type = other RNA
tacatccacgtgacccagagcccctcctctctgagcgtctccattggcgacagagttacaatcaactgccaaacgtctcagggggtgggaagcgatctccattggtatcagcacaaacctggccgggccccgaaactgcttattcatcacacctcctctgtggaggacggggtccccagccgcttctccggaagcggctttcatacatctttcaatctgaccatctccgatctccaggctgacgatattgccacatactattgtcaagtgctgcagtttttcgggagaggaagccggcttcacatcaagcgcaccgttgcggctccttctgtgtttatctttcccccttccgacgaacagctgaaaagcggcacagcctctgtcgtgtgcctcctgaacaatttctaccccagagaggccaaggttcagtggaaagtggataacgctctgcaatccggcaatagccaggaatccgtcaccgagcaggactctaaggatagcacgtattccctcagctctaccctgacactttccaaggccgactacgaaaaacacaaggtgtatgcttgtgaggtgacccatcaggggctgagctctcctgtcacaaagagcttcaaccggggagagtgc

SEQ ID NO: 39358 - RNA, 675 nt, synthetic construct
  misc_feature 1..675: note = derived and/or modified sequence opt5 from anti-HIV_N6_HeavyChain
  source 1..675: mol_type = other RNA
agagcccacctggtgcagagcggcaccgctatgaagaaacccggggcctccgtccgggtttcttgccaaacaagcggatacacgttcaccgcgcatatcctcttttggttccgccaggctcctggcagagggctggagtgggtgggatggattaagccgcagtatggcgccgtgaactttgggggaggcttccgggaccgcgtcacacttaccagagatgtgtaccgggaaatcgcctatatggacattcgcggcctgaaacccgatgacacagctgtttactattgtgccagagatcggtcctacggggactctagctgggctctcgatgcctggggacagggcaccacagtggtcgtgtccgcggcctctaccaaggggcctagcgtttttcccctggctccttccagcaaatctacgtccggaggcaccgccgctcttgggtgcctggtgaaggactatttccccgagcctgtcacagtgagctggaactctggagccctcacctccggcgtgcacacatttccggcggtcctgcaaagctctggcctgtactccctcagctccgttgtgaccgtgccctctagctccctggggacgcagacatacatctgtaatgtcaatcataagcctagcaacaccaaagtggataagaaagttgaacccaagtcttgc

SEQ ID NO: 39359 - RNA, 1080 nt, synthetic construct
  misc_feature 1..1080: note = derived and/or modified sequence opt5 from anti-HIV_N6_GChain
  source 1..1080: mol_type = other RNA
gcctgggaggacgctgataccacactgttctgcgccagcgacgcgaaggcttactccacggaaaaacacaacgtgtgggccacccatgcctgtgtccccacagatcctgacccgcaggagatccccctcgaaaatgttaccgagaactttaatatgtggaagaacaatatggtggaacaaatgcacgaggatattatctctctgtgggacgagagccttaaaccttgcgtgatgctgacaggcgggtccaccattaagcaggcttgtcccaaagtcacattcgaacctatccccattcattattgcgcccctgctggatttgccatcctcaagtgtagagatgaggacttcaacggcaccgggccgtgcaagaatgtgtctacggttcagtgtacccacggaatcaaacccgtggtcagcacacagctgcttctgaacggctccctcgcgaagggggatattgtgatccggtctgaaaatctgaccaacaatgccaaagttattatcgtgcaactgaacgagcctgtccagattgtgtgcatccgccccaataacggaggcagcggctccgggggagacattagacaggctcattgtaatgtgacacggggcaagtgggtcaacatcaccaaaaacgttaaggagcagctctggaagatctttaataaaacgacaaacattaccttcaataacacaatctttaatagccctgccgggggagatctggaaattaccacccactctttcaactgcggcggggagtttttctactgtaatacatccgacctttttaacgaaacgaatctgagcgctaaccacaccgatacaaatgagaacatcaccctccaatgccgcattaagcagatcgtgagaatgtggcagcgggtgggacaggccatgtatgcgcccccgatcgccggcaatattacatgcatctctaacattaccggcctgcttctgacgcgcgacggggtcaatgacacacatgataaagaaaacgagaccttcagacctaccggaggcgacatgcgggataactggcgctccgagctctacaagtataaagtgatcaagctgaaa

SEQ ID NO: 39360 - RNA, 645 nt, synthetic construct
  misc_feature 1..645: note = derived and/or modified sequence opt5 from anti-HIV_10E8_LightChain
  source 1..645: mol_type = other RNA
agctacgagctgacccaggaaacaggcgtgtccgtcgccctcgggagaacggttaccatcacatgccggggagactctctgcgcagccactatgcttcctggtaccaaaagaaacccggccaggcccctattcttctgttctatgggaagaacaatagaccgtctggagtgcccgatcggtttagcggctccgcgtctgggaaccgcgctagcctcaccatctccggagcccaggccgaggacgatgctgaatactattgtagctctagagacaaatccggcagccggctgtctgtgttcggcgggggaacaaaacttaccgtcctgtcccagcctaaggccgctcccagcgtgacactctttcctccctcttccgaggaactgcaagccaataaggcgaccctggtttgcctcattagcgatttctaccctggcgccgtgacggtcgcttggaaggccgactcctctccggtgaaagctggggttgagaccacaacccccagcaagcagtccaacaataaatatgccgcgagctcttacctgtcccttacacctgagcagtggaaaagccatcgctcttacagctgtcaggtgacccacgaaggatccacggtcgagaagacagtggcccccaccgaatgctct

SEQ ID NO: 39361 - RNA, 708 nt, synthetic construct
  misc_feature 1..708: note = derived and/or modified sequence opt5 from anti-HIV_10E8_HeavyChain
  source 1..708: mol_type = other RNA
gaggtgcagctggtcgaaagcggcgggggactcgttaagcccggcgggtccctgagactttcttgcagcgcctccggattcgactttgataacgcttggatgacctgggtgcggcaacctccgggcaaagggctggagtgggtgggacgcatcacaggccccggcgaagggtggtctgtcgactacgccgcgcctgtggagggaagattcacgattagccggctcaattccatcaactttctgtatcttgaaatgaataacctgcgcatggaggattctggcctctacttctgtgctagaaccgggaagtattacgacttttggagcggatatccccctggcgaggaatacttccaggattgggggcggggaacactggttaccgtgtccagcgcctctacaaaaggcccctccgtctttcctctggccccgagctctaagtccaccagcggcgggacagctgccctcggatgcctggtgaaagactatttccccgagcctgttaccgtgtcttggaatagcggcgctcttacgagcggggtccacacctttcccgccgtgctgcagtcctctggactctacagcctgtccagcgtggtcacagttccttcttccagccttggcacccagacatacatttgtaacgtgaatcataagccctctaacaccaaggtggataaacgcgtcgaaccgaagtcctgcgacaaa

SEQ ID NO: 39362 - RNA, 333 nt, synthetic construct
  misc_feature 1..333: note = derived and/or modified sequence opt5 from anti-HIV_12A12_LightChain
  source 1..333: mol_type = other RNA
gacatccagatgacccaaagcccctcctctctgagcgcctccgtgggcgatagagtcacaattacgtgccaggctgggcagggaatcggctctagcctccagtggtaccaacagaagcctgggaaagccccgaagctgcttgttcacggagcgtccaacctgcatcggggcgtgccctctcgcttcagcgggtccggatttcacaccacattcagcctcaccatttctggcctgcagagagacgattttgctacatatttctgtgccgtgcttgagtttttcggccctgggaccaaagtcgaaatcaagcggacagtggccgctccctccgtt

SEQ ID NO: 39363 - RNA, 381 nt, synthetic construct
  misc_feature 1..381: note = derived and/or modified sequence opt5 from anti-HIV_12A12_HeavyChain
  source 1..381: mol_type = other RNA
agccagcacctggtgcaatccggcacccaggtcaagaaacccggggcctctgttagaatcagctgccaggcttccggatactctttcacagactatgtgctccattggtggcggcaggcccctggccaagggctggagtggatgggatggattaagccggtgtacggcgcgcgcaactatgctagacggtttcaggggcgcatcaatttcgatagagacatttaccgggaaatcgcctttatggatcttagcggactgcgctccgacgatacggccctctatttctgtgctagagacggctctggcgatgacaccagctggcacctggatccctgggggcagggaacacttgtcattgtgtccgccgctagcaccaaaggc

SEQ ID NO: 39364 - RNA, 315 nt, synthetic construct
  misc_feature 1..315: note = derived and/or modified sequence opt5 from anti-HIV_12A21_LightChain
  source 1..315: mol_type = other RNA
gacatccagatgacccaaagcccctcctctctgagcgcctccgtgggcgatagagtcacaattaactgccaggctgggcagggaatcggctctagcctcaattggtaccagaagaaacctgggcgggccccgaagctgcttgttcacggagcgtccaacctgcaacgcggcgtgccctctagattcagcgggtccggatttcatacgaccttcacactcaccattagctctctgcagcctgacgatgtggctacatatttttgtgccgtcttccagtggtttggccccggcaccaaagtggacatcaagcggaca

SEQ ID NO: 39365 - RNA, 384 nt, synthetic construct
  misc_feature 1..384: note = derived and/or modified sequence opt5 from anti-HIV_12A21_HeavyChain
  source 1..384: mol_type = other RNA
agccagcacctggtgcaatccggcacccaggtcaagaaacccggggcctctgttagagtgagctgccaggcttccggatacacattcacgaactatatcctccattggtggcggcaggcccctggccaagggctggagtggatgggacttattaagccggtgtttggcgcggtcaattacgctcgccagttccaggggagaatccagctgacccgggacatttatcgcgaaatcgcctttctcgatctgtctggacttagaagcgacgatacagccgtgtactattgtgctcgggacgagtccggcgatgacctgaaatggcacctccatccctggggccaagggacccaggttattgtgtctcctgccagcacaaagggaccc

SEQ ID NO: 39366 - RNA, 648 nt, synthetic construct
  misc_feature 1..648: note = derived and/or modified sequence opt5 from anti-HIV_35022_LightChain
  source 1..648: mol_type = other RNA
cagagcgtgctgacccaatccgcctctgtcagcggctccctcgggcagtctgttacaatcagctgcacgggacccaactccgtgtgttgctctcacaagagcatttcctggtaccagtggcctccgggcagagctcccaccctgatcatttatgaggacaatgaacgggcccctgggatcagcccccgcttctctggatacaaatcctattggagcgcgtaccttacaatttctgatctgagacctgaggacgaaaccacatattactgttgctcctatacccataacagcggctgtgtgtttgggacaggaaccaaggtctctgtgctcggccagtccaaagctaatcccagcgttacgctgttccctccgtcctctgaggaacttcaagccaacaaggccaccctggtgtgcctcatcagcgatttttaccccggcgctgtcacagtggcctggaaagctgactccagccctgttaaggccggggtggagaccacaaccccctctaagcagtccaataacaaatacgcggccagctcttatctgagcctgacgcctgagcagtggaagtcccaccggtcttacagctgtcaggtcacacatgaaggatccaccgtggagaaaacagtggctcccaccgaatgcagc

SEQ ID NO: 39367 - RNA, 729 nt, synthetic construct
  misc_feature 1..729: note = derived and/or modified sequence opt5 from anti-HIV_35022_HeavyChain
  source 1..729: mol_type = other RNA
gagggccagctggtgcaaagcggggccgaactcaagaaacccggagcttccgtcaagatctcttgcaaaaccagcggctacagattcaacttttatcacattaattggatccggcagacagccgggcgcggacctgagtggatgggctggatttccccgtactctggggacaagaacctggcgcccgctttccaggatagagttatcatgacgaccgacacagaagtgcctgtgaccagctttacatccaccggagccgcctatatggagattcggaatcttaaattcgatgacacaggcacctacttttgtgctaagggcctgctccgcgatgggtctagcacgtggctgccctatctttggggacagggcaccctgctcacagtctccagcgcctctaccaaggggccttccgtgttccccctggctcctagctctaaatccacaagcggaggcaccgccgcgctggggtgcctcgttaaggactactttccggaacccgtgacggtctcttggaactccggagccctgacaagcggcgtgcataccttccctgctgttcttcaatcctctggcctgtatagcctctccagcgtggtcacagtgccctcttccagcctggggacccagacctacatctgtaatgtgaaccacaaaccttctaatacaaaggtcgataaaagagttgagcccaagagctgcgacaagggacttgaggtgctgtttcag

SEQ ID NO: 39368 - RNA, 648 nt, synthetic construct
  misc_feature 1..648: note = derived and/or modified sequence opt5 from anti-HIV_3BC176_LightChain
  source 1..648: mol_type = other RNA
cagagcgtgctgacccaacccgcctccgtctctgctagccctggccagtccatcacagtttcttgcacggggagcagaaacgacgtgggaggctacgatttcgtgtcctggtatcagcggcaccccgggggagtcccgaagctcattatctacgagatttctaaacgccctagcggcatcccccagagattttccgggagccggtctggaaataccgcctccctgacaattagcggccttcaagacgatgacgaagcggattattactgttgctcttatgcttcctacgaccgcctgatcttcggcgggggaaccagagtgagcgttctccggcagcctaaggccgccccctctgtgacactgtttcctccgtccagcgaggaacttcaggctaacaaagccaccctggtctgtctcatctccgatttctatcccggcgctgtgacagttgcctggaaggcggacgggtctcctgtgaaagccggagtcgagaccacgaagcccagcaagcagtccaataacaaatacgctgccagctcttacctgtccctgacccctgaacaatggaaaagccatcgctcttatagctgccaggtgacacacgagggctccaccgtggagaagacagtcgctcccaccgaatgttct

SEQ ID NO: 39369 - RNA, 699 nt, synthetic construct
  misc_feature 1..699: note = derived and/or modified sequence opt5 from anti-HIV_3BC176_HeavyChain
  source 1..699: mol_type = other RNA
gaacaggtgcaactgatgcagagcggcgcccagctcagagaccccggggattccctgaagatctcttgcaaagctagcggatacaacttcattgactatcacatccattgggtccggcttgcccctggccgcgggctggagtggatgggatggattgatccggttggcgggatcaccaagtacgcgggacagtttcaaggcagactctccctgacacgggacacgtctaccaatacacttttcctggagctcagccgcctgaccgctggcgatacagccgtgtatttttgtgccagatccatgcggcccgtggaccacgggattgattactctggactgttcgtctttcatttctggggccgcgggagcgacgtgctcgtttccagcgcttctaccaaaggaccttccgtgtttcccctggcccctagctctaagtccacaagcggcgggaccgctgcccttggatgcctggtcaaagattatttccccgaacctgtgacggtttcttggaactccggcgcgctcaccagcggcgtgcacacatttccggccgtcctgcagtcctctgggctttacagcctgtccagcgtggtgaccgtcccctcttccagcctcggaacacagacctatatctgtaatgttaaccataagccttctaatacgaaggtggacaaaaaggtggagcccaaaagctgcgat

SEQ ID NO: 39370 - RNA, 621 nt, synthetic construct
  misc_feature 1..621: note = derived and/or modified sequence opt5 from anti-HIV_3BNC55_LightChain
  source 1..621: mol_type = other RNA
gacatccagatgacccaaagcccctcctctctgagcgcctccgtgggcgataaggtcacaattacgtgccagacctctgctgggtacctcaactggtatcagcagagacggggacgcgcccctaaactgcttatgtacgacggcagcagactggttacaggggtgccgtcccggttctctggacgcagatggggcacccaatataatctcacaatcgggagcctgcagcccgaggatattgcgacctactattgtcaggtgtacgaatttttcggacctggcacacggcttgacctgaagcgcaccgtcgctgccccctccgtgtttatcttccctcccagcgatgagcagctcaaatctggcacggcctccgttgtgtgcctgctgaacaatttttatcctagagaagctaaggtccaatggaaagtggacaacgccctccagagcgggaatagccaggagtccgttaccgaacaggatagcaaggactctacatactccctgagctccacccttacactgtctaaggctgattacgagaaacacaaggtgtatgcctgtgaggtcacccatcaaggactcagctccccggtgacgaaatctttcaaccggggcgaatgc

SEQ ID NO: 39371 - RNA, 675 nt, synthetic construct
  misc_feature 1..675: note = derived and/or modified sequence opt5 from anti-HIV_3BNC55_HeavyChain
  source 1..675: mol_type = other RNA
caggtgcaactggtccagagcggcaccgccgttaagagacccggggcttccgtgcgggtgtcttgccaggccagcggatacacattcacggactattttatctactggtggcgccaggcgcctggccaagggctcgagtggctgggatggattaacccgcttacctcccagccctcttatcctagcagattccagggccggctgacactcacccgcgatacatttgacgaaatgctgtacatggatcttagagggctgcggtccgacgataccggaatctatttctgtgctcgcagacactctgactactgcgattttgacatttggggcagcggcacacagatcattgtctccagcgcctctaccaaagggccctccgtgttccctctcgcccccagctctaagtccacgagcggaggcaccgctgccctggggtgtctggttaaagattattttcctgagccggtgacagtctcttggaactccggagctctcaccagcggcgtgcatacattccccgccgttctgcaatcctctgggctttacagcctgtccagcgtggtcaccgtgccttcttccagcctcggaacgcagacatacatctgcaatgtgaatcacaagccctctaacaccaaagtcgacaagcgggttgaacctaagagctgtgataaaaca

SEQ ID NO: 39372 - RNA, 618 nt, synthetic construct
  misc_feature 1..618: note = derived and/or modified sequence opt5 from anti-HIV_3BNC60_LightChain
  source 1..618: mol_type = other RNA
gacatccagatgacccaaagcccctcctctctgagcgcccgggtgggcgatacagtcacgattacctgccaggctaacgggtacctcaattggtatcagcagcggcgcggaaaggcccctaaactgcttatctacgacggctccaagctggagagaggggttccggcgcggttctctggacgcagatggggccaagaatataacctcacaattaataacctgcagcccgaggatgtggctacctacttttgtcaggtgtatgagttcatcgtccctgggacacggcttgacctgaaacgcaccgtggccgcccccagcgtttttattttccctccctccgatgaacagctcaagtctggaacagctagcgtggtctgcctgctgaataacttttaccctagagaagccaaagtgcaatggaaggttgacaatgctctccagtccggcaacagccaggagtctgtgaccgagcaggattccaaggacagcacgtattctctgtccagcacccttacactgtctaaagccgattacgaaaagcacaaagtctacgcgtgtgaggtgacccatcaaggcctctccagcccggtgacaaagtccttcaatagaggggaatgc

SEQ ID NO: 39373 - RNA, 687 nt, synthetic construct
  misc_feature 1..687: note = derived and/or modified sequence opt5 from anti-HIV_3BNC60_HeavyChain
  source 1..687: mol_type = other RNA
caggtgcacctgagccaatccggcgccgctgtcaccaagcccggggcctctgttagagtgagctgcgaggcgtccggatacaaaatctctgaccatttcattcactggtggcggcaggctcctggccaggggctccagtgggtgggatggatcaacccgaagacaggccaacccaataaccctcgccagtttcaggggagagtcagcctgacgcggcaggcctcctgggatttcgacacctattctttttacatggatcttaaagccgtgcgcagcgacgatacagctatttatttctgtgccagacaacggtccgacttttgggatttcgacgtttggggaagcggcacccaggtgacagtctcttccgctagcaccaagggcccctctgtgtttcctctggccccctccagcaaatctacatccgggggaaccgcggccctcggctgcctggttaaggattacttccctgaaccggtgacggtcagctggaactccggggctcttacctctggagtgcatacatttcccgccgtgctgcagagctccggcctctatagcctgtcttccgtcgttaccgtgcctagctctagcctggggacacagacctacatctgtaatgtgaatcacaagccctccaacacgaaagtcgacaagcgcgtggagcctaaatcttgcgataagaca

SEQ ID NO: 39374 - RNA, 687 nt, synthetic construct
  misc_feature 1..687: note = derived and/or modified sequence opt5 from anti-HIV_3BNC60_HeavyChain
  source 1..687: mol_type = other RNA
gaggtgcacctgagccagtccggcgccgctgtcaccaagcccggggcctctgttagagtgagctgcgaagcgtccggatacaaaatctctgaccatttcattcactggtggcggcaagctcctggccaggggctccagtgggtgggatggatcaacccgaagacaggccagcccaataacgcccgccaatttcaggggagagtcagcctgacgcggcaggcctcctgggatttcgacacctattctttttacatggatcttaaagctgtgcgcagcgacgatacagccatttatttctgtgctagacagcggtccgacttttgggatttcgacgtttggggaagcggcacccaagtgacagtctcttccgccagcaccaagggcccttctgtgtttcccctggcgccttccagcaaatctacatccgggggaaccgccgctctcggctgcctggttaaggattacttccccgagcctgtgacggtcagctggaactccggggcccttacctctggagtgcatacatttccggctgtgctgcagagctccggcctctatagcctgtcttccgtcgttaccgtgcccagctctagcctggggacacagacctacatctgtaatgtgaatcacaagccttccaacacgaaagtcgacaagcgcgtggaacccaaatcttgcgataagaca

SEQ ID NO: 39375 - RNA, 648 nt, synthetic construct
  misc_feature 1..648: note = derived and/or modified sequence opt5 from anti-HIV_447-52D_LightChain
  source 1..648: mol_type = other RNA
cagagcgtgctgacccaacccccttccgtctctgccgctccgggccagaaggttacaatcagctgctccgggtctagctccaacattggaaataactacgtgctctggtatcagcagttccccggcacggcccctaaactgcttatctacgggaataacaagagaccctctggcattcctgaccggtttagcggatccaaaagcgggacctctgcgacactgggaatcaccggcctccaaacaggcgatgaggctgactatttctgtgccacctgggattccgggctgagcgccgactgggtgtttggaggcgggacaaagctcaccgtcctgtctcagcccaaagctgccccttccgtgacgcttttcccgcccagctctgaggaactgcaggctaataaggccaccctggtttgcctcatttccgatttttaccctggagcggtgacagtcgcctggaaggctgacagctcccccgtgaaagccggcgttgaaaccacaaccccttctaagcagagcaacaataaatatgctgcctccagctacctgtctcttacgcccgagcaatggaagtcccaccgcagctattcttgtcaggtgacacatgaagggagcaccgtcgagaaaacagtggcgccgaccgagtgc

SEQ ID NO: 39376 - RNA, 693 nt, synthetic construct
  misc_feature 1..693: note = derived and/or modified sequence opt5 from anti-HIV_447-52D_HeavyChain
  source 1..693: mol_type = other RNA
gaggtgcagctggtcgaaagcggcgggggactcgttaagcccggcgggtccctgagacttacctgcgtggcctctggattcacatttagcgacgtgtggctgaactgggtccggcaagctcctggcaaagggctcgagtgggtgggacgcatcaagtccagaacggatggcggcaccacagactacgccgcgtctgttaaagggcggttcaccattagccgcgatgactccaagaatacactgtatcttcagatgaactctctgaaaaccgaagatacagctgtgtacagctgtaccacggacggatttatcatgattagaggcgtctccgaggattattactattactatatggacgtgtgggggaagggaaccacagttaccgtgagctctgcctccacaaagggcccgagcgtcttccccctcgccccttgctctcggtccaccagcgggggaacggctgccctgggctgtctggtgaaagattactttcccgaacctgtgacagtctcttggaactccggcgctctcaccagcggggttcacacattccccgccgtgctgcagtcctctggactttacagcctgtccagcgtggtcaccgtgccttcttccagcctcggcacccagacatatacgtgcaatgttaatcataagccgtctaacaccaaagtggacaagcgcgtcgagctg

SEQ ID NO: 39377 - RNA, 645 nt, synthetic construct
  misc_feature 1..645: note = derived and/or modified sequence opt5 from anti-HIV_447-52D_LightChain
  source 1..645: mol_type = other RNA
cagagcgtgctgacccaacccccttccgtctctgccgctccgggccagaaggttacaatcagctgctccgggtctagctccaacattggaaataactacgtgctctggtatcagcagttccccggcacggcccctaaactgcttatctacgggaataacaagagaccctctggcattcctgaccggtttagcggatccaaaagcgggacctctgcgacactgggaatcaccggcctccaaacaggcgatgaggctgactatttctgtgccacctgggattccgggctgagcgccgactgggtgtttggaggcgggacaaagctcaccgtcctgtctcagcccaaagctgccccttccgtgacgcttttcccgcccagctctgaggaactgcaggctaataaggccaccctggtttgcctcatttccgatttttaccctggagcggtgacagtcgcctggaaggctgacagctcccccgtgaaagccggcgttgaaaccacaaccccttctaagcagagcaacaataaatatgctgcctccagctacctgtctcttacgcccgagcaatggaagtcccaccgcagctattcttgtcaggtgacacatgaagggagcaccgtcgagaaaacagtggcgccgaccgag

SEQ ID NO: 39378 - RNA, 705 nt, synthetic construct
  misc_feature 1..705: note = derived and/or modified sequence opt5 from anti-HIV_447-52D_HeavyChain
  source 1..705: mol_type = other RNA
gaggtgcagctggtcgaaagcggcgggggactcgttaagcccggcgggtccctgagacttacctgcgtggcctctggattcacatttagcgacgtgtggctgaactgggtccggcaagctcctggcaaagggctcgagtgggtgggacgcatcaagtccagaacggatggcggcaccacagactacgccgcgtctgttaaagggcggttcaccattagccgcgatgactccaagaatacactgtatcttcagatgaactctctgaaaaccgaagatacagctgtgtacagctgtaccacggacggatttatcatgattagaggcgtctccgaggattattactattactatatggacgtgtgggggaagggaaccacagttaccgtgagctctgcctccacaaagggcccgagcgtcttccccctcgccccttgctctcggtccaccagcgggggaacggctgccctgggctgtctggtgaaagattactttcccgaacctgtgacagtctcttggaactccggcgctctcaccagcggggttcacacattccccgccgtgctgcagtcctctggactttacagcctgtccagcgtggtcaccgtgccttcttccagcctcggcacccagacatatacgtgcaatgttaatcataagccgtctaacaccaaagtggacaagcgcgtcgagctgaaaacacccacc

SEQ ID NO: 39379 - RNA, 624 nt, synthetic construct
  misc_feature 1..624: note = derived and/or modified sequence opt5 from anti-HIV_5H/I1-BMV-D5_LightChain
  source 1..624: mol_type = other RNA
gacatccagatgacccaaagcccctccacactgtctgccagcattggcgatagagtgacgattacctgccgggcttccgaggggatctaccactggctcgcctggtatcagcagaagcctggaaaagcgccgaagctgcttatctacaaggcttctagcctggcctccggcgccccctctcgcttcagcgggtccggaagcggcacagactttaccctcacaatttcttccctgcagcctgatgacttcgctacctattactgtcaacagtatagcaactacccccttacatttgggggaggcaccaaactggaaatcaaaagaacggtcgccgctccttctgttttcatctttcccccttccgatgagcagctcaagagcggcaccgcctctgtggtgtgcctgctgaataacttctatccgcgggaagcgaaggtccagtggaaagtggacaatgccctccaatccgggaacagccaggagtccgttacagaacaggattctaaggacagcacctactccctgagctctacacttaccctgtccaaagctgattacgagaagcataaagtgtatgcctgtgaggtcacgcaccagggactcagctctcccgtgacaaagagc

SEQ ID NO: 39380 - RNA, 651 nt, synthetic construct
  misc_feature 1..651: note = derived and/or modified sequence opt5 from anti-HIV_5H/I1-BMV-D5_HeavyChain
  source 1..651: mol_type = other RNA
caggtgcaactggtccagagcggcgccgaggttagaaagcccggggcttccgtgaaagtgtcttgcaaggccagcggagacaccttctcctcttacgcgatcagctgggtccggcaggctcctggccaggggctcgaatggatgggaggcattatcccgatttttgggacagccaactatgcccaggctttccaaggacgcgtgacgatcaccgccaatgagtccacatctaccgcttacatggaactgagctcccttagaagcgaggatacagccatttattactgtgcgcgggacaaccccaccctgctcggctctgattattggggcgccgggacactggttaccgtgtccagcgcttctacgaaaggaccttccgtctttccccttgccccttgcagccgctctacctccggcgggacagctgccctgggatgtctcgtgaaggactacttccccgaacctgttaccgtgagctggaactccggcgcgctgacatctggggtccacacctttccggccgtgctgcagagctccggactctatagcctgtcttccgtggtcacggttcccagctctagccttggcacacagacctacatctgcaatgtgaatcataaaccttccaacacaaaggtggataagagagtc

SEQ ID NO: 39381 - RNA, 657 nt, synthetic construct
  misc_feature 1..657: note = derived and/or modified sequence opt5 from anti-HIV_5H/I1-BMV-D5_A-Chain
  source 1..657: mol_type = other RNA
atgcagctgctcagcggcatcgtgcaacagcagaacaatctgcttagagccattgaggctcagcaacacctcctgcagctgaccgtctgggggatcaagcagcttcaggcccggattctggcgggaggctccgggggacacacaacgtggatggaatgggaccgcgagatcaacaattacacctctctcattcacagcctgatcgaagagtcccaaaaccagcaggagaaaaatgaacaggagctgctcgaaggctctagcgggggacaactgctttccggcatcgttcagcagcaaaacaatctgctcagagctattgaggcccagcagcatctgcttcagctgacagtgtggggcatcaagcaactccaggcccggattctggctgggggatctggcgggcacaccacatggatggaatgggatcgcgagatcaacaattataccagcctgattcattccctcatcgaggaaagccagaaccagcaagagaaaaatgaacaggagctgcttgaaggatcttccggcgggcagctgctcagcggaattgtgcagcaacagaacaatctgcttagagccatcgaggctcagcagcatctgctccaactgacagtctggggcatcaagcagctgcaggcccggattctcgcgggcggg

SEQ ID NO: 39382 - RNA, 390 nt, synthetic construct
  misc_feature 1..390: note = derived and/or modified sequence opt5 from anti-HIV_8ANC195_LightChain
  source 1..390: mol_type = other RNA
gacatccagatgacccaaagcccctccacactgtctgccagcattggcgatacggtgagaatctcctgccgggcttctcagagcattaccgggaactgggtcgcctggtaccagcagcgccctggaaaggcgccgagactcctgatctatcggggcgctgcccttctcgggggagttccctcccgcttctctggcagcgccgctgggacagactttaccctgacaattggaaatctgcaagccgaggatttcggcaccttttactgtcagcagtatgacacataccctggcaccttcgggcagggaacgaaagtggaagtgaagagaaccgtcgctgccccctccgtgtttatcttccctcccagcgatgagcaacttaaatctggcaca

SEQ ID NO: 39383 - RNA, 423 nt, synthetic construct
  misc_feature 1..423: note = derived and/or modified sequence opt5 from anti-HIV_8ANC195_HeavyChain
  source 1..423: mol_type = other RNA
cagatccacctggtgcaaagcggcaccgaggtcaagaaacccgggtcctctgttacagtgagctgcaaggcctacggagtgaacacgttcggcctctatgctgtcaattgggtgagacaggcccctgggcagtccctggaatacattggacagatctggcggtggaaatctagcgcgtcccatcactttcgcggcagagttcttatttctgctgtggacctgaccgggagctccccgcccatcagctctctcgagattaagaacctgacatccgatgacaccgccgtctatttctgtacaaccacaagcacctacgataaatggtctggacttcatcacgacggcgtgatggccttttccagctggggccaagggacgctgatctctgtttccgctgccagcaccaagggaccttccgtgttc

SEQ ID NO: 39384 - RNA, 333 nt, synthetic construct
  misc_feature 1..333: note = derived and/or modified sequence opt5 from anti-HIV_CAP256-VRC26.01_LightChain
  source 1..333: mol_type = other RNA
cagagcgtgctgacccaacccccttccgtctctgccgctccgggccagaaggttacaatcagctgctccgggtctagctccacgattggaaacaattacgtgtcttggtatagactcctgcccggcaccgcccctaaacttctgatctacaagaacgacaatcggcccagcgggattcctgatcgcttctccggaagcaaatctggcacatccgcgaccctcgggatcagcggactgcagacaggcgacgaggctgattattactgtggcacctgggacacatctctttccgggggaggcgtgtttgggaccggaacgaaggtcaccgtgctg

SEQ ID NO: 39385 - RNA, 432 nt, synthetic construct
  misc_feature 1..432: note = derived and/or modified sequence opt5 from anti-HIV_CAP256-VRC26.01_HeavyChain
  source 1..432: mol_type = other RNA
gaggtgcaggtcgttgaaagcggcgggggagtggtgcaacccggcagatccctgcggctctcttgcaccgccagcgggttcacattttccaacttcgctatgggatgggtccgccaggcccctggcaaggggctggagtgggtggcgtttatctctagcgacggatccaataaaaactacggcgattctgttaagggcagattcacgattagccgggacaattccaaaaacaccgtgtttcttcagatgaatagcctgcgcgtcgaagatacagctctctattactgtgccaaggacgtgggggattataaatctgacgagtggggaaccgaatactatgatatctccattagctacccgatccaggaccccagagccatggttggcgctttcgatctgtgggggcaaggaacaatggtgaccgtctctcct

SEQ ID NO: 39386 - RNA, 324 nt, synthetic construct
  misc_feature 1..324: note = derived and/or modified sequence opt5 from anti-HIV_CAP256-VRC26.02_LightChain
  source 1..324: mol_type = other RNA
cagagcgtgctgacccaacccccttccgtctctgccgctccgggccagaaggttacaatcagctgctccgggtctaacagcaatattggaaacaaagacgtgtcctggtaccagcagatccccgccacggcgcctaagctcctgatttatgagaataacaaaagaccctctggcatcagcgatcggttctccgggagcaagtctggaacctccgctacacttgccattaccggcctgcaaacaggggacgaagccgattactattgtgctacctgggacggacgcgtgagcgtcatcggcacaggcaccaatgtgatcgttctc

SEQ ID NO: 39387 - RNA, 432 nt, synthetic construct
  misc_feature 1..432: note = derived and/or modified sequence opt5 from anti-HIV_CAP256-VRC26.02_HeavyChain
  source 1..432: mol_type = other RNA
gaggtgcagctggtcgaaagcggcgggggagttgtgcaacccggcagatccctccggctgtcttgcgccgctagccagttctcctttgggaactacggaatgcactgggtgcgccaggcccctggcaaggggcttgagtgggtcgcggctatctctttcgccggaaccaaaacaaattatgccgacagcgtgaagggcagatttacgatttcccgggataactctaaaaataccgtttacctgcagatgaacagcctccgcgctgaagacacagccctgtatttctgtgctaaggatatcagagagtacgaatgcgagtattggacctccgactactatgattttggccggccgcaaccctgtattgacagccgcggggtggtcggaacattcgatgtgtggggccaggggaccatggttacagtgtcttcc

SEQ ID NO: 39388 - RNA, 333 nt, synthetic construct
  misc_feature 1..333: note = derived and/or modified sequence opt5 from anti-HIV_CAP256-VRC26.03_LightChain
  source 1..333: mol_type = other RNA
cagagcgtgctgacccaacccccttccgtctctgccgctccgggccagaaggttacaatcagctgctccgggtctagctccaacattggaaataacttcgtgtcttggtaccagcagagacccggcacggcccctaaaatcctcatttatgagaataacaagcggcccagcgaaacccctgaccgcttttccgggagcaaatctggaacatccgcgaccctggctatcacaggccttcaaaccgccgatgaggccgaatactattgtgctacatggagcgcctctctgtccagcgctagagtgttcgggaccggaacgcggattaccgtcctc

SEQ ID NO: 39389 - RNA, 432 nt, synthetic construct
  misc_feature 1..432: note = derived and/or modified sequence opt5 from anti-HIV_CAP256-VRC26.03_HeavyChain
  source 1..432: mol_type = other RNA
gaggtgcagctggtcgaaagcggcgggggagttgtgcaacccggcaagtccctcagactgtcttgcgccgctagccggttctcctttaatcgctacgggatgcactgggtgagacaggcccctggaaaaggccttgagtgggtcgcggctatctcttatgacgggaccgataagtaccatgccgacaaagtgtggggacggttcacaattagccgcgataattccaagaacacgctgtatctccagatgaactctctgagagccgaagacaccgctctttactattgtgccaaagatctgcgggaggacgaatgcgaggagtggtggagcgattactatgactttggcaagcagctcccgtgtcgcaagtccagaggcgttgctgggatcttcgatggatggggccaagggacaatggtgaccgtcagctct

SEQ ID NO: 39390 - RNA, 333 nt, synthetic construct
  misc_feature 1..333: note = derived and/or modified sequence opt5 from anti-HIV_CAP256-VRC26.04_LightChain
  source 1..333: mol_type = other RNA
cagcccgtgctgacccaacctccgagcgtctccgccgctcccggccagaaggttacaatctcttgcagcgggtcctctagcaacattggaaataacttcgtgtcctggtaccagcagagacctggcacggccccctctctcctgatctatgagaccaataaacggcctagcgggattcccgaccgcttttccggaagcaagtctgcgacatccgctacccttgccatcacaggcctgcaaaccggggatgaagccgactactattgtgctacatgggccgctagcctcacctctgccagagtgttcggaacgggcaccaaagtcattgtgtcc

SEQ ID NO: 39391 - RNA, 432 nt, synthetic construct
  misc_feature 1..432: note = derived and/or modified sequence opt5 from anti-HIV_CAP256-VRC26.04_HeavyChain
  source 1..432: mol_type = other RNA
gaggtgcagctggtcgaaagcggcgggggagttgtgcaacccggcaagtccctcagactgtcttgcgccgctagccagttctcctttaatcggtacgggatgcactgggtgcgccaggcccctggaaaaggccttgagtgggtcgcggctatctcttatgacgggaccgataagtaccatgccgacaaagtgtggggaagattcacaattagccgggataattccaagaacacgctgtatctccagatgaactctctgcgcgccgaagacaccgctctttactattgtgccaaagatctgagagaggacgaatgcgaggagtggtggagcgattactatgactttggcaagcaactcccgtgtcggaagtcccgcggcgttgctgggatcttcgataaatggggacagggcacaatggtgattgtcagctct

SEQ ID NO: 39392 - RNA, 324 nt, synthetic construct
  misc_feature 1..324: note = derived and/or modified sequence opt5 from anti-HIV_CAP256-VRC26.05_LightChain
  source 1..324: mol_type = other RNA
cagagcgccctgacccaacccccttccgtgtctgctgccccgggccagaaggtcacaatcagctgctccgggaacattggaaataactacgtttcttggtatcaacaggtgcccggcacggcgcctaaactcctgatctacgagaataacaagagacccagcgggattcctgaccggttctccggatctaaaagcggcacctccgctacacttgtgatcaccgggctgcagacaggagatgaagccgacttttattgtggcacctggggcgggagcctccgcacaggaggcgtcctggggaccggaacgagagtgaccgttctt

SEQ ID NO: 39393 - RNA, 432 nt, synthetic construct
  misc_feature 1..432: note = derived and/or modified sequence opt5 from anti-HIV_CAP256-VRC26.05_HeavyChain
  source 1..432: mol_type = other RNA
gaggtgcagctggtcgaaagcggcgggggagttgtgcaacccggcagatccctccggctgtcttgcgccgctagccacttctccctttctagctacgggatgcattgggtgcgccaggcccctggaaagggcctggagtgggtcaccgggatctcctttgcgggaacaaaaacgtattacggcgactctgtgagaggccggttcaccgttagccgcgatatttccaagaacacactctttctgcagatgaatagccttagaccggacgataccgctatgtattactgtgcccgggaccagcgctattacgaatgcgaggaatgggcctctgattattacgacttcgggagagagcaaccctgtctggatcctcggggagtggtcggcatctttgacctctgggggcagggaacaatggtgaccgtttccagc

SEQ ID NO: 39394 - RNA, 324 nt, synthetic construct
  misc_feature 1..324: note = derived and/or modified sequence opt5 from anti-HIV_CAP256-VRC26.06_LightChain
  source 1..324: mol_type = other RNA
cagagcgtgctgacccaacccccttccgtctctgccgctccgggccagaaggttacaatcagctgctccgggtctacgagcaaaattggacagaactccgtgtcttggtaccagcaactccccggcaccgcccctaagctgcttatctatgagaatgacagacggcccagcgggacacctgatcgcttctccggaagcaaatctggcacctccgcgacactggctattaccgggctccagacaggagacgaagccgagtactattgtgaaacctgggatggcagcggcggggtgtttggaacgggcaccaaggtcacagtgctg

SEQ ID NO: 39395 - RNA, 435 nt, synthetic construct
  misc_feature 1..435: note = derived and/or modified sequence opt5 from anti-HIV_CAP256-VRC26.06_HeavyChain
  source 1..435: mol_type = other RNA
gaggtgcagctgatcgaaagcggcgggggagtcgttcaacccggcagatccctccggctgtcttgcggggccagcggattctcctttaacaattacggcatgcactgggtgcgccaggctcctgggaagggacttgagtgggtggccggcatttctttcgcgggcatcaaaaagtattacgggaccagcgtcaaaggaagatttacaatttcccgggacaactctaagaataacttctatctgcagatgaatagcctccgcgtggaagatacggctctgtactattgtgccagagaccttcgggagctggaatgcgaggagtggaccctctacaactattacgattttggctcccgcgggccgtgtgttgaccccagaggagtggccggcagcttcgatgtctgggggcagggaacaatggtgaccgtttcttcc

SEQ ID NO: 39396 - RNA, 333 nt, synthetic construct
  misc_feature 1..333: note = derived and/or modified sequence opt5 from anti-HIV_CAP256-VRC26.07_LightChain
  source 1..333: mol_type = other RNA
caggccgtgctgacccaaccccctagcgtctccgctgccccgggccagaacgttacaatctcttgcagcgggtccggatctaatattggcaacaatttcgtgagctggtaccagcagagacccgggacggcgcctaagctcctgatctatgagtccaacaaacggccctctggcattcctgaccgctttagcggatccaagagcgggacctctgctacacttgccatcaccggactgcaaacaggcgatgaagcctactattactgtgctacctgggccgctagactcaattccgcccgggtgttcggcacagggaccatggtcacggtgctg

SEQ ID NO: 39397 - RNA, 432 nt, synthetic construct
  misc_feature 1..432: note = derived and/or modified sequence opt5 from anti-HIV_CAP256-VRC26.07_HeavyChain
  source 1..432: mol_type = other RNA
gaggtgcagctggtcgaaagcggcgggggagttgtgcaacccggcagatccctccggctgtcttgcgtggggagccagttctcctttaaccgctacggaatgcactgggtcagacaggcccctggcaaggggcttgagtgggtggctggaatctctttcgacggcaccgatcggtatcatgccgacaatgtttggggccgctttacaattagcagagataactccaaaaatacgctgtacctccagatgtctagcctgcgggcggaagacaccgctctttattactgtgccaaggatctgcgcgaggacgaatgcgaggagtggtggtccgattattacgacttcgggaaaaagctcccgtgtagaaaaagccggggagtggccggcgtctttgataagtgggggcaaggaacaatggtgaccgtttcttcc

SEQ ID NO: 39398 - RNA, 333 nt, synthetic construct
  misc_feature 1..333: note = derived and/or modified sequence opt5 from anti-HIV_CAP256-VRC26.08_LightChain
  source 1..333: mol_type = other RNA
cagagcgccctgacccaacccccttccgtgtctgctgccccgggccagaaggtcacaatcagctgctccgggaactctagcaatattggaaacaatttcgtttcctggtaccaacaggtgcccggcacggcgcctaaactcctgctttatgagacctacagacggccctctgggatccctgaccgctttagcggatccaagagcggcacatctgctaccctggccattacagggctccagaccggagatgaagccgactattactgtacagtgtggggcgtcagaaaaggcgtgggggctgttttcggaaccggcacgaaggtgaccgtcctg

SEQ ID NO: 39399 - RNA, 438 nt, synthetic construct
  misc_feature 1..438: note = derived and/or modified sequence opt5 from anti-HIV_CAP256-VRC26.08_HeavyChain
  source 1..438: mol_type = other RNA
gaggtgcagctggtcgaaagcggcgggggagttgtgcaacccggcagatccctcaccctgtcttgcgccgctagccagttcacattttccaactacgggatgcactgggtgcggcaggcccctggaaagggccttgagtgggtcgcgtctgtgagcaatgacgggacgaaaaagtatcatggagattccgtttggggccgcttcaccatctctagagacaacagcaaaaatacactgtttctccagatgtccagcctgcgggctgaagataccgccgtgtacttctgtgtccgcgaccaaagagaggatgaatgcgaggagtggtggtctgactattacgattttggccgggaacttccgtgtcgcaagttcagagggctgggactcgccggcatttttgacatctgggggcacggaacaatggtgaccgtttccagc

SEQ ID NO: 39400 - RNA, 333 nt, synthetic construct
  misc_feature 1..333: note = derived and/or modified sequence opt5 from anti-HIV_CAP256-VRC26.09_LightChain
  source 1..333: mol_type = other RNA
cagagcgccctgacccaacccccttccgtgtctgctgccccgggccagaaggtcacaatcagctgctccgggaactctagcaatattggaaacaatttcgtttcctggtaccagcagctccccggcacggcgcctaaactgcttatctatgagaacaatagacggccctctgggattcctgaccgctttagcggatccaagagcggcacctctgctacactggccatctccgggctccaaaccggagatgaagccgactactggtgtgctgtgtggggcgtgagacggggcgccggggctgtcttcggagccggcacaaaagtgaccgttctg

SEQ ID NO: 39401 - RNA, 438 nt, synthetic construct
  misc_feature 1..438: note = derived and/or modified sequence opt5 from anti-HIV_CAP256-VRC26.09_HeavyChain
  source 1..438: mol_type = other RNA
gaggtgcagctggtcgaaagcggcgggggagttgtgcaacccggcagatccctcaccctgtcttgcgccgctagccagttcaactttgccaattacgggatgcactgggtgcggcaggcgcctggaaagggccttgagtgggtcgcttccatctctaacgacgggacgaaaaagtatcatgaagagagcgtgtggggacgcttcacaatttccaaagataattctaagagcaccctgtttctccagatgaactccctgagaatcgaagacacagccctttacttctgtgttaaagatcaacgggaggacgagtgcgaagagtggtggagcgattattacgactttggccgcgaactgccgtgtagaaagtctcggggcctcgggctggccggaattttcgatatgtggggccacgggaccatggtgacagtctccagc

SEQ ID NO: 39402 - RNA, 333 nt, synthetic construct
  misc_feature 1..333: note = derived and/or modified sequence opt5 from anti-HIV_CAP256-VRC26.10_LightChain
  source 1..333: mol_type = other RNA
cagagcgtgctgacccaacccccttccgtctctgccgctccgggccagaaggttacaatcagctgctccgggtctagctccaacattggagacaattacgtgtcttggtatcagcacctccccggcacggcccctaaactgcttatctacgagaacaccagacggcccagcgggattcctgatcgcttctccggaagcaagtctggcacatccgcgaccctggctatcacagggctccagaccggagacgaagccgattattactgtggcacatgggacgtgagacccaatcggggcgccgtctttgggaccggaacgaaagtgaccgttctg

SEQ ID NO: 39403 - RNA, 432 nt, synthetic construct
  misc_feature 1..432: note = derived and/or modified sequence opt5 from anti-HIV_CAP256-VRC26.10_HeavyChain
  source 1..432: mol_type = other RNA
caggccatcctggtggagagcggcgggggagtcgttcaacccggcagatccctccggctgtcttgcgctgccagccagttcaccttttccgggcacggacttcattgggtgcgccaggcgcctggcaaggggctggaatgggtggcttctattagcttcgccggaacaaaaatggactacgccgattccgtcaagggcagatttgctatctctcgggacaacagcaaaaatacgctctatctgcagatgaactcccttcgcgtggaggataccgccctgtactattgtgctaaggacatgagagaatacgagtgcgaatattggacaagcgattactatgacttcggccggccgcaaccctgtattgatcgcagaggggttgtgggaatctttgacatgtggggccaggggaccatggtcacagtgtctacc

SEQ ID NO: 39404 - RNA, 321 nt, synthetic construct
  misc_feature 1..321: note = derived and/or modified sequence opt5 from anti-HIV_CAP256-VRC26.11_LightChain
  source 1..321: mol_type = other RNA
cagagcgtgctgacccaacccccttccgtctctgccgctccgggccagaacgttacaatcagctgctccgggcccccttctcacattgagaagaatgacgtgagctggtaccagagactccccggaatggcccctaaaatggtgatctatgaatccaagcggcgccccctgggcattcctgtcagattctctgcgagccggtccgggagctctgctacgcttgtgatcaccggactgcagacagccgatgaggccgactactattgtggcacctgggatgggcgcatgaactttggaacaggcaccacagtttccgtgctc

SEQ ID NO: 39405 - RNA, 429 nt, synthetic construct
  misc_feature 1..429: note = derived and/or modified sequence opt5 from anti-HIV_CAP256-VRC26.11_HeavyChain
  source 1..429: mol_type = other RNA
gaggtgcagctggtcgaaagcggcgggggagttgtgccccctggcaagtccctcaccctgtcttgcgtggccagcagattcacattttccgctttcgggatgcactgggtccggcaagccccgggaaaaggccttgagtgggtggcgtctatcagctttgctgggattaagaaatactatgccgactccgttaagggacgcttctctatcagcagagataactccaatacgctgtttctccagatgaacggcctgcggggcgaagacaccgggctttaccattgtgtgaaagatatgcgcgagctggaatgcgaggagtgggccagcgactattacgatttcggaaagccccagccttgtctcgacagacggggcgtctctgggatttccgcttggtggggacccggcacaatggtgaccgttagctct

SEQ ID NO: 39406 - RNA, 321 nt, synthetic construct
  misc_feature 1..321: note = derived and/or modified sequence opt5 from anti-HIV_CAP256-VRC26.12_LightChain
  source 1..321: mol_type = other RNA
cagagcgtgctgacccaacccccttccgtctctacagccccgggccagacggttaccgtgagctgctccgggggaacatctaacaccggcaataacttcgtgagctggtaccagcacctccccgggacagctcctaagctgcttatctatgagaataacaaaagacccctgggagtccctgaccggttttccggcgccaagtctgggaccagcgcgacactcgctattaccggactgcagacgggcgatgaaggcgactactattgtgccacctggtccgggagccttaatatcggaacaggcaccaaagtgtctgttctg

SEQ ID NO: 39407 - RNA, 432 nt, synthetic construct
  misc_feature 1..432: note = derived and/or modified sequence opt5 from anti-HIV_CAP256-VRC26.12_HeavyChain
  source 1..432: mol_type = other RNA
gaggtgcagctggtccaaagcggcgggggagttgtgcagcccggcagatccctccggctgtcttgcgccgctccttacttcgaatttgggcgctatggattccactgggtgagacaggccccgggcaaggggcttgagtgggtcgcgagcatctcctttgctggacgggactactatcattctcccagcgtgtggggccgcttcaccatttccagagataactctaaaaatacactgtacctccagatgaacagcctgcggatcgaagacacggccctttatttttgtgcccgcgatctgagagagtccgaatgcgaggagtgggaaagcgactactatgatttcggcaagaaagggccttgtgttaagccccggggagtggctggcgggctcgacctgtggggacaaggcaccatggtcattgtgtcttcc

SEQ ID NO: 39408 - RNA, 333 nt, synthetic construct
  misc_feature 1..333: note = derived and/or modified sequence opt5 from anti-HIV_CAP256-VRC26.I1_LightChain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacaagaataacgagagacccagcgggattcctgaccggttctccggaagcaaatctggcacctccgcgacactggggatcaccggactccaaacaggcgatgaagctgactattactgtggcacctgggatacaagcctgtctgccgggggagtgtttggcaccgggacgaaggtcaccgtgctt

SEQ ID NO: 39409 - RNA, 432 nt, synthetic construct
  misc_feature 1..432: note = derived and/or modified sequence opt5 from anti-HIV_CAP256-VRC26.I1_HeavyChain
  source 1..432: mol_type = other RNA
caggtgcaactggtcgagagcggcgggggagttgtgcagcccggcagatccctccggctgtcttgcgccgctagcgggttcaccttttccaactacgccatggactgggtgcgccaggcgcctggaaagggccttgaatgggtcgctgtgatctctagcgatgggtccaataaaaactatgccgactctgttaagggaagattcacaattagccgggataattccaaaaacacgctgtacctccagatgaatagcctgcgcgccgaggacaccgctgtgtattactgtgccaaggatcttggcgaaaacaaaaatgacgagtgggctacagattattacgacctgtctatcgcctatccggtccaagatcccagagcggtggttggcgcctttgacatttgggggcagggaaccatggtgacagtctccagc

SEQ ID NO: 39410 - RNA, 333 nt, synthetic construct
  misc_feature 1..333: note = derived and/or modified sequence opt5 from anti-HIV_CAP256-VRC26.I2_LightChain
  source 1..333: mol_type = other RNA
cagagcgtgctgacccaacccccttccgtctctgccgctccgggccagaaggttacaatcagctgctccgggtctagctccacgattggaaacaattacgtgtcttggtatcagctcctgcccggcaccgcccctaaacttctgatctacaagaacgacaaaagacccagcgggattcctgatcggttctccggaagcaagtctggcacatccgcgaccctcgggatcacaggactgcagaccggcgacgaggctgattattactgtggcacatgggacaccagcctttctgccgggggagtgtttggcacggggaccaaagtcacagtgctg

SEQ ID NO: 39411 - RNA, 432 nt, synthetic construct
  misc_feature 1..432: note = derived and/or modified sequence opt5 from anti-HIV_CAP256-VRC26.I2_HeavyChain
  source 1..432: mol_type = other RNA
caggtgcaactggtcgagagcggcgggggagttgtgcagcccggcagatccctccggctgtcttgcgccgctagcgggttcaccttttccaacttcgccatgggatgggtgcgccaggcgcctggcaaggggcttgaatgggtcgcttttatctctagcgacggatccaataaaaactacggcgattctgtgaagggcagattcacaattagccgggacaattccaaaaacacgctgtttctccagatgaatagcctgcgcgccgaggataccgccctttattactgtgctaaggacgttggggaatataaatctgatgagtgggccacagactactatgatctgtccatcgcttacccgattcaagaccccagagccatggtgggagcgttcgatatctggggccaggggaccatggtcacagtgagctct

SEQ ID NO: 39412 - RNA, 333 nt, synthetic construct
  misc_feature 1..333: note = derived and/or modified sequence opt5 from anti-HIV_CAP256-VRC26.UCA_LightChain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgagaataacaagagacccagcgggattcctgaccggttctccggaagcaaatctggcacctccgcgacactggggatcaccggactccaaacaggcgatgaagctgactattactgtggcacctgggatagctctctgtccgccgggggagtgtttggcacagggaccaaggtcacggtgctt

SEQ ID NO: 39413 - RNA, 432 nt, synthetic construct
  misc_feature 1..432: note = derived and/or modified sequence opt5 from anti-HIV_CAP256-VRC26.UCA_HeavyChain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatcagctatgacggatccaacaaatactatgctgattctgttaagggcagattcacaattagccgggacaattccaaaaacacgctgtacctccagatgaatagcctgcgcgccgaggataccgccgtgtattactgtgctaaggaccttggcgaatctgagaacgaagagtgggccacagattattacgacttttccatcgggtacccgggacaagatcccagaggcgtcgtgggggctttcgacatttggggacagggcaccatggttacagtgagctct

SEQ ID NO: 39414 - RNA, 324 nt, synthetic construct
  misc_feature 1..324: note = derived and/or modified sequence opt5 from anti-HIV_CH01_LightChain
  source 1..324: mol_type = other RNA
gagatcgtgctggcccagagccccggcaccctctccctgtctcctggggaaagagctacacttagctgccgggcctcccacaacgtccatccgaagtacttcgcgtggtatcaacagaaacccggacagtctcctcgcctgctcatttacggcgggagcacgagagctgccggaatccccggcaagttttccgggtctggaagcggcaccgacttcacactgaccatttcccgggttgatcctgaggactttgccgtgtattactgtcagcaatatggcgggagcccctacacattcggacagggcaccaaagtggaaatcaag

SEQ ID NO: 39415 - RNA, 399 nt, synthetic construct
  misc_feature 1..399: note = derived and/or modified sequence opt5 from anti-HIV_CH01_HeavyChain
  source 1..399: mol_type = other RNA
gaggtgcagctggtcgaaagcggcgccaacgttgtgagacccgggggatccctccggctgtcttgcaaggctagcggcttcatctttgagaatttcgggttttcctgggtgcgccaagcccctggaaaaggccttcagtgggtcgcggggctgaactggaatggaggcgacaccagatacgctgattctgtgaagggccggttccgcatgagcagagacaactcccggaattttgtttatctcgatatggacaaagtgggggtcgatgacacagccttctactattgtgcccgcggaacggattacaccattgacgatgctggcatccactatcaggggtctggaacattttggtacttcgacctgtggggcagagggacccttgtgagcgtttccagc

SEQ ID NO: 39416 - RNA, 324 nt, synthetic construct
  misc_feature 1..324: note = derived and/or modified sequence opt5 from anti-HIV_CH02_LightChain
  source 1..324: mol_type = other RNA
gagatcgtgctgacccagagccccgccacactctccgtctctcctggcgaaagagctacgctgagctgccgggcctcccaaaacgttcacccgcgctacttcgcgtggtatcagcagaagagagggcagtctccccggcttctgattcatagcggatccacccgcgctgccggcatcgccgacagattttctgggggaggcagcgggatgcacttcacactcaccattacacgggtggagcctgaagattttgctgtgtacttctgtcaacagtatggaggctccccctacacctttggccaggggacacgcgtcgagctgaga

SEQ ID NO: 39417 - RNA, 399 nt, synthetic construct
  misc_feature 1..399: note = derived and/or modified sequence opt5 from anti-HIV_CH02_HeavyChain
  source 1..399: mol_type = other RNA
gaggtgcagctggtcgaaagcggcgggtccgttgtgagacccggaggctctctccggctgagctgccgcgcctccgggttcatctttgagaactacggacttacctgggtgagacaagtccctggcaaggggctgcactgggtgtctggaatgaattggaacggcggcgacacacggtatgctgatagcgttcgcgggagattctccatgtctcgggacaatagcaacaatattgcctacctccagatgaacaatctgcgcgtggaagatacggcgctttattactgtgctagaggaaccgactatacaatcgatgaccagggccggttttaccaggggtccggaaccttctggtattttgatttctggggccgcgggacactggtcaccgtgagctct

SEQ ID NO: 39418 - RNA, 324 nt, synthetic construct
  misc_feature 1..324: note = derived and/or modified sequence opt5 from anti-HIV_CH03_LightChain
  source 1..324: mol_type = other RNA
gagatcgtgctgacccagagccccgccacactctccctgtctcctggcgaaagagctacgcttagctgccgggcctcccaatctgtccacccgaagtacttcgcgtggtatcagcagaaacccgggcagagccctcgcctgctcatttactccggatctaccagagctgccggcatcgccgaccggtttagcgggggaggctccgggattcatttcacactgaccatcacacgcgttgagcccgaagattttgctgtgtatttctgtcaacagtacggaggcagcccttatacctttggccaggggacaaaggtggagcttaga

SEQ ID NO: 39419 - RNA, 399 nt, synthetic construct
  misc_feature 1..399: note = derived and/or modified sequence opt5 from anti-HIV_CH03_HeavyChain
  source 1..399: mol_type = other RNA
gaggtgcagctggtcgaaagcggcgggggagttgtgagacccggcgggtccctccggctgtcttgcgccgctagcggattcatttttgagaactacggccttacctgggtgcgccaagtccctgggaagggactgcactgggtgtccggcatgaattggaacggcggggacacaagatatgccgattctgttcggggacgcttcagcatgtccagagacaattctaacaatattgcgtacctccagatgaaaaacctgcgggtggatgacacggctctttattactgtgcccgcggcaccgattatacaatcgacgatcaggggatcttttacaagggaagcggcaccttctggtattttgacctgtgggggagaggaacactcgtcaccgtgtccagc

SEQ ID NO: 39420 - RNA, 324 nt, synthetic construct
  misc_feature 1..324: note = derived and/or modified sequence opt5 from anti-HIV_CH04_LightChain
  source 1..324: mol_type = other RNA
gagatcgtgctgacccagagccccgacacactctccctgtctcctggcgaaagagccacgcttagctgccgggcttcccaatctgtccacagccgctacttcgcctggtatcagcataagccggggcagccccctagactgctcatttacggaggctccacccgggcgacagggatccccaaccgcttttctgctggaggcagcgggacccagttcacactgaccgttaatagacttgaggccgaagattttgccgtgtattactgtcaacagtatggacggtccccttacacattcggccagggcaccaaagtggagattcgc

SEQ ID NO: 39421 - RNA, 399 nt, synthetic construct
  misc_feature 1..399: note = derived and/or modified sequence opt5 from anti-HIV_CH04_HeavyChain
  source 1..399: mol_type = other RNA
gaggtgcagctggtcgaaagcggcgggggactcatcagacccggcgggtccctgcggctttcttgcaagggaagcggcttcatttttgagaacttcgggtttggatgggttcgccaaggccctggcaaagggctggaatgggtgtccggaaccaattggaacggcggggactctagatacggagatagcgtgaagggccggttcacaatctcccgcgacaattctaacaattttgtctatctccagatgaacagcctgagaccggaggatacggccatttactattgtgctcgggggaccgactacacaatcgatgaccagggcattcgctatcagggatccggcaccttctggtactttgatgtgtgggggagaggaacacttgttaccgtgagctct

SEQ ID NO: 39422 - RNA, 627 nt, synthetic construct
  misc_feature 1..627: note = derived and/or modified sequence opt5 from anti-HIV_CH103_LightChain
  source 1..627: mol_type = other RNA
tacgagctgacccagccccctagcgtgtccgtctctccgggccaaacagccacgatcacgtgcagcggggcttccacaaacgtttgttggtatcaggtgaagcccggacagtctcctgaagtggtcattttcgagaattacaaaagacccagcggcatccctgaccggttttccgggtctaagagcggatccaccgccacactcaccattcgcggcacacaggcgatcgatgaagctgactattactgccaagtgtgggatagcttctctacctttgttttcgggtccggaacccaggtgaccgtcctgagacagcccaaagccaaccctacagtgaccctttttccgcccagctctgaggaactgcaggccaataaggctacactcgtttgtctgatttccgacttctatcctggcgccgtgaccgtcgcttggaaagccgatagctctcccgtgaaggcgggcgtggagacgacaaccccttccaagcaaagcaacaataaatacgccgcttcctcttatcttagcctgacacccgagcagtggaagtcccaccggagctactcttgccaggtcacccatgaagggtccaccgttgagaaaacagtggccccgacggaatgtagc

SEQ ID NO: 39423 - RNA, 678 nt, synthetic construct
  misc_feature 1..678: note = derived and/or modified sequence opt5 from anti-HIV_CH103_HeavyChain
  source 1..678: mol_type = other RNA
caggtgcaactgcaggagagcggccccggggtcgttaagtcctctgaaaccctcagcctgacatgcacggtgtccggaggctctatgggagggacctactggagctggcttagactgtcccctggcaaagggctcgagtggatcggatatattttccacacaggcgaaaccaactactctccgagcctgaagggccgggtgtccatcagcgtcgacacatctgaggatcagttttcccttcgcctgagaagcgtgaccgccgctgacacagccgtttatttctgtgcgtctctcccccgggggcagctggtgaatgcttactttcgcaactggggaagaggctccctggtcagcgtgaccgccgcctctacgaaagggccttccgttttccccctcgctcctagctccaagtctaccagcggaggcacagccgctctggggtgccttgtgaaagattattttcccgaacctgtcaccgtgtcctggaatagcggagccctgacatctggcgtgcataccttcccggcggtcctccaatccagcggcctgtactctcttagctccgttgtgacggtgccctctagctccctggggacacagacctatatttgtaacgtcaatcacaagcctagcaacacaaaggtggacaaaaaggttgagcccaaatcttgcgataag

SEQ ID NO: 39424 - RNA, 321 nt, synthetic construct
  misc_feature 1..321: note = derived and/or modified sequence opt5 from anti-HIV_M66.6_LightChain
  source 1..321: mol_type = other RNA
gacatccagctgacccaaagcccctcctctctcagcgcctccgtgggcgatagagtcacaattacgtgccgggcttctcagagcatcgggtcctacctgaactggtatcagcagaagcctggaaaagccccgaaacttctgatttacgcggcttctaccctccaaagcggcgttccctcccgcttcagcgggtctggatccggcacagactttaccctgacaatcagctctcttcagcctgaggattccgccacctattactgtcagcagagctattctacacccttcacctttgggcctggaacgaaggtggacattaga

SEQ ID NO: 39425 - RNA, 390 nt, synthetic construct
  misc_feature 1..390: note = derived and/or modified sequence opt5 from anti-HIV_M66.6_HeavyChain
  source 1..390: mol_type = other RNA
caggtgcaactggtccagagcggcgccgaggttaagaaacccggggaatccctcaagatctcttgcaaagtgagcggatacaacttcgcttccgagtggattggctgggtgagacagatgcctgggaagggactggaatggatgggcatcatttatccgggggactctgataccaaatacagcccctcctttcagggacaagtcatcatttctgccgacaagagcatcaatacagcgtatcttcagtggtccagcctgaaggcttctgatacggccatctactattgtgcccggcagaaccactacggctccggcagctatttctaccgcaccgcttactattacgccatggacgtgtgggggcagggaacaaccgttacagtgtcttcc

SEQ ID NO: 39426 - RNA, 327 nt, synthetic construct
  misc_feature 1..327: note = derived and/or modified sequence opt5 from anti-HIV_NIH45-46_LightChain
  source 1..327: mol_type = other RNA
gaaatcgtgctgacccagagccccgccacactctccctgtctcctggcgaaacggctattatcagctgcagaacctcccaatctgggagccttgcctggtaccagcagcggccgggacaggcgccccgcctggtcatttattccggctctacaagagctgccgggatccctgaccggttcagcggatcccgctggggcgccgattacaacctcagcatttctaatctggagtccggggactttggagtttattactgtcaacagtatgagttctttggccagggcaccaaggtccaggtggatatcaaaagaacagtggctgccccc

SEQ ID NO: 39427 - RNA, 399 nt, synthetic construct
  misc_feature 1..399: note = derived and/or modified sequence opt5 from anti-HIV_NIH45-46_HeavyChain
  source 1..399: mol_type = other RNA
caggtgcggctgagccaatccggcgggcagatgaagaaacccggagagtctatgcggctcagctgccgcgcctccggctacgagttcctgaactgtcctatcaattggattagacttgctccggggcggcgccccgaatggatgggatggctgaagcctagaggcggggccgtcaactatgcgcggaaatttcagggacgcgttaccatgacaagagacgtgtactctgatacggctttcctcgaactgcggagccttacctccgacgatacagccgtgtatttttgcacccgcggcaagtactgtacagccagagactattacaattgggatttcgagcactggggcagaggggctcccgtcaccgtgtctagcgcctccacaaaaggacctagcgtt

SEQ ID NO: 39428 - RNA, 330 nt, synthetic construct
  misc_feature 1..330: note = derived and/or modified sequence opt5 from anti-HIV_PG16_LightChain
  source 1..330: mol_type = other RNA
cagagcgccctgacccaacccgcttccgtgtctggcagccctgggcagacaatcacgatttcctgcaacggaacctctagcgacgtcggcgggttcgattccgtttcttggtaccagcagagcccgggaaaggcccccaaagtgatggtgtttgacgtctcccacagacctagcggcatctctaatcggttctccgggagcaagtctggaaacacagcgtccctcaccattagcggcctgcatatcgaggatgaaggcgactatttttgttcttcccttacagatcgcagccacagaattttcgggggaggcaccaaagtgacagttctg

SEQ ID NO: 39429 - RNA, 411 nt, synthetic construct
  misc_feature 1..411: note = derived and/or modified sequence opt5 from anti-HIV_PG16_HeavyChain
  source 1..411: mol_type = other RNA
caggagcaactggtggaaagcggcgggggagtcgttcagcccggcgggtccctcagactgtcttgccttgccagcggattcacctttcacaagtacggcatgcattgggtgcggcaggctcctgggaaaggactggagtgggtggccctcatctccgacgatggcatgcgcaagtatcactctgacagcatgtggggcagagtcacaatttcccgggataactctaaaaatacgctgtaccttcagttcagctccctgaaggtggaagacaccgcgatgtttttctgtgctcgcgaggccgggggaccgatctggcatgatgacgttaaatattacgattttaacgacggctattacaattatcactacatggatgtgtgggggaagggaacaaccgtcacagtgagctct

SEQ ID NO: 39430 - RNA, 315 nt, synthetic construct
  misc_feature 1..315: note = derived and/or modified sequence opt5 from anti-HIV_PGT122_LightChain
  source 1..315: mol_type = other RNA
accttcgtgagcgtcgcccccggccagacagctagaatcacgtgcggggaggaatccctgggatctcggagcgttatttggtaccaacagcgccctggccaggccccgtccctcatcatttataacaataacgacagaccctctgggatccctgatcggtttagcggatcccccggctctaccttcgggacaaccgcgacactgaccattacaagcgtggaggctggagacgaagccgattactattgtcacatctgggactcccgcagacctaccaattgggtgtttggcgagggcacgacccttatcgtcctg

SEQ ID NO: 39431 - RNA, 396 nt, synthetic construct
  misc_feature 1..396: note = derived and/or modified sequence opt5 from anti-HIV_PGT122_HeavyChain
  source 1..396: mol_type = other RNA
caggtgcatctgcaagagagcggccccgggctcgtcaagccttccgaaaccctgtctcttacatgcaacgttagcggaacgctggtgagagacaattactggtcctggatccggcagccgctcggcaaacagcccgagtggattgggtatgtgcacgattctggagacaccaactacaatcctagcctgaagtcccgcgtccacctttctctggataaaagcaagaacctcgtgtccctgagactgacaggcgttaccgccgctgacagcgccatctattactgtgcgacaaccaaacatgggcggcgcatttatggagtggtcgctttcaaggaatggtttacatacttctatatggatgtgtggggcaagggcacctctgttacggtgtccagc

SEQ ID NO: 39432 - RNA, 315 nt, synthetic construct
  misc_feature 1..315: note = derived and/or modified sequence opt5 from anti-HIV_PGT123_LightChain
  source 1..315: mol_type = other RNA
agctccatgtctgtgagccccggcgagaccgccaagatctcctgcgggaaagaatctattggaagcagagctgtccagtggtaccaacagaagcctggccagccgccctccctgatcatttataacaatcaggaccggcctgccggggttcccgagcgcttctctgcgagccctgattttagacccggaacaacggctaccctcacaatcaccaacgtggacgccgaagatgaggccgactactattgtcacatttacgatgctcggggcgggacaaattgggtgttcgaccgcggaaccacactgaccgtcctt

SEQ ID NO: 39433 - RNA, 396 nt, synthetic construct
  misc_feature 1..396: note = derived and/or modified sequence opt5 from anti-HIV_PGT123_HeavyChain
  source 1..396: mol_type = other RNA
cagctgcacctccaagagagcggccccgggctggtgaagcctccggagaccctttccctgacatgctctgtcagcggagcctccatcaacgacgcttactggtcttggattagacagagccccggcaaacggcctgagtgggttgggtatgtgcatcactccggagatacgaattacaacccctctctcaagcgcagagtgaccttcagcctggacacagccaaaaatgaagtctcccttaagctggtggatctcaccgcggctgacagcgccacatatttttgtgcccgggctctgcatggcaaacgcatctacgggattgttgccctgggagaactcttcacctatttttacatggatgtgtggggcaagggcacagctgtcaccgtgtcttcc

SEQ ID NO: 39434 - RNA, 315 nt, synthetic construct
  misc_feature 1..315: note = derived and/or modified sequence opt5 from anti-HIV_PGT125_LightChain
  source 1..315: mol_type = other RNA
cagagcgccctgacccaacccccttccgcttctggcagcccggggcagtccatcacaatttcttgcaacggaacggccaccaatttcgtgagctggtaccagcagtttcccgacaaggcgcctaaactcatcattttcggcgtcgataagagaccccctggggttcccgaccggttttccggatctcgcagcggcacaaccgcttccctgacagtgagcagacttcaaaccgatgacgaggccgtgtattactgtgggtctctggtcggaaactgggatgtgatcttcggcggcgggacaaccctcacggttctg

SEQ ID NO: 39435 - RNA, 411 nt, synthetic construct
  misc_feature 1..411: note = derived and/or modified sequence opt5 from anti-HIV_PGT125_HeavyChain
  source 1..411: mol_type = other RNA
cagagccaactgcaggagtccggccccagactcgtggaagcctctgagaccctgagccttacatgcaacgtctccggggaatctacgggagcttgtacctacttctggggctgggttcggcaggcccctgggaagggactggagtggatcggcagcctctcccactgccagtctttttgggggagcggatggacattccataatccgtccctgaaaagccgccttaccatttctctggacacacccaagaaccaagtgtttctcaaactgacctccctgacagcggctgataccgccacgtattactgtgccagattcgacggcgaagtgctcgtctataatcactggcctaagcccgcttgggtggatctgtggggccgggggatccctgttaccgtgacagtcagctct

SEQ ID NO: 39436 - RNA, 315 nt, synthetic construct
  misc_feature 1..315: note = derived and/or modified sequence opt5 from anti-HIV_PGT126_LightChain
  source 1..315: mol_type = other RNA
cagagcgccctgacccaacccccttccgcttctggcagcccggggcagtccatctctattagctgcacaggaacgtccaacagattcgtgtcttggtaccagcagcaccccggcaaggcccctaaactcgtcatctatggggttaataagcggcccagcggagtgcctgaccgcttttccggcagcaaatctgggaacaccgcgtccctgacagtgagcggacttcaaaccgatgacgaggctgtctactattgttcttccctggtgggcaattgggatgttattttcggcgggggaacaaagctcaccgtgctg

SEQ ID NO: 39437 - RNA, 411 nt, synthetic construct
  misc_feature 1..411: note = derived and/or modified sequence opt5 from anti-HIV_PGT126_HeavyChain
  source 1..411: mol_type = other RNA
cagccccaactgcaggagagcggccctgggctcgtggaagcctccgagaccctgtctcttacatgcacggtcagcggagactccaccgctgcctgtgattacttctggggctgggttagacagccgcccgggaagggactggaatggatcggcgggctctctcactgcgcgggatattacaacacaggctggacctatcataatcctagcctgaaatcccggcttacaatttctctggacacccccaagaaccaggtgtttctcaaactgaatagcgtgacagctgccgataccgccatctactattgtgctcgcttcgacggcgaggtcctggtgtaccacgattggcctaagcccgcctgggttgacctctgggggagaggaacgctggtgaccgtcacagtgtccagc

SEQ ID NO: 39438 - RNA, 315 nt, synthetic construct
  misc_feature 1..315: note = derived and/or modified sequence opt5 from anti-HIV_PGT127_LightChain
  source 1..315: mol_type = other RNA
cagagcgccctgacccaacccccttccgcttctggcagcccggggcagtccatcacaatttcttgcacgggaaccagcaacaatttcgtgtcctggtaccagcagtatcccggcaaggcccctaaactcgtcatctacgaggttaacaagagaccctctggggtgcctgaccggtttagcggatccaaaagcggctctacagcgtccctgaccgtgagcgggcttcaagctgatgacgaaggagtctattactgttcttccctggtgggcaattgggatgttattttcggcgggggaacaaagctcaccgtgctg

SEQ ID NO: 39439 - RNA, 405 nt, synthetic construct
  misc_feature 1..405: note = derived and/or modified sequence opt5 from anti-HIV_PGT127_HeavyChain
  source 1..405: mol_type = other RNA
cagccccaactgcaggagagcggccctgggctcgtggaagcctccgagaccctgtctcttacatgcacggtcagcggagactccaccggcagatgtaactacttctgggggtgggttcggcagccgcccggaaagggcctggaatggatcgggtctctcagccactgccgctcctattacaatacagattggacctatcataacccttctctgaaaagcagacttacaatttccctggacacccccaagaatcaggtgtttctccggctgacaagcgtgaccgctgccgatacggcgacctactattgtgctcgcttcggaggcgaggtcctggtgtacagagactggcctaaacccgcctgggttgatctctggggccgggggacactggtgaccgtctcttcc

SEQ ID NO: 39440 - RNA, 315 nt, synthetic construct
  misc_feature 1..315: note = derived and/or modified sequence opt5 from anti-HIV_PGT128_LightChain
  source 1..315: mol_type = other RNA
cagagcgccctgacccaacccccttccgcttctggcagcccggggcagtccatcacaatttcttgcacgggaaccagcaacaatttcgtgtcctggtaccagcagcacgccggcaaggcgcccaaactcgtcatctatgacgttaacaagagaccttctggggtgcccgatcggtttagcggatccaaaagcggcaatacagcttctctgaccgtgtccgggcttcaaacagacgatgaggccgtctactattgtggaagcctggtgggcaactgggacgttattttcggcgggggaaccaagctcacagtgctg

SEQ ID NO: 39441 - RNA, 405 nt, synthetic construct
  misc_feature 1..405: note = derived and/or modified sequence opt5 from anti-HIV_PGT128_HeavyChain
  source 1..405: mol_type = other RNA
cagccccaactgcaggagagcggccctaccctcgtggaagcctccgagacactgtctcttacgtgcgctgtcagcggggactccaccgccgcgtgtaactctttctggggatgggttagacagccgcccggcaaggggctggaatgggtgggaagcctctcccactgcgcttcttactggaatcggggctggacatatcataaccctagcctgaaatcccgccttaccctggccctcgatacacccaagaatctggtgtttctgaaactcaacagcgtcaccgccgctgacacagccacctactattgtgctagattcgggggagaggtgctgcggtacacggattggcctaagcccgcctgggttgacctttggggccgcggcaccctggtgacagtctcttcc

SEQ ID NO: 39442 - RNA, 330 nt, synthetic construct
  misc_feature 1..330: note = derived and/or modified sequence opt5 from anti-HIV_PGT130_LightChain
  source 1..330: mol_type = other RNA
cagagcgccctgacccaacccccttccgcttctggcagcctcgggcagtccgtgacaatctcttgcaacggaacgagctccgacattggcgggtggaatttcgtctcttggtaccagcagtttccgggacgggcccccagactgatcattttcgaggttaacaagcgccctagcggcgtgcccgggagattttccggaagcaaatctggcaattccgcgagccttaccgtgtctggcctgcaatccgatgacgaagggcagtatttctgtagctctctctttggacggtgggatgtcgtgttcggcgggggaacaaagctgaccgttctt

SEQ ID NO: 39443 - RNA, 387 nt, synthetic construct
  misc_feature 1..387: note = derived and/or modified sequence opt5 from anti-HIV_PGT130_HeavyChain
  source 1..387: mol_type = other RNA
caggtgcaactgcaggagagcggccccgggctcgtcaagcctgccgaaaccctgtcccttacatgctctgttagcggagagtccatcaacacgggccactactattgggggtgggtgagacaggtgccgggaaaaggcctggaatggattgggcatatccactacaccacagctgtcctccataatccctctcttaagagccggctgaccattaaaatctatacactgcgcaaccagattaccctcagactgtccaatgtgacagccgcggacaccgctgtttaccactgtgtgcggtctggaggcgatatcctgtattactatgagtggcaaaagcctcattggttcagcccctggggccctgggatccacgtcacggtgtccagc

SEQ ID NO: 39444 - RNA, 330 nt, synthetic construct
  misc_feature 1..330: note = derived and/or modified sequence opt5 from anti-HIV_PGT131_LightChain
  source 1..330: mol_type = other RNA
cagagcgccctgacccaacccccttccgcttctggcagcctcgggcagtccctgacaatctcttgcagcggaacgggctccgacattgggtcttggaacttcgtgagctggtaccagcagtttccgggcagagcccccaatcttatcattttcgaggtcaaccggcgcagatccggagttcctgatcggtttagcgggtctaagtccggaaataccgcgagcctgacagtgtctggcctccgctccgaagacgaggctgaatatttctgtagctctctgtccggcagatgggatatcgtgtttgggggaggcaccaaagtcacagtgctt

SEQ ID NO: 39445 - RNA, 387 nt, synthetic construct
  misc_feature 1..387: note = derived and/or modified sequence opt5 from anti-HIV_PGT131_HeavyChain
  source 1..387: mol_type = other RNA
caggtgcaactgcaggagagcggccccgggctcgtcaagccttccgaaaccctgtctcttacatgcacggttagcggagactccatcaacaccggccaccattactgggggtgggtgagacaggtgccgggaaaaggccccgagtggattgcccacatccattataatacagctgtcctgcacaaccctgccctcaagtctcgggtgaccattagcatcttcacactgaaaaatcttattaccctgtccctctctaacgttacagcggctgataccgccgtgtacttttgtgtccgcagcgggggagacatcctgtattacatcgaatggcagaagccccattggttctatccttggggccccggcattctggtgacggtttccagc

SEQ ID NO: 39446 - RNA, 321 nt, synthetic construct
  misc_feature 1..321: note = derived and/or modified sequence opt5 from anti-HIV_PGT135_LightChain
  source 1..321: mol_type = other RNA
gagatcgtgatgacccagagccccgacacactgtccgtctctcctggcgaaacggttaccctcagctgcagagcctcccaaaacattaataagaacctggcttggtaccagtataaaccggggcagtctccccggcttgtgatcttcgagacatacagcaagattgccgcgtttcctgctcgcttcgtggcctccggatctggcaccgaatttacactgaccatcaataacatgcagagcgaggatgtcgccgtgtattactgtcaacagtatgaagagtggcccagaacattcgggcagggaaccaaagttgacattaag

SEQ ID NO: 39447 - RNA, 399 nt, synthetic construct
  misc_feature 1..399: note = derived and/or modified sequence opt5 from anti-HIV_PGT135_HeavyChain
  source 1..399: mol_type = other RNA
cagctgcaaatgcaggagagcggccccgggctcgtgaagccttccgaaaccctgtctcttagctgcacagtctccggagactctatcagaggcggggagtggggagataaagactaccactggggctgggttcggcatagcgccgggaagggactggaatggattggctccatccactggcgcggcacgacccattataaagagtctctcagacggcgcgtgagcatgtccattgatacaagcagaaactggttctctctgcggcttgcttccgtgaccgccgcggacacagctgtctacttttgtgcccgccacagacatcacgatgtgttcatgctggttccgatcgccgggtggtttgacgtgtggggacccggcgtccaggtgaccgttagctct

SEQ ID NO: 39448 - RNA, 321 nt, synthetic construct
  misc_feature 1..321: note = derived and/or modified sequence opt5 from anti-HIV_PGT136_LightChain
  source 1..321: mol_type = other RNA
gagatcgtgatgacccagagccctcccacactgtccgtctctccgggcgaaacggccaccctcagctgcagagcttcccaaaacgttaagaataacctggcctggtaccagcttaaacccgggcaggcgcctcggctgctcattttcgacgcttctagccgcgccggaggcatccccgatagattttccgggtctggatatggcacagacttcaccctgacagtgaatagcgtgcagtccgaggattttggggactacttctgtcaacagtatgaagagtggcctcggacctttggacagggcacaaaggtcgatattaaa

SEQ ID NO: 39449 - RNA, 402 nt, synthetic construct
  misc_feature 1..402: note = derived and/or modified sequence opt5 from anti-HIV_PGT136_HeavyChain
  source 1..402: mol_type = other RNA
cagctgcaactccaggagagcggccccgggctggtgaagccttccgaaaccctttctctgacatgcacggtcagcggaggctccatgagagggaccgactggggagagaacgatttccactacggctggatccggcagtctagcgccaaagggctcgaatggattggatccatccattggcgcggcagaacaacccactataagacatcttttcggagccgcgctaccctgtccattgacacaagcaataacagattctctcttaccttttccttcgttacggccgcggataccgctgtgtactattgtgcccggcataaataccacgacatctttcgcgtggtcccggtggccggctggttcgatccctgggggcagggactgctcgttacagtgagctct

SEQ ID NO: 39450 - RNA, 321 nt, synthetic construct
  misc_feature 1..321: note = derived and/or modified sequence opt5 from anti-HIV_PGT137_LightChain
  source 1..321: mol_type = other RNA
gagatcatgatgacccagagccccgccattctgtccgtgtctcctggcgacagagctacactcagctgccgggcctcccaatctgtcaagaacaatctggcgtggtaccagaaacgcccggggcaggctcccagacttctgatcttcgatacgagctcccgggcctctggcattcctgcccgctttagcggagggggatccggcaccgagttcacactcaccgttaacagcatgcagtctgaagactttgctacatattactgtcaacagtatgaagagtggcccagaaccttcgggcagggaacaaaggtggaaatcaaa

SEQ ID NO: 39451 - RNA, 399 nt, synthetic construct
  misc_feature 1..399: note = derived and/or modified sequence opt5 from anti-HIV_PGT137_HeavyChain
  source 1..399: mol_type = other RNA
gaggtgcacctggaagagagcggccccgggctcgtcagaccttccgaaaccctgtctcttacatgcacggccagcggaggctccatccgcgggggagagtggggcgactctgattaccattgggggtgggttcggcacagcccggaaaagggactggagtggattggctccatccattggagaggcaccacacactataacgctcccttccgggggcgcggaagactctctattgacctgagccggaatcagttttcccttcgcctgaccagcgtgacagccgaggataccgcggtgtactattgtgtcaaacataagtaccacgacatcgtgatggttgtgcctattgctggctggttcgatccctgggggcaaggactccaggtcacagtgtcttcc

SEQ ID NO: 39452 - RNA, 336 nt, synthetic construct
  misc_feature 1..336: note = derived and/or modified sequence opt5 from anti-HIV_PGT141_LightChain
  source 1..336: mol_type = other RNA
gacaccgtggtcacacagagccccctgtccctccctgttacgccgggcgaggccgcttctatgagctgctcctctacccaaagcctgagacactccaacggggccaattaccttgcgtggtatcagcataagcccggacagtctcctcggctgctcatccgcctgggcagccagagagcttccggggtgcccgatcggttcagcggatctggctccgggacacactttacccttaaaattagccgcgtggaagccgaggacgccgctatctactattgtatgcaaggactgaacagaccttggacattcggcaagggcaccaaactcgaaattaag

SEQ ID NO: 39453 - RNA, 423 nt, synthetic construct
  misc_feature 1..423: note = derived and/or modified sequence opt5 from anti-HIV_PGT141_HeavyChain
  source 1..423: mol_type = other RNA
caggtgcaactggtccagagcggccccgaggttaagaaacctgggtcctctgtgaaggtgagctgcaaagcctccggaaacaccttctctaagtacgacgtccactgggtgagacaggctacaggccaggggctcgaatgggttggatggatgagccatgagggcgataaaacggaatccgcccaacggtttaaggggcgcgtgaccttcacaagagacacctctgcgagcacagcttatatggagctgcggggacttacctccgatgacacagccatctactattgtacccgcggcagcaagcacagactgcgggattacgtcctctatgacgattacggcctgattaattatcaggaatggaacgactaccttgagtttctggatgtgtgggggcatggaacggccgttaccgtgtcttcc

SEQ ID NO: 39454 - RNA, 336 nt, synthetic construct; identical to SEQ ID NO: 39452
  misc_feature 1..336: note = derived and/or modified sequence opt5 from anti-HIV_PGT142_LightChain
  source 1..336: mol_type = other RNA

SEQ ID NO: 39455 - RNA, 423 nt, synthetic construct
  misc_feature 1..423: note = derived and/or modified sequence opt5 from anti-HIV_PGT142_HeavyChain
  source 1..423: mol_type = other RNA
caggtgcaactggtccagagcggccccgaggttaagaaacctgggtcctctgtgaaggtgagctgcaaagcctccggaaacaccttctctaagtacgacgtccactgggtgagacaggctacaggccaggggctcgaatgggttggatggatcagccatgagcgggataaaacggaatccgcccaacgctttaagggcagagtgaccttcacacgggacacctctgcgacaaccgcttatatggagctgcgcgggcttacaagcgatgacaccgccatttactattgtacgagaggatccaagcaccggctgcgcgattacgtcctctatgacgattacggcctgatcaattatcaggaatggaacgactaccttgagtttctggatgtgtggggccatgggaccgccgttacagtgagctct

SEQ ID NO: 39456 - RNA, 336 nt, synthetic construct
  misc_feature 1..336: note = derived and/or modified sequence opt5 from anti-HIV_PGT143_LightChain
  source 1..336: mol_type = other RNA
gacaccgtggtcacacagagccccctgtccctccctgttacgccgggcgaggccgcttctatgagctgcacctccacacaatctctgagacacagcaacggggccaattaccttgcgtggtatcagcataagcccggacagtcccctcggctgctcatccgcctgggctctcagagagctagcggggtgcccgatcggttctccggaagcggctctgggacccactttacacttaaaatttcccgcgtggaacctgaggacgccgccatctactattgtatgcaaggactgaacagaccctggaccttcggcaagggcacaaaactcgaaattaag

SEQ ID NO: 39457 - RNA, 423 nt, synthetic construct
  misc_feature 1..423: note = derived and/or modified sequence opt5 from anti-HIV_PGT143_HeavyChain
  source 1..423: mol_type = other RNA
caggtgcaactggagcagagcggcgccgaagtcaagaaacccgggtcctctgttaaggtgagctgcaaggcttccggaaacaccttctctaaatacgacgtgcactgggtcagacaggccacaggccaggggctcgagtgggtgggatggatgagccatgaaggcgataaaacggagtccgcgcaacggtttaaggggcgcgttaccttcacaagagacacctctgctagcacagcctatatggaactgcggggacttacctccgatgacacagccatctactattgtacccgcggcagcaagcacagactgcgggattacgtgctctatgacgattacggcctgattaattatcaggagtggaacgactaccttgagtttctggatgtctgggggcatggaacggctgtgaccgtttcttcc

SEQ ID NO: 39458 - RNA, 336 nt, synthetic construct
  misc_feature 1..336: note = derived and/or modified sequence opt5 from anti-HIV_PGT144_LightChain
  source 1..336: mol_type = other RNA
gacaccgtggtcacacagagccccctgtccctctctgttacgcctggcgaggccgctagcatgtcctgcacctctacacaaagcctgagacactccaacggggccaattaccttgcgtggtatcagcataagccgggacagtctccccggctgctcatccgcctgggcagccagagagcttccggggtgcctgatcggttcagcggatctggctccgggacccactttacacttaaaattagccgcgtggaagccgacgatgccgctatctactattgtatgcaaggactgaacagaccctggaccttcggcaagggcacaaaactcgagattaag

SEQ ID NO: 39459 - RNA, 423 nt, synthetic construct
  misc_feature 1..423: note = derived and/or modified sequence opt5 from anti-HIV_PGT144_HeavyChain
  source 1..423: mol_type = other RNA
caggtgcaactggtccagagcggcgccgaggttaagaaacccgggtcctctgtgaaggtgagctgcaaggcttccggaaacaccttcagaaaatacgacgtccactgggtgcggcaggccacaggccaggggctcgaatgggttggatggatgtctcatgagggcgataaaacggaaagcgcgcaacgctttaaggggagagtgtccttcacccgggacaattctgctagcacagcctatatcgagctgcgcggacttacctccgatgacacagccatttactattgtaccggcggcagcaagcacagactgcgggattacgtcctctatgacgattacgggctgatcaaccagcaggaatggaatgactatcttgagtttctggatgtgtggggacatggcacagctgttaccgtgtcttcc

SEQ ID NO: 39460 - RNA, 336 nt, synthetic construct
  misc_feature 1..336: note = derived and/or modified sequence opt5 from anti-HIV_PGT145_LightChain
  source 1..336: mol_type = other RNA
gaggtggtcatcacccagagccccctgttcctccctgttacaccgggcgaagccgcttccctgtcttgcaagtgtagccactcccttcaacattctacgggggccaactacctggcgtggtatctccagagacccggacagacccctcggctgcttattcacctggctacacatcgcgccagcggcgtgcccgacagattttccgggtctggaagcggcaccgatttcacactcaaaatctcccgggtggagagcgacgatgtcgggacctactattgcatgcagggactgcactctccttggacatttggccaaggcaccaaggtggaaattaaa

SEQ ID NO: 39461 - RNA, 420 nt, synthetic construct
  misc_feature 1..420: note = derived and/or modified sequence opt5 from anti-HIV_PGT145_HeavyChain
  source 1..420: mol_type = other RNA
caggtgcaactggtccagagcggcgccgaggttaagaaacccgggtcctctgtgaaggtgagctgcaaggcttccggaaactctttcagcaatcacgacgtccattgggtgagacaggccaccggccaggggctcgaatggatgggatggatgtcccacgagggcgataaaacagggctggcgcaaaaatttcagggacgggttacgatcacccgcgactctggcgctagcacagtgtacatggaacttagaggcctgaccgccgatgacacagccatttattactgtctcaccgggtccaagcatcggctgcgcgattatttcctttacaacgagtatggacctaattacgaagagtggggcgactatctggctacactcgatgtctgggggcacggaaccgccgtgacggttagctct

SEQ ID NO: 39462 - RNA, 657 nt, synthetic construct
  misc_feature 1..657: note = derived and/or modified sequence opt5 from anti-HIV_PGT151_LightChain
  source 1..657: mol_type = other RNA
gacatcgtgatgacccagacacccctgagcctctccgtcacgcctggccaaccggcctctattagctgcaagtcctctgagagcctgagacagtccaacgggaaaacctctctttactggtatcggcagaagcccggacagagccctcaactgctcgttttcgaagtgtccaatcgctttagcggcgtgtctgatagattcgtcgggtccggaagcggcacagactttaccctgcggatctctcgcgtggaggctgaagatgttgggttctactattgtatgcagtccaaagactttccccttacattcggaggcggcaccaaggtggatctgaaaagaacagtcgccgcgcctagcgtgtttatttttcccccttctgacgagcagctcaagtccgggaccgctagcgttgtgtgcctgctgaacaatttctacccgcgggaagccaaggtccagtggaaagtggataacgccctccaatccggaaattctcaggagagcgtgacggagcaggactccaaggatagcacctattctctgtccagcacacttaccctgtctaaagctgactacgaaaagcacaaagtctatgcctgtgaggttacacatcagggcctcagctcccccgtgaccaagtctttcaaccgcggggaatgc

SEQ ID NO: 39463 - RNA, 720 nt, synthetic construct
  misc_feature 1..720: note = derived and/or modified sequence opt5 from anti-HIV_PGT151_HeavyChain
  source 1..720: mol_type = other RNA
agagtgcagctggtcgagagcggcgggggagttgtgcaacccggcaagtccgtgcggctctcttgcgtcgtgagcgacttccctttttccaaatacccgatgtattgggttcgccaggcccccgggaagggactggaatgggtggctgccatctctggcgatgcgtggcacgtcgtgtacagcaactccgttcaggggagattccttgtgtctcgggacaatgtcaaaaacaccctgtatctcgagatgaatagcctgaagattgaagatacagctgtgtaccgctgtgccagaatgtttcaggagtccggacctccccggcttgaccgctggagcggcagaaactattactattactctggcatggatgtgtgggggcaaggaacgaccgtcacagtttccagcgcctctaccaaaggcccttccgtgttccccctggctcctagctctaagtccacaagcgggggaaccgccgctctcggctgcctggtgaaggactactttccggaacccgtcacagtgtcctggaactctggggccctgaccagcggagttcatacgttccctgcggtgctccagtccagcggcctgtattctctttccagcgtcgtgaccgttccctctagctccctgggcacacagacctacatctgtaatgtgaatcacaaaccttctaacacaaaggtcgataaacgggtggagcccaagagctgcgacaaa

SEQ ID NO: 39464 - RNA, 657 nt, synthetic construct
  misc_feature 1..657: note = derived and/or modified sequence opt5 from anti-HIV_PGT152_LightChain
  source 1..657: mol_type = other RNA
gacatcgtgatgacccagacacccctgagcctctccgtcgatcctggccaaccggcctctattagctgcaagtcctctcagagcctgcggcagtccaacgggaaaacgtctctttactggtatcagcaaaagcccggacagagccctcagctgctcatcttcgaggtttccaatcggtttagcggcgtgtctgaccgcttcgtggggtccggaagcggcaccgattttacactgagaatttctcgggtcgaagctgaggacgtggggttctactattgtatgcagtccaaagattttccccttaccttcggaggcggcacaaaggttgacctgaaacgcaccgtggccgcgcctagcgtctttatctttcccccttctgatgaacaactcaagtccgggacagctagcgtggtttgcctgctgaacaatttctacccgagagaggccaaggtgcagtggaaagtcgacaacgccctccagtccggaaattctcaggaaagcgtgaccgagcaagattccaaggacagcacgtattctctgtccagcacccttacactgtctaaagctgattacgagaagcacaaagtgtatgcctgtgaagtcacccatcagggcctcagctcccccgttacaaagtctttcaacagaggggagtgc

SEQ ID NO: 39465 - RNA, 720 nt, synthetic construct
  misc_feature 1..720: note = derived and/or modified sequence opt5 from anti-HIV_PGT152_HeavyChain
  source 1..720: mol_type = other RNA
agagtgcagctggtcgagagcggcgggggagttgtgcaacccggcaagtccgtgcggctctcttgcgtcgtgagcgacttccctttttccaaatacccgatgtattgggttcgccaggcccccgggaagggactggaatgggtggctgccatctctgcggatgcttggcacgtcgtgtacagcggctccgttcaggggagattccttgtgtctcgggacaacagcaaaaatattctgtatctcgagatgaacaccctgaagatcgaagatacagccgtctaccgctgtgccagaatgtttcaggagtccggacctccccggttcgacagctggtctggccgcaattattactattactccggcatggatgtgtgggggcaaggaacgaccgtgacagtcagctctgcttccaccaaaggccctagcgtttttccccttgccccttcttccaagagcacatccgggggaaccgctgccctgggctgcctcgtgaaggactacttcccggaacccgtgacagtctcttggaacagcggggcgctgacctccggagtgcatacgtttcctgccgttctgcagagctctggcctctattccctgagctctgtggtcaccgtgcccagctcctctcttggcacacagacctacatttgtaatgttaaccacaaacctagcaatacaaaggtggataaaagagtcgagcccaagtcctgcgacaaa

SEQ ID NO: 39466 - RNA, 309 nt, synthetic construct
  misc_feature 1..309: note = derived and/or modified sequence opt5 from anti-HIV_VRC-CH30_LightChain
  source 1..309: mol_type = other RNA
gacatccagatgacccaaagcccctcctctctgagcgcctccctcggcgatagagtgacaattacgtgccaggcttctcgggggatcggaaaggacctgaactggtaccagcagaaacctggcaaggccccgaaacttctggtcagcgatgcgtccattctcgaagggggagttccctctcgcttcagcggctccgggtttcaccaaaatttcagcctgaccatctcttcccttcagcctgaggacgtggctacatatttttgtcagcagtacgagaccttcggacaaggcacaaaggtggatattaaa

SEQ ID NO: 39467 - RNA, 393 nt, synthetic construct
  misc_feature 1..393: note = derived and/or modified sequence opt5 from anti-HIV_VRC-CH30_HeavyChain
  source 1..393: mol_type = other RNA
caggtgcaactggtccagagcggcgccgctgttagaaagcccggggcctccgtgaccgtgtcttgcaaattcgcggaggacgatgactacagccctcactgggtcaacccggctcccgaacattatatccactttctccggcaggcccctggacagcaactggagtggcttgcctggatgaatcccacaaacggcgctgtgaattacgcctggcagctgcatgggcgcctcacggctaccagagatggatccatgacaaccgccttcctggaagttcggtctcttcgcagcgacgatacagcggtgtattactgtgccagagctcagaagcggggccgctccgagtgggcctatgctcactgggggcagggaacccctgtcgccgtgtctagc

SEQ ID NO: 39468 - RNA, 309 nt, synthetic construct
  misc_feature 1..309: note = derived and/or modified sequence opt5 from anti-HIV_VRC-CH31_LightChain
  source 1..309: mol_type = other RNA
gacatccagatgacccaaagcccctcctctctgagcgcctccctcggcgatagagtgacaattacgtgccaggcttctcgggggatcggaaaggacctgaactggtaccagcagaaagccggcaaggcgcctaaacttctggtcagcgatgcttccaccctcgaagggggagttccgtctcgcttcagcggctccgggtttcaccaaaatttcagcctgacaatttcttcccttcaggccgaggacgtggccacctatttttgtcagcagtacgagacattcggacaaggcaccaaggtggatatcaaa

SEQ ID NO: 39469 - RNA, 393 nt, synthetic construct
  misc_feature 1..393: note = derived and/or modified sequence opt5 from anti-HIV_VRC-CH31_HeavyChain
  source 1..393: mol_type = other RNA
caggtgcaactggtccagagcggcgccgctgttagaaagcccggggcctccgtgaccgtgtcttgcaaattcgcggaggacgatgactacagcccttattgggtcaacccggctcccgaacactttatccatttcctccggcaggcccctggacagcaactggagtggcttgcctggatgaatcccacaaacggcgctgtgaattacgcctggtatctgaacgggcgcgttacggctaccagagatcggtccatgacaaccgcctttctcgaagtgaagtctctgcgcagcgacgatacagcggtctactattgtgccagagctcagaaacggggacgctccgagtgggcctacgctcactggggccaggggacccctgtggttgtgtctagc

SEQ ID NO: 39470 - RNA, 309 nt, synthetic construct
  misc_feature 1..309: note = derived and/or modified sequence opt5 from anti-HIV_VRC-CH32_LightChain
  source 1..309: mol_type = other RNA
gacatccagatgacccaaagcccctcctctctgagcgcctccctcggcgatagagtgacaattacgtgccaggcttctcgggggatcggaaaggacctgaactggtaccagcagaaacctggccgcgccccgaaacttctggtcagcgatgcgtccattctcgaagggggagttcccaccagattctctggcagcgggtttcaccaaaatttctccctgacaatcagctctcttcaggctgaggacgtggccacctatttttgtcagcagtacgagacattcggacaaggcaccaaggtggatattaag

SEQ ID NO: 39471 - RNA, 393 nt, synthetic construct
  misc_feature 1..393: note = derived and/or modified sequence opt5 from anti-HIV_VRC-CH32_HeavyChain
  source 1..393: mol_type = other RNA
caggtgcaactggtccagagcggcgccgctgttagaaagcccggggcctccgtgaccgtgtcttgcaaattcgcggaggacgatgactttagccctcactgggtcaacccggctcccgaacattacatccacttcctccggcaggcccctggacagcaactggagtggcttgcctggatgaagcccacaaatggcgctgtgaactatgcctggcagctgcaggggcgcgttacggtgaccagagatcggtcccagacaaccgcttttctcgaagtcaaaaatctgcgctctgacgatacagccgtgtactattgtgcgagagcccaaaagcggggacgcagcgagtgggcttacgcccattggggccaggggacccctgttgtgatttccgct

SEQ ID NO: 39472 - RNA, 309 nt, synthetic construct
  misc_feature 1..309: note = derived and/or modified sequence opt5 from anti-HIV_VRC-CH33_LightChain
  source 1..309: mol_type = other RNA
gacatccagatgacccaaagcccctcctctctgagcgcctccctcggcgatagagtgacaattacgtgccaggcttctcgggggatcggaaaggacctgaactggtaccagcagaaacgcggcagagcccctcggcttctggtcagcgatgcgtccgttctcgaagggggagtgccgtctcgcttcagcggctccgggtttcaccaaaatttcagcctgaccatttctacacttcagcccgaggacgtggctacctatttttgtcagcagtacgagacattcggacaaggcaccaaggtcgatatcaaa

SEQ ID NO: 39473 - RNA, 393 nt, synthetic construct
  misc_feature 1..393: note = derived and/or modified sequence opt5 from anti-HIV_VRC-CH33_HeavyChain
  source 1..393: mol_type = other RNA
caggtgcaactggtccagagcggcgccgctgttagaaagcccggggcctccatctctgtgagctgcaaattcgcggacgctgatgactactcccctcactggatgaacccggcccccgagcattatattcactttctccggcaggcccctggacagcaactggaatggcttgcttggatgaatcccaccaacggcgccgtgaattacgcttggtatctgaacgggcgcgtcacagccacgagagatcggtctatgaccacagcgttcctcgaggtgcgcagcctgagatccgacgataccgccgtttactattgtgctcgggcccagaagcgcgctagatctgaatgggcctacgcgcattggggacagggcacacctgtggtcgtgagctcc

SEQ ID NO: 39474 - RNA, 309 nt, synthetic construct
  misc_feature 1..309: note = derived and/or modified sequence opt5 from anti-HIV_VRC-CH34_LightChain
  source 1..309: mol_type = other RNA
gacatccagatgacccaaagcccctcctctctgagcgcctccctcggcgatagagtgacaattacgtgccaggcttctcgggggatcggaaaggacctgaactggtaccagcagaaagccggcaaggcgcctaaacttctggtcagcgatgcttccattctcgaagggggagttccgtctcgcttcagcggctccgggtttcaccaaaatttcagcctgaccatctcttcccttcagcccgaggacgtggccacatatttttgtcagcagtacgagaccttcggacaaggcacaaaggtggatattaaa

SEQ ID NO: 39475 - RNA, 393 nt, synthetic construct
  misc_feature 1..393: note = derived and/or modified sequence opt5 from anti-HIV_VRC-CH34_HeavyChain
  source 1..393: mol_type = other RNA
caggtgcaactggtccagagcggcgccgctgttagaaagcccggggcctccgtgaccgtgtcttgcaaattcgcggaggacgatgactggagccctcactgggtcaacccggctcccgaacattacatccactttctccggcaggcccctggacagcaactggagtggcttgcctggatgaatcccacaaacggcgctgtgaattatgcctggcagctgaacgggcgcctcacggctaccagagatacatccatgaccacagccttcctggaagttaagtctcttcggagcgacgataccgcggtgtactattgtgcccgcgctcagaaaagaggacggtccgagtgggcctacgctcattggggccaggggacacctgtcgtggtttctagc

SEQ ID NO: 39476 - RNA, 306 nt, synthetic construct
  misc_feature 1..306: note = derived and/or modified sequence opt5 from anti-HIV_VRC-PG04_LightChain
  source 1..306: mol_type = other RNA
gagatcgtgctgacccagagccccggcacactctccctgtctcctggggaaacggccagcctttcctgcaccgctgcctcttacggacacatgacatggtatcaaaagaaaccgggccagccccctaagctgctcattttcgcgaccagcaaaagagcttccgggatccccgaccggttttctggaagccagttcggcaagcagtacacactgaccattacacgcatggagcctgaagattttgccagatattactgtcaacagcttgagttctttgggcagggaacccggctggaaatccgcaga

SEQ ID NO: 39477 - RNA, 375 nt, synthetic construct
  misc_feature 1..375: note = derived and/or modified sequence opt5 from anti-HIV_VRC-PG04_HeavyChain
  source 1..375: mol_type = other RNA
caggtgcaactggtccagagcggctccggggttaagaaacccggagcctctgtgagagtgagctgctggacctccgaggacatcttcgaacggacagagctcattcactgggtccgccaggctcctggccaggggctggaatggatcggatgggtgaagacggttaccggcgccgtgaactttgggtctccggatttcagacaacgggtcagccttacacgcgacagagatctgtttaccgcgcatatggacattcggggactcacacagggcgataccgctacatacttctgtgcccgccagaaattttataccggcgggcagggatggtacttcgacctgtggggcagagggacgcttatcgtggtttcctct

SEQ ID NO: 39478 - RNA, 303 nt, synthetic construct
  misc_feature 1..303: note = derived and/or modified sequence opt5 from anti-HIV_VRC-PG04b_LightChain
  source 1..303: mol_type = other RNA
gagatcgtgctgacccagagccccggcacactctccctgtctcctggggaaacggccagcctttcctgcaccgctgcctcttacggacacatgacatggtatcaaaagaaaccgggccagccccctaagctgctcattttcgcgaccagcaaaagagcttccgggatccccgaccggttttctggaagccagttcggcaagcagtacacactgaccattacacgcatggagcctgaagattttgccgggtattactgtcaacaggtcgagttctttggacagggcaccagacttgaaatccgg

SEQ ID NO: 39479 - RNA, 375 nt, synthetic construct
  misc_feature 1..375: note = derived and/or modified sequence opt5 from anti-HIV_VRC-PG04b_HeavyChain
  source 1..375: mol_type = other RNA
caggtgcaactggtccagagcggctccggggttaagaaacccggagcctctgtgagagtgagctgctggacctccgaggacatcttcgaacggacagagctcattcactgggtccgccaggctcctggccaggggctggaatggatcggatgggtgaagacggttaccggcgccgtgaactttgggtctccgaatttcagacatcgggtcagccttacacgcgatagagacctgtttaccgcgcacatggatattcggggactcacacaaggcgacaccgctacatacttctgtgcccgccagaaatttgagagaggcgggcagggatggtatttcgatctgtggggccgggggacccttatcgtggtttcctct

SEQ ID NO: 39480 - RNA, 612 nt, synthetic construct
  misc_feature 1..612: note = derived and/or modified sequence opt5 from anti-HIV_VRC-PG20_LightChain
  source 1..612: mol_type = other RNA
cagagcgccctgacccaacccccttccgtgtctggcagcccggggcagtccatcacactctcttgcacgggagctagcacctccgtcgcctggtaccagcagtatgcggacaaggctcccagactgattgttttcgatggcaacaaacggccttctgacatcagctcccgctttagcgggtctcaatccggaggcacagccagccttaccatttctgggctgcagtccgaggatgaagcctactatcactgtaatgctttcgagtttttcggaggcggcacaaagctcaccgtgctgagccagcccaaagccgctccttctgtgacactttttcccccttccagcgaggaactgcaggccaacaaggcgaccctcgtctgcctgatctccgacttctacccgggggccgtgacggttgcttggaaagccgattctagccccgtgaaggctggagtcgaaaccacaaccccttccaagcaaagcaataacaaatatgccgcgtcttcctacctgagcctcacacccgagcagtggaagtctcataaaagctattcctgtcaggtgacccacgagggctctacggttgaaaagacagtggcccctaccgagtgc

SEQ ID NO: 39481 - RNA, 681 nt, synthetic construct
  misc_feature 1..681: note = derived and/or modified sequence opt5 from anti-HIV_VRC-PG20_HeavyChain
  source 1..681: mol_type = other RNA
gaggtgcacctgatgcagagcggcaccgaaatgaagaaacccggggcctccgtcagagttacatgccaaacgtctggatacaccttcagcgactattttatccattggctccgccaggtgcctggccgggggttcgagtggatgggatggatgaacccgcagtggggccaggtgaattacgctagaacatttcaagggcgggtcaccatgacacgcgatgtgtatagagaagttgcctacctggaccttcggtccctgaccttcgcggatacagctgtgtatttttgtgcccgcagaatgcggtctcaggaccgcgagtgggatttccagcactggggacagggcaccagaattatcgtcagctccgcctctacgaagggccccagcgtgtttcctctcgctccctccagcaaatctacctccgggggaacagccgctctgggctgccttgttaaggactacttccctgaacccgtgaccgtcagctggaactctggggccctgacatccggagtgcatacctttcctgcggtgctccaaagctctggcctgtattccctgagctccgtcgttacggtgccgtctagctccctcgggacacagacctacatttgtaatgtgaaccacaaacccagcaatacaaaggtcgataagaaagtggagcctaagtcttgcgacaaa

SEQ ID NO: 39482 - RNA, 1059 nt, synthetic construct
  misc_feature 1..1059: note = derived and/or modified sequence opt5 from anti-HIV_VRC-PG20_G-Chain
  source 1..1059: mol_type = other RNA
gtgtggaaggacgccgataccacactgttctgcgctagcgacgccaaagcgcacgagacggaagtccataacgtttgggctacccacgcctgtgtgcccacagatcctaatccgcaggagatccatctcgaaaacgtgaccgagaattttaacatgtggaagaataacatggtcgaacaaatgcaggaggacgtgatttccctgtgggatcagtctcttcagccctgcgttaaactgacaggcgggagcgtgatcaagcaagcctgtcctaaaatttccttcgaccccatccctattcactactgcacccccgctggatatgtcatcctcaagtgtaatgataagaactttaatggcacagggccttgcaaaaacgtgtctagcgttcagtgtacccatggaatcaagccggtggtctccacgcagctgcttctgaatggctctctcgccgaggaagagattatcattagaagcgaaaacctgaccaataacgctaaaacaatcattgtgcacctgaataagtccgtggagatcaactgcacccggcccagcaacgggggatctggctccggcggggacattcgcaaagcctactgtgagatcaatggaacaaagtggaacaaggtcctcaaacaggttaccgaaaagctgaaagagcacttcaataacaagacgatcatttttcaacctcccagcggcggggatcttgaaatcacaatgcatcacttcaattgcagaggagagtttttctattgtaacaccacacagctgtttaataatacctgcattggcaacgaaaccatgaaagggtgcaacggaacaatcacgctcccttgtaagattaaacagatcatcaatatgtggcagggcaccggccaagcgatgtacgctcccccgattgacgggaagatcaactgcgtgtctaatattacaggaatcctgcttacccgggatggcggggccaacaatacatccaacgagaccttccgccctggaggcgggaacattaaggacaattggagaagcgagctgtataaatacaaggtggtccagatcgaa

SEQ ID NO: 39483 - RNA, 312 nt, synthetic construct
  misc_feature 1..312: note = derived and/or modified sequence opt5 from anti-HIV_VRC02_LightChain
  source 1..312: mol_type = other RNA
gaaatcgtgctgacccagagccccggcacactctccctgtctcctggggaaacggccattatcagctgcagaacctcccaatacggatctcttgcttggtatcagcagcggccgggccaggcgccccgcctggtcatttacagcgggtccacaagagccgctggaatccctgaccggttctctggcagccgctgggggcccgattataacctcaccattagaaatctggagtccggagactttggcctttactattgtcaacagtacgagttctttggccaggggacaaaggttcaggtggatatcaaacgg

SEQ ID NO: 39484 - RNA, 363 nt, synthetic construct
  misc_feature 1..363: note = derived and/or modified sequence opt5 from anti-HIV_VRC02_HeavyChain
  source 1..363: mol_type = other RNA
caggtgcaactggtccagagcggcgggcagatgaagaaacccggagagtccatgagaatctcttgccaggccagcggctacgagttcattgactgtaccctcaactgggttcggctggctcctgggcgcagaccggaatggatgggatggcttaagccccggggcggggccgtgaattatgcgcgccctctgcaaggaagagtgacaatgacgcgggatgtctactccgacaccgcttttctcgaactgcgctctcttacagccgatgacaccgccgtgtattactgcacaagaggcaaaaactgtgattataattgggacttcgagcactggggccgggggacccccgttacagtgagctcc

SEQ ID NO: 39485 - RNA, 309 nt, synthetic construct
  misc_feature 1..309: note = derived and/or modified sequence opt5 from anti-HIV_VRC03_LightChain
  source 1..309: mol_type = other RNA
gagatcgtgctgacccagagccccggcattctctccctgtctcctggggaaacagccacgcttttctgcaaggctagccaaggaggcaacgccatgacctggtaccagaagagacgggggcaggtcccgcgcctgctcatctatgacacatccagacgggcgtctggagttcccgatcgctttgtgggcagcgggtccggaaccgacttctttctgacaattaataaacttgatagagaggacttcgctgtgtactattgtcagcaatttgagttctttggcctgggctctgaactcgaagtccaccgg

SEQ ID NO: 39486 - RNA, 390 nt, synthetic construct
  misc_feature 1..390: note = derived and/or modified sequence opt5 from anti-HIV_VRC03_HeavyChain
  source 1..390: mol_type = other RNA
caggtgcaactggtccagagcggcgccgttatcaagacccccgggtcctctgtgaaaattagctgcagagcttccggatacaacttccgggactattctatccactgggtgcgcctcattcctgataagggctttgagtggatcgggtggattaaaccgctgtggggagccgtcagctacgcgagacagcttcagggccgggtgtccatgacacgccaactgtctcaggaccccgatgaccctgattggggagttgcttatatggagttcagcgggctcacgcccgccgacaccgccgaatacttttgtgtgagacggggctcctgcgattattgtggcgacttcccttggcagtactgggggcagggaacagtcgtggttgtgagctct

SEQ ID NO: 39487 - RNA, 630 nt, synthetic construct
  misc_feature 1..630: note = derived and/or modified sequence opt5 from anti-HIV_VRC23_LightChain
  source 1..630: mol_type = other RNA
gagatcgtgatgacccagagccccgtcacagtttccgtgtctagaggcgggacggccaccctgagctgccgggcttcccaaggagtgggctctgacgtcgcctggtaccagcacaagcctgggcagacaccgcgcctcctgatttatggagcgagcaccagagcttccggcgtgcccgaacggttctctgggagcggatttcatgttgatttcacactttccatcagcggcctgcagcctgaggacgtggccatttactattgtcaacagtacgaaacctttggccaggggacaaaagtcgagatcaagcgcaccgtggccgctccctctgttttcatttttcctccctccgatgaacagctcaaaagcggaacggcctctgtggtctgcctgcttaacaatttctatcctagagaggctaaggtgcaatggaaagtggacaacgccctgcagtccggcaatagccaggagtctgtcaccgaacaggattccaaggacagcacatactccctctctagcaccctgacactgtccaaggcggattatgagaaacacaaggtttacgcctgtgaagtgacccatcaagggctcagctctccggtgacgaaatcctttaaccggggagagtgc

SEQ ID NO: 39488 - RNA, 672 nt, synthetic construct
  misc_feature 1..672: note = derived and/or modified sequence opt5 from anti-HIV_VRC23_HeavyChain
  source 1..672: mol_type = other RNA
gaggtgcagttcgtccaaagcggcgccgaagttaagaaacccggggcttccgtgagagtgtcttgcgaggccagcggatactcctttaccgactatgtcctgcagtggatccggcaggcgcctggccagcgcccggaatggatggggtggattaagcccgagagaggagctgtgtcttacgcccctcaattccagggccggctcacactgacgcgcgatctttataccgaaacagcctacatgcactttaaaaacctgagaagcgacgataccgctatctattactgtgcccgcggggttcggagagacgcttcctggtggctccagttctggggacagggcacactggtgaccgtctctagcgcctccacaaagggccccagcgtgtttcctcttgcgccctcttccaaaagcacctctgggggaacggccgctctgggctgcctcgttaaggattatttccctgagccggtgaccgtctcctggaatagcggggccctgacatctggagtgcatacctttcccgctgtgctgcaatccagcggcctctactccctgtctagcgtcgttacagtgccttccagctctcttgggacccagacgtacatttgtaacgtgaatcacaagccctccaacacaaaagtcgacaagaaagtggagcctaagagctgc

SEQ ID NO: 39489 - RNA, 1077 nt, synthetic construct
  misc_feature 1..1077: note = derived and/or modified sequence opt5 from anti-HIV_VRC23_G-Chain
  source 1..1077: mol_type = other RNA
gtgtggagagacgccgataccacactgttctgcgctagcgacgccaaggcgtacgagacggaaaaacacaacgtctgggctacccatgcctgtgttccgacagatcctaatccgcaggagatccacctcgacaacgtgaccgaaaagtttaatatgtggaaaaacaatatggtggagcaaatgcatacagatattatctccctgtgggaccagtctcttaagccctgcgtcaaactgaccggcgggagcgccattacacaggcttgtcctaaggtgtccttcgaacccatccctattcactattgcacccccgccggatttgctatcctcaagtgtaaagatgagggcttcaacgggacgggactgtgcaagaatgtttctaccgtgcagtgtacacatggcatcaaacctgtcgtgagcacccaacttctgctcaacgggtccctggccgagaagaatattacaatccggtctgaaaacattaccaataacgcgaaaatcattatcgttcagctggtgcagccggtcacgattaagtgcatccgccccaataacggaggcagcggctccgggggagacatcagacaggcccactgtaatgtgacacggagccgctggaacaagaccctccaagaggtggctgaaaaactgagaacatactttggcaacaagaccattatcttcgccaattcttccgggggagatcttgagattaccacacacagctttaactgcggcggggagttcttttattgtaatacgtctggactgttcaactccacctggtacgtcaatagcacatggaacgacaccgattctacacaggaatccaatgacaccatcacgctcccttgccggattaaacagatcatcaacatgtggcagcgcgctggccaagccatgtatgcgccccctattcccggcgttatcaagtgcgagagcaatattacagggctgcttctgaccagagatggaggcaaagacaacaatgtgaacgaaacctttcggcccgggggaggcgacatgcgcgataattggagatccgagctctacaagtataaagtggtcgaaatcgag

SEQ ID NO: 39490 - RNA, 648 nt, synthetic construct
  misc_feature 1..648: note = derived and/or modified sequence opt5 from anti-HIV_5CCK_LightChain
  source 1..648: mol_type = other RNA
cagagcgccctgacccaacccgcttccgtgtctgccagccctggccagtccatcacaatttcttgcagcgggacgagatccgacgtcggaggctacgatttcgtttcttggtatcagcagcacccggggaaggtgcccaagctcatcatttacgaggtgaccaagcggcctagcggaatcccccaacgcttttccggcagcaaatctgggaacacagcgtccctgaccattagcggacttcaggctgacgatgaagccgactattactgttgctcttatgccaattacgataagctgatcctcggcggcgggacaaaactgaccgtccttggacagcctaaggctaaccccacagtgaccctgttccctccgtccagcgaggaactccaggccaataaggctacgctggtttgtctgatctctgacttttatcccggcgccgtgaccgtcgcgtggaaagccgatgggtcccctgtgaaggctggagttgagacaaccaaacccagcaagcaatccaacaataaatacgccgcttctagctacctctccctgacacctgaacagtggaaaagccatagatcttattcctgccaggtgacccacgagggcagcacggtcgagaagacagtggcccccaccgaatgttct

SEQ ID NO: 39491 - RNA, 696 nt, synthetic construct
  misc_feature 1..696: note = derived and/or modified sequence opt5 from anti-HIV_5CCK_HeavyChain
  source 1..696: mol_type = other RNA
caggtgcaactggtccagagcggcgccgagatgaaggaccccggggcttccgttaaagtgtcttgcagagccagcggatacaagttcaccgattattacatgcactgggtgcggcaggcgcctggccaggggctcgaatgggtcggatgggtgaacacaaatggcgggtttacgaaatatggagctaagttccaaggccgcgttaccgtgacaagagacacctccacaaacaccgtctttctggagctttctcggctgacattcggcgataccgccatgtacttttgtgcccgcccgatgagacccgtgagccatgggatcgactattccggactcttcgtttttcagttctggggccgggggacgatggtgaccgtctctagcgcttccacaaaaggacctagcgtgtttcccctggccccttcttccaagagcacctctggcgggacagctgcccttggatgcctggtgaaggattacttccccgaacctgtcaccgtttcctggaatagcggcgcgctcacgtctggcgtgcacacatttccggccgtgctgcagtccagcgggctgtattccctctctagcgtcgtgaccgttccctccagctctctgggaacacagacctacatttgtaacgtgaatcataaaccttccaacaccaaggtcgacaaaaaggtggagcccaaaagctgcgat

SEQ ID NO: 39492 - RNA, 648 nt, synthetic construct; identical to SEQ ID NO: 39368
  misc_feature 1..648: note = derived and/or modified sequence opt5 from anti-HIV_5AWN_LightChain
  source 1..648: mol_type = other RNA

SEQ ID NO: 39493 - RNA, 696 nt, synthetic construct
  misc_feature 1..696: note = derived and/or modified sequence opt5 from anti-HIV_5AWN_HeavyChain
  source 1..696: mol_type = other RNA
caggtgcaactgatgcagagcggcgcccagctcagagaccccggggattccctgaagatctcttgcaaagctagcggatacaacttcattgactatcacatccattgggtccggcttgcccctggccgcgggctggagtggatgggatggattgatccggttggcgggatcaccaagtacgcgggacagtttcaaggcagactctccctgacacgggacacgtctaccaatacacttttcctggaactcagccgcctgaccgctggcgatacagccgtgtatttttgtgccagatccatgcggcccgtggaccacgggattgattactctggactgttcgtctttcatttctggggccgcgggagcgacgtgctcgtttccagcgcttctaccaaaggaccttccgtgtttcccctggcccctagctctaagtccacaagcggcgggaccgctgcccttggatgcctggtcaaagattatttccccgagcctgtgacggtttcttggaactccggcgcgctcaccagcggcgtgcacacatttccggccgtcctgcagtcctctgggctttacagcctgtccagcgtggtgaccgtcccctcttccagcctcggaacacagacctatatctgtaatgttaaccataagccttctaatacgaaggtggacaaaaaggtggaacccaaaagctgcgat

SEQ ID NO: 39494 - RNA, 645 nt, synthetic construct
  misc_feature 1..645: note = derived and/or modified sequence opt5 from anti-HIV_3QEG_LightChain
  source 1..645: mol_type = other RNA
gagatcgtgatgatgcagagccccggcaccctgtccctctctcctggggaaagagccacactgagctgccgggcttcccaatctgtcagctcctcttaccttgcctggtatcagcagaagccgggacaggcgccccgcctgctcatttacggcgctagctccagagccacggggatccctgaccggttcagcggatctggctccgggaccgattttacactgaccattagccgccttgagcccgaagacttcgccgtttattactgtcaacagtatggatcttcccctgagacatttggccagggcaccaaagtggaaatcaagagaacagtggctgcccccagcgtcttcatttttcctccgtctgatgagcagctgaaatccgggaccgctagcgtggtttgcctcctgaacaatttctacccccgggaggccaaggtgcaatggaaagtcgacaacgcgctgcagtccggaaattctcaggaaagcgtgacggagcaggattccaaggacagcacctattctctctccagcacactgaccctttctaaggccgattacgaaaaacacaaggtttacgcttgtgaggtgacacatcaaggcctgagctcccctgtcaccaaatcttttaaccgcggggagtgc

SEQ ID NO: 39495 - RNA, 717 nt, synthetic construct
  misc_feature 1..717: note = derived and/or modified sequence opt5 from anti-HIV_3QEG_HeavyChain
  source 1..717: mol_type = other RNA
caggtgcaactggtccagagcggcgccgaggttaagaaacccgggtcctctgtgaaggtgagctgcagagcttcccggggaaccttctctagctacggcatcacatgggtccgccaggcccctgggcagggactcgaatggatgggcgggattatcccgatttttgacgtgacgaactatgcgcaaaatttccagggaagagttgctatcaccacagatgccgagatgtccaccgcctacatggaactgcggtctcttaaaagcgaggactccgctgtgtattactgtgccagcgattctcgcgacttttcctattacgaacccggcacaagctattctcactactacaacattatggatgtctggggccaggggaccacagtgaccgtttccagcgcttctacgaagggaccttccgtgttccccctggcccctagctccaaatctaccagcggcgggacagcggccctcggatgcctggtcaaggactattttcccgagcctgtgaccgtgtcctggaatagcggcgctcttacatctggggtccataccttcccggccgttctgcagtccagcggactctactctctgagctccgtggtgacggtcccctctagctccctgggcacacaaacctatatctgtaacgtgaatcacaagcctagcaacacaaaagttgataagagagtggagcccaaatcttgcgacaagacccat

SEQ ID NO: 39496 - RNA, 690 nt, synthetic construct
  misc_feature 1..690: note = derived and/or modified sequence opt5 from anti-HIV_1N0X_K-Chain
  source 1..690: mol_type = other RNA
caggtgcaactggtccagagcggcgccgaggttaagaaacccggggcttccgtgaaggtgtcttgccaggccagcggatacagattctccaactttgtcatccactgggtgcggcaggcgcctggccaacgcttcgaatggatggggtggattaatccgtataacggaaataaagagttttctgctaagttccaggacagagttacctttacagccgatacgagcgccaacaccgcttacatggaactccggtccctgcgctctgccgacacagctgtgtattactgtgccagagtcggcccctatagctgggatgactcccctcaggataattactatatggacgtgtgggggaaaggaaccacagttatcgtgagctctgcgtccaccaagggccccagcgtcttccctcttgccccctcttccaagagcacatctggcgggaccgctgccctgggatgcctcgtgaaagattactttcctgagccggtgacggtctcctggaacagcggcgctctgacctccggggttcatacattccccgccgtgcttcagtctagcggactgtactccctcagctctgtggtcaccgtgccttccagctctctgggcacacaaacctatatttgtaatgttaaccacaagcccagcaatacgaaagtggacaagaaagtcgaacctaagtcctgc

SEQ ID NO: 39497 - RNA, 645 nt, synthetic construct
  misc_feature 1..645: note = derived and/or modified sequence opt5 from anti-HIV_1N0X_M-Chain
  source 1..645: mol_type = other RNA
gagatcgtgctgacccagagccccggcacactcagcctgtctcctggggaacgggccacgttcagctgccggtcctctcacagcattcgctccagacgggtcgcttggtaccaacataagccgggacaggcgccccgccttgttatccacggcgtgtctaacagagccagcgggatttccgaccggtttagcggatctggctccgggaccgatttcacactgaccatcacacgcgtggagcctgaagactttgctctctattactgtcaggtctatggagccagctcttacaccttcggccagggcacaaaactggagagaaagcggaccgtggccgctccctccgtttttattttccctcccagcgatgaacaacttaaatctgggacggcctccgtggtctgcctgctcaataacttttatcctcgcgaggctaaggtgcagtggaaagttgacaatgccctgcagagcggaaactcccaggagtctgtgaccgaacaagatagcaaggactccacatacagcctgtcttccaccctcacactgagcaaggcggattatgagaaacataaggtctacgcctgtgaagtgacccaccagggccttagatctccggtgacgaaatccttcaatagaggggagtgc

SEQ ID NO: 39498 - RNA, 654 nt, synthetic construct
  misc_feature 1..654: note = derived and/or modified sequence opt5 from anti-HIV_3QEH_HeavyChain
  source 1..654: mol_type = other RNA
gacatcgtgatgacccagagccccctgtccctccctgtcacaccgggcgaggccgcttctattagctgcagatcctctcaaagcctgcttcacacgaacgggttccagtacctggattggtatctccagaagcccggacagtcccctcaactgcttatctacctgggctctaatcgggccaccggggttccccatcgctttagcggatccggcagcgggacagagttcaccctcaaaatttctagagtggaagcggaagacgtgggagtctattactgtatgcaggctaaggagtcccctacatttggccagggcaccaaagtggaaatcaagcggacagttgccgcccccagcgtgttcatttttcctccgtctgatgagcagctgaaatccgggaccgctagcgtcgtgtgcctgctcaacaatttctatccccgcgaggccaaggttcaatggaaggtggacaacgctctgcagtctggaaattcccaggaaagcgtcacggagcaggattccaaagactctacctacagcctttccagcacactgaccctctctaaggccgattatgaaaaacacaaggtgtacgcgtgtgaggtgacacatcaaggcctgtccagccctgtcaccaaatcttttaacagaggggagtgc

SEQ ID NO: 39499 - RNA, 696 nt, synthetic construct
  misc_feature 1..696: note = derived and/or modified sequence opt5 from anti-HIV_3QEH_G-Chain
  source 1..696: mol_type = other RNA
caggtgcaactggtccagagcggcgccgaggttagaaagcccggggcttccgtgaccgtgtcttgcaaaacaagcggatacacgttcgtcaacttttatatcgtgtgggttcggcaggcccctggccaggggctcgaatggatgggagtgattaatccgttccgcggcgacacctactttgcgcaaaagttcaaagggagagtcacactgacccgggatacatccacctctacagtgtttatggagcttagctccctgcgctctgacgataccgctatctattactgtgccagagacctcgaaatgcgggatggaaacaatcacggcagccatctggagttctggggccaggggacgcttgttaccgtgtccagcgcctctacaaagggaccctccgtctttcctctggctcccagctctaaatccaccagcggcgggacagccgctctcggatgcctggtgaaggactatttccctgaacccgtgaccgtctcttggaactccggcgccctgacgagcggggttcacacatttcctgcggtgctccagtcctctggactgtacagcctttccagcgtggtcaccgtgccgtcttccagcctgggcacacagacctatatttgtaatgttaaccataagccctctaataccaaagtggataagcgcgtcgagcctaaaagctgcgacaagacacac

SEQ ID NO: 39500 - RNA, 678 nt, synthetic construct
  misc_feature 1..678: note = derived and/or modified sequence opt5 from anti-HIV_2B1H_HeavyChain
  source 1..678: mol_type = other RNA
gagatccagctggaacaaagcggcgccgaggtgaagaaatccggggaatctctcaagattagctgccagacctccggatactctttcagcgactattggatcggctgggtcagacagatgcccgggaaaggactggagtggatgggcatcttttaccctggggattccgactctcggtatagcccgtccttcgaaggacaggttacaatgagcgctgatcgctctacgaacaccgcccaccttcaatggtccagcctgaagccctctgacacagcgctctactattgtgctagactgggcggcgattacgaggactccggggccgatgcctttgacttctggggacagggcacccttgtgacagtgagctctgcttccaccaaagggcctagcgtctttcccctggccccttcctctaagagcacatccggaggcaccgctgccctcgggtgcctggtgaaggattatttccccgagcctgttacggtgagctggaactctggagcgctgacctccggcgtccatacatttccggccgtgctccagagctctggcctgtacagcctttcctctgttgtgaccgtccccagctccagcctggggacacagacctacatttgtaatgtgaatcacaaaccttctaacacgaaggtggacaaaaaggtcgaacccaaatcc

SEQ ID NO: 39501 - RNA, 645 nt, synthetic construct
  misc_feature 1..645: note = derived and/or modified sequence opt5 from anti-HIV_2B1H_LightChain
  source 1..645: mol_type = other RNA
cagagcgtgctgacccaacccccttccgcctctggcacaccggggcagagaatcagcatttcctgctctggaacgagctccaacgtcgagaataactacgtttattggtaccagcacctccccggcaccgctcctaagctgcttatctatcggaatgaccatcgctctagcgggattcccgatagattctccgccagcaaatctggaacatccgcgagcctggctatctctggcctccggcctgaagacgagggggattactattgtgccgcctgggacgattcccgcggaggccccgactgggtgtttggcgggggaaccaagctgacagtgcttgctcagcctaaagccgctccgagcgtcaccctgtttcccccttcttccgaggaactccaagccaacaaggcgacactggtgtgcctgattagcgatttctaccccggcgccgttaccgtggcttggaaagccgactcctctcctgtcaaggctggggtggaaacgaccacacccagcaagcagtccaataacaaatatgccgcgagctcttacctctccctgaccccggagcagtggaaaagccacaagtcttacagctgtcaggttacacatgagggatccaccgtggaaaagacggtcgcccctaca

SEQ ID NO: 39502 - RNA, 648 nt, synthetic construct
  misc_feature 1..648: note = derived and/or modified sequence opt5 from anti-HIV_3TNM_B-Chain
  source 1..648: mol_type = other RNA
cagagcgtgctgacccaacccccttccgcctctggcagcccggggcagtccgtcacaatctcttgcacgggaaccagctccgacgttggcgggtacaactatgtgtcttggtaccagcaccatcccggaaaggctcctaaactcattatcagcgaggtgaataacagaccctccggcgtccctgatcggttcagcgggtctaagtccggaaatacagccagcctgaccgtgtctggccttcaggcggaagacgaggctgaatattactgttccagctatacagatattcacaactttgttttcggcgggggaaccaaactgacagtgctcggccaacccaaggccgccccttctgtcaccctgtttccgccctccagcgaggaacttcaggctaataaagccacgctggtgtgcctcatctccgacttctaccctggggctgttaccgtggcctggaaggcggattctagccccgtcaaggccggagtggagacaaccacaccttccaaacagagcaacaataagtatgctgcctcttcctacctgagcctgacccccgagcagtggaaatctcatcgcagctactcctgtcaagtgacgcacgaaggctctacagtcgagaagaccgttgctccgacagaatgcagc

SEQ ID NO: 39503 - RNA, 693 nt, synthetic construct
  misc_feature 1..693: note = derived and/or modified sequence opt5 from anti-HIV_3TNM_A-Chain
  source 1..693: mol_type = other RNA
caggtgcaactgcaggagagcggccccgggctcgtcaagccttcccagaccctgtctcttagctgcacagtttccggaggctctagctcctctggggcccactactggagctggatcagacagtatccgggaaaaggcctggaatggattgggtacatccattattccggaaacacgtactataatcccagcctcaagtctcggattaccatctcccaacacacaagcgagaaccagttctctctgaaacttaattccgtgaccgtggctgacacagccgtctactattgtgcgcgcggcaccagactgcggacactccgcaacgcttttgatatttggggccaggggaccatggtgacggttagctctgcctccaccaagggacctagcgtgttccccctggccccttcctctaaaagcacatccggcgggaccgctgccctgggatgcctcgtcaaggactactttcccgaacctgtgacagttagctggaactctggcgctctgacctccggggtgcatacgttcccggccgtccttcagagctctggactgtacagcctctcctctgtggtgacagtccccagctccagcctgggcacccaaacatatatctgtaatgttaatcacaagccttctaacaccaaagtggataagagagtggagcccaaatcctgcgacaagacccataca

SEQ ID NO: 39504 - RNA, 690 nt, synthetic construct
  misc_feature 1..690: note = derived and/or modified sequence opt5 from anti-HIV_3UJJ_HeavyChain
  source 1..690: mol_type = other RNA
gaggtgcagctggtccaaagcggcgccgaagttaagaaacccggggagtccctcaagatctcttgcaaagctagcggatactccttctctagctattggattgcctgggtgagacagatgcctggcaaggggctggaatggatgggatttatctacccggcggactccgatacccggtattctcccagcttccagggccaggggacaatttccgctgacaaaagcatctctacggcctaccttcaatggtccagcctgaaggcctctgataccgctatgtattactgtgccattctcggattttggggcgctaaccgcggcgggggaggcatggacgtgtgggggcagggaacaaccgtcatcgtgtccagcgcctctacaaagggcccttccgttttccccctggcgcctagctccaaatctaccagcgggggaacagccgctcttggctgcctggtgaaggattattttcccgagcctgtcaccgtgtcctggaatagcggcgccctcacgtctggggttcacaccttcccggctgtgctgcagtccagcggactgtactctctcagctccgtcgtgacagtgccctctagctccctgggcacccagacatacatctgtaacgtcaatcataaacctagcaacaccaaggttgacaaaaaggtggaacccaagtcttgcgataaaacg

SEQ ID NO: 39505 - RNA, 639 nt, synthetic construct
  misc_feature 1..639: note = derived and/or modified sequence opt5 from anti-HIV_3UJJ_LightChain
  source 1..639: mol_type = other RNA
agctacgagctgacccagcccccttccgtgtctgtcagcccgggccaaacagccagaatcacgtgctccggggacgctctccccgaaaagtatgcctactggtatcagcagaaatctggacaggcgcctgttctgattatctacgaggatagcaagcggccctccggcattcctgaacgcttctctgggagcagatccggaaccatggctacacttaccatcagcggcgcccaagtggacgatgaggccgactattactgttattctacaaactccgggggaacctttttcgtgtttggcacaggcaccaaagtcacggtgctggggcagcccaaggctaatcctaccgttacactcttcccgcccagctctgaggaactgcaggccaacaaagctacccttgtgtgcctgatttccgatttttaccctggagccgtcacagtggcgtggaaggccgacagctctcccgttaaggctggcgtggagaccacgacaccttccaaacagagcaataacaagtacgccgcttcctcttatctcagcctgacccccgaacaatggaaatcccaccggagctactcttgtcaggtcacacatgaggggtccaccgtggaaaagaccgtggccccgacagagtgc

SEQ ID NO: 39506 - RNA, 669 nt, synthetic construct
  misc_feature 1..669: note = derived and/or modified sequence opt5 from anti-HIV_3UJI_HeavyChain
  source 1..669: mol_type = other RNA
caggtgcaactggtccagagcgccgctgaggttaagaaacccggcgaagccctcaagatctcctgcaaagggtctggatacagcttctccaactattggattgcgtgggtgagacagatgcctggcaaggggctggagtggatgggaatcgtgtacccggacgattctgacagctcctataattctagctttcagggccaaattaccttctccgctgataaaagcatctctacagcctaccttcactggacgtccctgcaggccagcgacaccgctatgtattactgtgcccggctcgggtttgaaggagattattctggctccttctttgactactggggccaggggacactgcttattgtcagctctgcttccaccaagggacccagcgtgttccctctggccccctcctctaagagcacatccggcgggaccgcggccctcggatgcctggttaaagattactttcctgagcccgtgacagtcagctggaactctggcgctctgacctccggggtgcatacgttccctgccgttctccagagctctggactgtatagcctttcctctgtggtcaccgtgccgagctccagcctgggcacacaaacctacatctgtaatgtgaaccacaagccctctaatacaaaagtcgacaagaaagttgaacct

SEQ ID NO: 39507 - RNA, 627 nt, synthetic construct
  misc_feature 1..627: note = derived and/or modified sequence opt5 from anti-HIV_3UJI_LightChain
  source 1..627: mol_type = other RNA
agctacgagctgacccagcccccttccgtgtctgtcagcccgggccaaacagcctccatcacgtgctctggggacattctcggagataagtatgttagctggtaccagcagaaatccggccagtctcccctgcttgtgatctatgaagacaccaagagacctagcgggattcccgatcggttctccggaagcaaatctggcaacacagctaccctgacaatctccgggacccaagccatggacgaggcggattactattgtcaggcttgggacagcacactcggagtggtctttggcggcgggaccaaggtgacggttctgggacagcctaaagccgccccctctgtgacccttttccctccgtccagcgaggaactgcaggctaataaggccacactcgtctgcctgatttctgatttttaccccggcgctgtgaccgttgcctggaaggcggactccagccctgtgaaagccggggtcgaaacaaccacgccctccaagcaatctaacaataaatatgctgccagctcctacctgagcctcacacctgagcagtggaagtctcacaaatcctacagctgtcaggtgacccatgagggatctacagtggaaaagaccgtcgctccc

SEQ ID NO: 39508 - RNA, 666 nt, synthetic construct
  misc_feature 1..666: note = derived and/or modified sequence opt5 from anti-HIV_2QSC_HeavyChain
  source 1..666: mol_type = other RNA
caggtgcaactggtccagagcggcgggggactcgttcagcccggcgggtccctgagactttcttgcgccgctttcggatttaacttcagctcctacgtgatgcactgggtgcggcaggcccctggccaagggctggagtatctctctgcgatcagctccgacggagaaaccacataccatgctaattctgtcaagggccgctttacgagctccagagataacagcaaaaataccctgttccttcagatgggctctctgcggacagaggacgtggccgtttattactgtgcccgcgatagatattacgaaacctccgggagcaacgcttttgacgtgtggggacagggcacaatggtcgtggtttcttccgccagcaccaaggggccgtctgtgttccccctcgctccttgctcccggagcacatccgagtctaccgccgcgctgggatgtctggtcaaagattattttcccgaacctgtgacggtgagctggaactccggcgccctcaccagcggggtccacacattccccgctgttctgcagtcttccggactttacagcctgtctagcgtggtgaccgtcccttcctctaattttggcacacaaacctacacgtgcaatgtggaccataagccgagcaacacaaaagttgataagaccgtggag

SEQ ID NO: 39509 - RNA, 645 nt, synthetic construct
  misc_feature 1..645: note = derived and/or modified sequence opt5 from anti-HIV_2QSC_LightChain
  source 1..645: mol_type = other RNA
aacagcgtgctgacccagtccccctctagcctctccgcctctgtcggcgaccgggttacaatcacgtgccaagctagccaggatatttccaattacctgaactggtatcagcacaagcctgggaaagccccgaaacttctgatctacaccgcgtctaatctcgagacaggagtgcccagccggttctccggcgggggaagcggcacccatttttctttcacaattacctccctgcagcctgaagacgctgccacatatttttgtcaacagtacgataaccttggggacctgagcttcggaggcggcaccaaagtggagatcaagcgcacggtcgccgctccctctgtgtttattttccctccctccgatgaacagctcaaaagcgggaccgcctctgttgtgtgcctgctgaataacttttatcctagagaggctaaggtccagtggaaggtggacaatgccctccaatccggaaacagccaggaatccgttacagagcaggattctaaagacagcacctactccctgagctctacacttaccctgtccaaggcggattatgagaaacacaaggtgtacgcctgtgaagtcacgcatcagggcctcagctctccggtgacaaagagcttcaatagaggggagtgc

SEQ ID NO: 39510 - RNA, 690 nt, synthetic construct
  misc_feature 1..690: note = derived and/or modified sequence opt5 from anti-HIV_3MLZ_HeavyChain
  source 1..690: mol_type = other RNA
caggtgcaactgcaggagagcggccccgggctcgtcaagccttccgaaaccctgtctcttacatgcacggttagcggaggctccatctctgggttccactggagctggattagacagccgcccggaaaaggcctggagtacatcgggtatatttactattccggatctaccagctacaacccttccctcaagagccgggtgtctatgtccgtggacacaagccgcaatcagttttctctggaactttccagcgtcaccgccgctgatacagccgtgtattactgtgcgagagacttcggcgagtatcattacgatggccgggggtttcaatgcgaaggattcgacctgtggggccaggggaccctcgttacagtgtcttccgctagcaccaaaggaccctccgtctttcctctggccccctctagcaagtccacgagcggcgggaccgccgctctgggatgtctcgtgaaagattacttccctgagccggttacagtgtcttggaactccggcgccctgaccagcggcgtccacacatttcccgctgtgcttcagtctagcgggctgtattccctctctagcgtggtcaccgttccttccagctctctgggaacgcagacatacatctgcaatgtgaaccataagccctccaataccaaggtggacaaaaaggtcgagcctaaaagctgt

SEQ ID NO: 39511 - RNA, 642 nt, synthetic construct
  misc_feature 1..642: note = derived and/or modified sequence opt5 from anti-HIV_3MLZ_LightChain
  source 1..642: mol_type = other RNA
cagagcgtgctgacccaacccccttccgtctctgccgctccgggccagaaggttacaatcagctgctccgggtctagctccaacattggaaataacatggtgtcttggtaccagcagcaccccggcacggcccctaaactcctgatctatgagaatagcaagagaccctccgggattcctgaccggttcagcggatctcgctccggcaccagcgcgacacttgggatcattggactgcaaaccggcgatgaagctgagtactattgtgccacatgggacggctctctcagaaccgtgtttgggggaggcacaaaactgaccgtcctttcccagcccaaggccgctcctagcgtgacgctgttcccgccctcttccgaggaactccaggccaacaaagctaccctggtttgcctgatcagcgatttttaccctggggccgtgacagtcgcgtggaaggccgactcctctcccgtgcgggctggagttgaaaccacaacccctagcaagcagtccaataacaaatatgccgctagctcttacctctccctgacgcccgagcaatggaaaagccatcgctcttatagctgtcaggtgacacacgagggctccaccgtcgaaaagacagtggccccgaccgagtgc

SEQ ID NO: 39512 - RNA, 684 nt, synthetic construct
  misc_feature 1..684: note = derived and/or modified sequence opt5 from anti-HIV_3MLX_I-Chain
  source 1..684: mol_type = other RNA
caggtgcaactgcaggagagcggccccgggctcgtcaagccttccgaaaccctgtctcttacatgcacggttagcggaggctccatctctgggttccactggagctggattagacagccgcccggaaaaggcctggagtacatcgggtatatttactattccggatctaccagctacaacccttccctcaagagccgggtgtctatgtccgtggacacaagccgcaatcagttttctctggaactttccagcgtcaccgccgctgatacagccgtgtattactgtgcgagagacttcggcgagtatcattacgatggccgggggtttcaatgcgaaggattcgacctgtggggccaggggaccctcgttacagtgtcttccgctagcaccaaaggaccctccgtctttcctctggccccctctagcaagtccacgagcggcgggaccgccgctctgggatgtctcgtgaaagattacttccctgagccggttacagtgtcttggaactccggcgccctgaccagcggcgtccacacatttcccgctgtgcttcagtctagcgggctgtattccctctctagcgtggtcaccgttccttccagctctctgggaacgcagacatacatctgcaatgtgaaccataagccctccaataccaaggtggacaaaaaggtcgagcctaaa

SEQ ID NO: 39513 - RNA, 633 nt, synthetic construct
  misc_feature 1..633: note = derived and/or modified sequence opt5 from anti-HIV_3MLX_M-Chain
  source 1..633: mol_type = other RNA
agcgtgctgacccagcccccttccgtctctgccgctccgggccaaaaggttacaatcagctgctccgggtctagctccaacattggaaataacatggtgtcttggtaccagcagcaccccggcacggcccctaaactcctgatctatgagaatagcaagagaccctccgggattcctgaccggttcagcggatctcgctccggcaccagcgcgacacttgggatcattggactgcagaccggcgatgaagctgagtactattgtgccacatgggacggctctctcagaaccgtgtttgggggaggcacaaaactgaccgtcctttcccaacccaaggccgctcctagcgtgacgctgttcccgccctcttccgaggaactccaggccaacaaagctaccctggtttgcctgatcagcgatttttaccctggggccgtgacagtcgcgtggaaggccgactcctctcccgtgcgggctggagttgaaaccacaacccctagcaagcagtccaataacaaatatgccgctagctcttacctctccctgacgcccgagcagtggaaaagccatcgctcttatagctgtcaagtgacacacgagggctccaccgtcgaaaagacagtggccccgacc

SEQ ID NO: 39514 - RNA, 684 nt, synthetic construct
  misc_feature 1..684: note = derived and/or modified sequence opt5 from anti-HIV_3MLW_I-Chain
  source 1..684: mol_type = other RNA
caggtgcaactggtccagagcggcgccgaggttaagaaagctggggaatccctcgagatctcttgcaagggaagcggctacaccttcacagaccactggattgcctgggtgagacaggtgcccgggaaaggactggaatggatgggcatgatctatcctggggattccgacacgcggtactctccgagccttcagggacgcgtcaccatgtccgcggataagacactgtctaccgcttatctccaatggagcagactggaggcctccgacacagccatgtactattgtgctcggcttcattacagcgatcgctctggctcctattttaacgacgtgttccacatgtggggccaggggaccacagttaccgtgagctctgcctccacgaaaggacccagcgtctttcctctggctccctcttccaagagcacctccggcgggacagccgcgctcggatgcctggtgaaggattacttccctgaacccgttaccgtgtcttggaatagcggcgccctgacatccggggtccatacctttcctgctgtgctccagagctctggactgtactcccttagctctgtggtcacggttccgagctcctctctgggcacacagacctatatttgtaacgtgaatcacaaacccagcaacacaaaggtggacaaaaaggtcgagcctaaatcc

SEQ ID NO: 39515 - RNA, 645 nt, synthetic construct
  misc_feature 1..645: note = derived and/or modified sequence opt5 from anti-HIV_3MLW_M-Chain
  source 1..645: mol_type = other RNA
cagagcgtgctgacccaacccccttccgcctctggcacaccggggcagagagtcacgatcagctgctccggaaactctagcaatattgagaacaattacgtttattggtaccagcagctccccggctccacccctaagctgcttatcttccgggacgatcaacgcccctctggggtgcctgacagatttagcggatccaaaagcggcacatctgcttccctggccattagcgggctccggtctgaagatgaggcggactattactgtgcttcctgggatgacagccgcggaggccccgattatgtgttcggcaccgggacaaaggtcaccgtgctgggacagcctaaagccaacccgacagttaccctttttcccccttcttccgaggaactgcaggccaataaggctacgctcgtgtgcctgatcagcgacttctaccccggcgccgtcaccgtggcttggaaagccgatgggtcccctgttaaggcgggagtggaaacaaccaagccctctaaacagagcaacaataagtatgccgcttccagctacctgtctctcacaccggagcaatggaaatcccacagaagctactcttgtcaggtcacccatgagggcagcacggtggaaaagacagtggcccctacc

SEQ ID NO: 39516 - RNA, 678 nt, synthetic construct
  misc_feature 1..678: note = derived and/or modified sequence opt5 from anti-HIV_3MLV_N-Chain
  source 1..678: mol_type = other RNA
gaggtgcagctggtcgaaagcggcggggaggttaagcaacccggacagtccctcaaaatctcttgcaagagctccggctacaacttcctggactcttggattgggtgggtgagacagatccctggaaaaggccttgaatggattgggatcatttatccggatgacagcgatgcccactactccccctcttttgagggacaggtgaccatgagcgtcgacaagtccatcagcacagcttatctgcaatggacgaccctccaggcctctgatacaggcaaatacttctgtacccggctgtatctttttgaaggcgcgcagtccagcaatgctttcgacctgtgggggcagggaacaatgatcctcgtgtcttccggcaccacaaaggggcctagcgtttttcccctggccccttcttccaagagcacctccggaggcacggccgctctggggtgcctcgtgaaagattacttccccgagcctgtcaccgtgtcttggaacagcggagccctgacatccggcgttcatacctttccggctgtgcttcaaagctctggcctgtattccctcagctctgtcgtgacagtgcccagctcctctctggggacccagacgtacatttgtaatgtcaaccacaagcctagcaatacaaaagttgacaagaaagtggagcccaagtcc

SEQ ID NO: 39517 - RNA, 657 nt, synthetic construct
  misc_feature 1..657: note = derived and/or modified sequence opt5 from anti-HIV_3MLV_M-Chain
  source 1..657: mol_type = other RNA
agctacctgctcacccagcccccttccgtgtctgtcagcccgggccaaacagcctccatctcttgcagcggggacaagctggatgacaaatatgtttcctggtactatcagagacccggacagtctcctgtgcttctgatgtaccaggatttcaagcggcccagcggcattcctgagcgcctctccgggagcaaatctggaaagacggctaccctgacaatctccggcacccaaagccttgacgaaggggattattactgtcaggcctgggacgcgtctacaggagtgtccggcggcgggaccaaactgacagtcctctttggagagggcaccagactgacggtgctggctcagcccaaggccgcccctagcgttaccctcttcccgccctcttccgaggaactgcaggctaacaaggccacacttgtgtgcctgattagcgatttttatcctggggctgtcaccgtggcctggaaagcggactcctctcccgttaaggccggagtggaaacaaccacgcctagcaaacaatccaataacaagtacgctgccagctcttacctctccctgacacccgagcagtggaaaagccacaagtcttatagctgtcaggtcacccatgagggctccacagtggaaaagaccgtggctccgacc

SEQ ID NO: 39518 - RNA, 654 nt, synthetic construct
  misc_feature 1..654: note = derived and/or modified sequence opt5 from anti-HIV_3MLU_LightChain
  source 1..654: mol_type = other RNA
tacctgctcacccagccccctagcgtgtccgtctctccgggccaaacagccagcatctcctgctctggggacaagctggatgacaaatatgttagctggtactatcagagacccggacagtcccctgtgcttctgatgtaccaggatttcaagcggccctctggcattcctgagcgcctcagcgggtccaaaagcggaaagacggctaccctgacaatctctggcacccaatcccttgacgaaggggattattactgtcaggcctgggacgcgagcacaggagtgtctggcggcgggaccaaactgacagtcctctttggagagggcaccagactgacggtgctggctcagcccaaggccgccccttccgttaccctcttcccgcccagctctgaggaactgcaggctaacaaggccacacttgtgtgcctgatttccgatttttatcctggggctgtcaccgtggcctggaaagcggacagctcccccgttaaggccggagtggaaacaaccacgccttctaaacaaagcaataacaagtacgctgcctccagctacctctctctgacacccgagcagtggaaatcccacaagagctattcttgtcaggtcacccatgagggcagcacagtggaaaagaccgtggctccgacc

SEQ ID NO: 39519 - RNA, 657 nt, synthetic construct
  misc_feature 1..657: note = derived and/or modified sequence opt5 from anti-HIV_3MLT_G-Chain
  source 1..657: mol_type = other RNA
agctacgacctgacccagcccccttccgtgtctgtcagcccgggccaaacagcctccatctcttgcagcggggataagctcgacgataaatatgtttcctggtactatcagagacccggacagtctcctgtgctgcttatgtaccaggacttcaagcggcccagcggcattcctgagcgcctgtccgggagcaaatctggaaagacggctaccctcacaatctccggcacccaaagcctggatgaaggggactattactgtcaggcctgggatgcgtctacaggagtgtccggcggcgggaccaaacttacagtcctgtttggagacggcaccagactcacggtgctggggcagcccaaggctgcccctagcgttaccctgttcccgccctcttccgaggaactccaggccaacaaggctacactggtgtgccttattagcgatttttatcctggagccgtcaccgtggcttggaaagccgactcctctcccgttaaggcgggcgtggagacaaccacgcctagcaaacaatccaataacaagtacgccgctagctcttacctgtccctcacacccgaacagtggaaaagccacaagtcttatagctgtcaggtcacccatgaggggtccacagtggagaagaccgtggccccgacc

SEQ ID NO: 39520 - RNA, 666 nt, synthetic construct
  misc_feature 1..666: note = derived and/or modified sequence opt5 from anti-HIV_3GO1_HeavyChain
  source 1..666: mol_type = other RNA
gaggtgcagctgcaagaaagcggccccgggctcgtcaagccttccgagaccctgtctcttacatgcacggttagcggaggcccgatcaacaatgcctactggacctggattagacagccccctgggaaaggactggaatatctcggctacgtgtatcacacaggggtgaccaactacaatccctccctgaagtctcggcttacaatcaccattgacacaagccgcaaacagctgtccctctctctgaagttcgtcaccgctgccgatagcgcggtgtattactgtgctagagagtgggccgaagacggagattttggcaacgccttccatgtttggggccaggggacgatggtggctgtctccagcgcctctaccaaaggaccttccgtgtttcccctggctcctagctctaagtccacaagcggcgggaccgccgcgctcggatgcctggttaaggactatttcccggagcccgtgacagtctcttggaactccggcgcccttaccagcggggtgcacacgtttcctgctgtgctgcaatcctctggactctacagcctgtccagcgtcgttacagtgccctcttccagccttggcacccagacatacatctgtaatgtgaatcataaaccttctaacaccaaggtcgataaacgggtggagccc

SEQ ID NO: 39521 - RNA, 627 nt, synthetic construct
  misc_feature 1..627: note = derived and/or modified sequence opt5 from anti-HIV_3GO1_LightChain
  source 1..627: mol_type = other RNA
agctacgtgctgacccagcccccttccgtctctgttagcccgggccaaacagccagaatcacgtgctccgctgaggccctctctaaccagtatgcgtactggtatcggcagcgccccgggcaggctcctctgcttattatctacaaggacaccaaaagacccagcggcattcctgaacggttctccggatctacaagcgggaccacagtgaccctgacaatctccggagtgcaagccgaggatgaagccgactattactgtcagagcgctgattcttccggcgactatgtctttgggggaggcaccaaggtgacggttctcggccagcccaaagccaatcctaccgtgacactgttcccgcccagctctgaggaacttcaggctaacaaggccaccctggtctgcctcatttccgatttttaccctggggcggtgacagttgcctggaaagctgacggaagccccgtgaaggccggcgtcgagaccacgaagccttctaaacaatccaataacaagtacgctgccagctcctatctgtctctgacacccgagcagtggaaaagccaccgctcctacagctgtcaggtgacccatgaagggtctacagtggagaagaccgtcgcgccg

SEQ ID NO: 39522 - RNA, 690 nt, synthetic construct
  misc_feature 1..690: note = derived and/or modified sequence opt5 from anti-HIV_4XCY_J-Chain
  source 1..690: mol_type = other RNA
caggtgcaactggtccagagcggcgccgaggttaagagacccgggtcctctgtgaccgtgagctgcaaggcttccggaggctctttcagcacatacgccctctcctgggtccggcaggcgcctgggcgcggactggaatggatgggcggggtgatcccgcttctgacgattaccaactatgctcccagatttcagggacggatcacaattaccgccgaccgctctacaagcaccgcctacctcgagcttaattccctgagacctgaagatacagctgtttattactgtgcccgggagggcaccacgggctgggggtggctgggaaaacccatcggcgctttcgcccactgggggcaaggaaccctcgtgacagtcagctctgcgtccaccaaaggccctagcgtgtttcccctggccccttcttccaagagcacatctgggggaaccgctgccctgggctgcctcgttaaagactatttcccggaacccgtgacggtctcctggaacagcggcgctctgacatccggggtgcatacctttcctgccgtgcttcagtctagcggactgtactccctcagctctgtcgttacagtgccctccagctctctgggcacccagacctatatttgtaatgtgaaccacaagcctagcaatacaaaggtcgataaaaaggtggagcccaaatcctgc

SEQ ID NO: 39523 - RNA, 645 nt, synthetic construct
  misc_feature 1..645: note = derived and/or modified sequence opt5 from anti-HIV_4XCY_K-Chain
  source 1..645: mol_type = other RNA
gagatcgtgctgacccagagccccggcacacaatccctctctcctggggaaagagccacgctgagctgccgggcttcccagtctgtcggaaacaataaacttgcctggtaccagcagcgcccgggccaagcgcccagactgctcatttatggggctagctcccggccttctggagttgccgaccgcttcagcggctccgggagcggaaccgattttacactgaccatctctagacttgagcccgaagacttcgccgtgtactattgtcagcagtacggccagtccctgagcacatttggccaagggaccaaagtggaggtcaagcggacagtggctgccccttctgttttcatttttcccccttccgatgaacagctcaaaagcggaaccgcttctgtggtctgcctgctgaacaatttctatccgcgcgaggccaaggtgcagtggaaagttgacaacgcgctccagtccggcaatagccaagagtccgtgacggaacaggattctaaggacagcacctactccctgagctctacacttaccctgtccaaggccgattatgagaaacacaaggtctacgcttgtgaagtgacacatcaggggctcagctctcccgtgaccaagagctttaacagaggagagtgc

SEQ ID NO: 39524 - RNA, 630 nt, synthetic construct
  misc_feature 1..630: note = derived and/or modified sequence opt5 from anti-HIV_4YBL_C-Chain
  source 1..630: mol_type = other RNA
gtgctgacccagccccctagcgcctccggctctccggggcaaagcgtcacaatctcctgcacgggaacctctagcgacgttggcgggtacaactatgtgtcctggtaccagcaccatcccggaaaggctcctaaactcattatctctgaggtgaataacagacccagcggcgtccctgatcggttctccgggagcaagtctggaaatacagcctccctgaccgtgagcggccttcaggcggaagacgaggctgaatattactgttcttcctatacagatattcacaactttgttttcggcgggggaaccaaactgacagtgctcggccagcccaaggccgcccctagcgtcaccctgtttccgccctcttccgaggaacttcaagctaataaagccacgctggtgtgcctcatcagcgacttctaccctggggctgttaccgtggcctggaaggcggattcctctcccgtcaaggccggagtggagacaaccacacctagcaaacagtccaacaataagtatgctgccagctcttacctgtccctgacccccgagcagtggaaaagccatcgctcttacagctgtcaggtgacgcacgaaggctccacagtcgagaagaccgttgctccg

SEQ ID NO: 39525 - RNA, 672 nt, synthetic construct
  misc_feature 1..672: note = derived and/or modified sequence opt5 from anti-HIV_4YBL_B-Chain
  source 1..672: mol_type = other RNA
caggtgcaactgcaggagagcggccccgggctcgtcaagccttcccagaccctgtctcttagctgcacagtttccggaggctctagctcctctggggcccactactggagctggatcagacagtatccgggaaaaggcctggaatggattgggtacatccattattccggaaacacgtactataatcccagcctcaagtctcggattaccatctcccaacacacaagcgagaaccagttctctctgaaacttaattccgtgaccgtggctgacacagccgtctactattgtgcgcgcggcaccagactgcggacactccgcaacgcttttgatatttggggccaggggaccatggtgacggttagctctgcctccaccaagggacctagcgtgttccccctggccccttcctctaaaagcacatccggcgggaccgctgccctgggatgcctcgtcaaggactactttcccgaacctgtgacagttagctggaactctggcgctctgacctccggggtgcatacgttcccggccgtccttcagagctctggactgtacagcctctcctctgtggtgacagtccccagctccagcctgggcacccaaacatatatctgtaatgttaatcacaagccttctaacaccaaagtggataagagagtggagcccaaa

SEQ ID NO: 39526 - RNA, 630 nt, synthetic construct
  misc_feature 1..630: note = derived and/or modified sequence opt5 from anti-HIV_4R4N_X-Chain
  source 1..630: mol_type = other RNA
gacatccagatgacccaaagcccctccttcgtgtctgccagcgtcggcgatagagttacaattacgtgccgggcttcccaggggatctctagctacctggcctggtatcagcagaagcctggaaaagcgccgaagctcgtgatttacgctgcctccaccctgcaatctggcgtgcccagccgcttttccgggagcggatctggcacagagttcacccttacaatctccagcctgcagcctgaagactttgccacctattactgtcagcacctcattgggctgagatctttcggacagggcacaaaacttgagatcaagcggaccgtcgctgccccctccgtgtttatcttccctcccagcgatgaacaactgaaatctggcacggcttccgttgtgtgcctcctgaacaatttttatcctcgcgaggccaaggtccagtggaaggtggacaacgcgctgcagagcggaaattcccaggaatctgttaccgagcaagatagcaaagactccacatacagcctctcttccaccctgacacttagcaaggccgattatgagaaacataaggtgtacgcttgtgaagtcacccaccaggggctgtctagcccggtgacgaaatccttcaacaga

SEQ ID NO: 39527 - RNA, 660 nt, synthetic construct
  misc_feature 1..660: note = derived and/or modified sequence opt5 from anti-HIV_4R4B_F-Chain
  source 1..660: mol_type = other RNA
caggtgcaactgcagcagtggggcgccgggctcctgaagcccagcgagaccctttccctgacatgcggagtctacggcgaatctctcagcgggcactattggtcctgggttagacagcctccgggaaaacggctggagtggatcggcgaaattaagcataacgggtctcccaattaccaccctagccttaaatcccgcgtgacgatctctctggacatgagcaagaaccaattctccctcaatctgaccagcgtgacagctgccgataccgcggtctatttttgtgctagacggtctaactggccctacctgcctttcgacccctggggacagggcacactcgtgaccgtttccagcgcctctacaaaaggcccttccgtgtttccgctggcccccagctctaagtccaccagcgggggaacggctgcccttggctgcctggtcaaggattatttccctgagcccgtgaccgtttcctggaactctggggctctcacaagcggagtgcatacctttcctgccgtcctgcagtccagcggcctttactctctgtccagcgtggtgacagtcccctctagctccctcgggacccagacgtatatttgtaatgttaatcacaaaccgtctaacacaaaggtggacaaaaaggtggaacctaaa

SEQ ID NO: 39528 - RNA, 750 nt, synthetic construct
  misc_feature 1..750: note = derived and/or modified sequence opt5 from anti-HIV_3JUY_D-Chain
  source 1..750: mol_type = other RNA
caggtgcaactggtccagagcggcgccgaggttaagaaacccggggcttccgtgaaggtgtcttgccaggccagcggatacagattctcccactttaccgtccattgggtgcggcaggcgcctggccaacgcttcgaatggatggggtggatcaacccgtataatggaaacaaagagttttctgctaagttccaggacagagttacatttacggccgataccagcgccaatacagcttacatggaactccggtccctgcgctctgccgacaccgctgtgtattactgtgccagagtcggcgagtgggggtgggatgacagcccctatgataactactatatggacgtgtggggaaaaggcacaaccgttattgtgtccagcggcgggggaggctctgggggaggcgggtccggaggcggcgggagcgaaatcgtccttacacaggcgcctggaaccctgtctctctcccccggcgagcgggccacgttcagctgcagatcttcccacagcattcgctcccggcgcgtggcttggtaccagcataagcctgggcaagcccccagactggtgatccacggagtctctaatcgggctagcggcatttccgatcgctttagcgggtctggatccggcaccgacttcacacttaccatcacaagagttgagcctgaagattttgccctgtactattgtcaggtgtacggcgcgagctcttataccttcgggcagggaacgaagctcgagcggaaa

SEQ ID NO: 39529 - RNA, 369 nt, synthetic construct
  misc_feature 1..369: note = derived and/or modified sequence opt5 from anti-HIV_4KG5_HeavyChain
  source 1..369: mol_type = other RNA
cagctggtgcaaagcggccccgaggccaagagacctgggtcctctgtcaaagttagctgcaaggcttcccgggacaccttcaacaattacgtgctcaactgggtgcgccaggccccgggacagggcctggaatggatgggagggatcggccccattatcgagacagcggattatgctgaaaaatttagagggcggctttctattacggccgacgagagcaccacaaccgcctacatggaactgtcctctctcacaagcgatgacaccgctgtctattactgtgcccgctccccttatagctctctgacagatacctactattactacatggacctttggggaaagggcacgaccgtgacagtttccagc

SEQ ID NO: 39530 - RNA, 336 nt, synthetic construct
  misc_feature 1..336: note = derived and/or modified sequence opt5 from anti-HIV_4KG5_LightChain
  source 1..336: mol_type = other RNA
ctgacccagagccccgactccctcgccgtgtctctgggcgagagagctacaatcaactgcaagagctcccaatctattcttgatagctccaataaccggaattacctgacgtggtatcagcagaaacctgggcagccgcccaagctcctgatctactgggcctctacccgcgaaagcggagtccctgacagattctccggcagcgggtcttccacagattttacccttacaattagctctctgcaagcggaggacgttgctgtgtattactgtcagcagtatttctccacccccggaatcacatttggccaggggacccggctcgaaattaaacgc

SEQ ID NO: 39531 - RNA, 309 nt, synthetic construct
  misc_feature 1..309: note = derived and/or modified sequence opt5 from anti-HIV-1_LightChain
  source 1..309: mol_type = other RNA
gagatcgtgctgacccagagccccgccacactctccctgtctcctggcgaaagagctacgcttagctgccgggcctcccaatctgtctacaccaagctggcgtggtatcagcagaaaccggggcagccccctcgcctcctgatttacgacgctagcaacagagccgccggaatccccgctcggttctccggctctgggagcggaacagagtttacccttacaattaagcgcatggaaagagaggatttcgccgtttattactgtcaaatcctggaatttttcggccaggggaccacaattgacatgaat

SEQ ID NO: 39532 - RNA, 312 nt, synthetic construct
  misc_feature 1..312: note = derived and/or modified sequence opt5 from anti-HIV-1_LightChain
  source 1..312: mol_type = other RNA
gacatccagatgacccaaagcccctcctctgtgagcgcctccgtcggcgatagagttacaattacgtgccgggcttctcaggggatcctgagctcccagctcgcctggcaccagcaacgcagaggacagcctccgcggctgcttatttacggcgggtctaaccgcgcgcccggaatccctgagagattcaccggcagcgggtccggaacagactttgtgctgaccattaagcggctccagcgcgatgacttcgctgtgtattactgtcagatcctggaatttttcggcagaggcacacgggtcgagatgaat

SEQ ID NO: 39533 - RNA, 312 nt, synthetic construct
  misc_feature 1..312: note = derived and/or modified sequence opt5 from anti-HIV-1_LightChain
  source 1..312: mol_type = other RNA
ggcctgctcctgacccagagccccgggcctgtgtccttctttccgggagagagagccacagtctcttgccgggctagccactccgttaactctgccgcgatcaattggtaccaacagaagcgcggccagccccctagacttattatcgtggacgggagcacgcgggctaccgccgtgcccgaacgcttctccgccacaggatctggcaccgagtttacactggtcattagcagactcgaacctgaggatttcgctgtgtatttttgtcagcatctgcaattctttgggcttggaaccaaagttgacatcaag

SEQ ID NO: 39534 - RNA, 312 nt, synthetic construct
  misc_feature 1..312: note = derived and/or modified sequence opt5 from anti-HIV-1_LightChain
  source 1..312: mol_type = other RNA
gccttcgtgatgacccagagccccggcacactggctctctcccctggggagagagccacgctgtcttgccggaccagccaagaaatcctttccaaccagctggcgtggcaccagcagcgcagaggacaaccgccccggctcctgatttacggcgggtctaatcgcgctcctggaatccccgagagatttacaggcagcgggtccggaaccgacttcgtccttacaattaaccggctggaacgcgatgactttgccgtttattactgtcagatcctcgagttctttggcagaggcacccgggtggaaatgaat

SEQ ID NO: 39535 - RNA, 312 nt, synthetic construct
  misc_feature 1..312: note = derived and/or modified sequence opt5 from anti-HIV-1_LightChain
  source 1..312: mol_type = other RNA
ggcatcgtgctgacccagagccccgacacactctccctgtctcctggggatagagccacgcttagctgcaagacctcccaatctattgctagcgagcacctggcctggtaccagcagcggccgggacagccccctcgcctcctgatcttcggcgcgtccaacagagcttctgggattcccacacggtttagcggatccggcagcggggccgacttcaccctttctatcacacgcctggaacctgaggattttgccgtctattactgtcaattctccgaatttttcggaagaggcgctcgggttgaggtgaaa

SEQ ID NO: 39536 - RNA, 312 nt, synthetic construct
  misc_feature 1..312: note = derived and/or modified sequence opt5 from anti-HIV-1_LightChain
  source 1..312: mol_type = other RNA
cagttcgtgatgacccaaagccccgccacactgtcctctagccctggcgggacggctaccctctcctgcagaacatctcacagcatcctgaactcccagcttgcctggcatcagcagcggcgcggacaaccgctgagactcctgatttacggcgcgtctaatcgggctcccgggatccctgagcgctttagcgcctccggaagcggcaccgagttcgtccttacaattaagagaatggaacgggaagactttgccgtttattactgtcagatcctggagttctttgggcagggaaccacaattgatatgaac

SEQ ID NO: 39537 - RNA, 354 nt, synthetic construct
  misc_feature 1..354: note = derived and/or modified sequence opt5 from anti-HIV-1_HeavyChain
  source 1..354: mol_type = other RNA
agagtgcacctggtccagagcggcacccaagttaagaaacccggggcctccgtgaaggtgtcttgcgagacaagcggattcaaatttctcgactccctgatccattgggtccggcaggctcctggccaggggctttactggatgggatggattaagccgtatcgcggctctgtgaactacgatgggtatttcagaggacgggttagcatgacgcgcgacatctacaccgatacagcctatctggaactctccggcctgagatctgacgataccgcgatttactattgtgcttttggcgccggggacggatgggatcttgtgtggggccaggggacactggtcatcgtgagctcc

SEQ ID NO: 39538 - RNA, 354 nt, synthetic construct
  misc_feature 1..354: note = derived and/or modified sequence opt5 from anti-HIV-1_HeavyChain
  source 1..354: mol_type = other RNA
agagtgcacctggtccagagcggcacccaagttaagaaacccggggcctccgtgaaggtgtcttgcgagacaagcggattcaaatttctcgactccctgatccattgggtccggcaggctcctggccaggggctttactggatgggatggattaagccgttccgcggctctgtgaactatgatgggtactttagaggacgggttagcatgacgcgcgacatctataccgatacagcctacatggaactgtccggcctcagatctgacgataccgcgatttattactgtgctttcggcgccggggacggatgggatctggtgtggggccaggggacacttgtcatcgtgagctcc

SEQ ID NO: 39539 - RNA, 354 nt, synthetic construct
  misc_feature 1..354: note = derived and/or modified sequence opt5 from anti-HIV-1_HeavyChain
  source 1..354: mol_type = other RNA
caggtgcacctggtccaaagcggcacccaggttaagaaacccggggcctccgtgagagtgtcttgcgagacaagcggattcaagtttctcgactccatcattcattggttccggcaggctcctggcgaagggctgttttggatgggatggatcaaaccgtacacgggctctgtcaactatgtgcgcagataccaggggcgggttagcatgacccgcgatgtgtattccgacacagcctacatggatctttctggactgaatagcgacgataccgcggtctatttctgtacatacggcgctggcgacgggtggaacctcgtgtggggacaaggcaccctggttattgtgtccgcc

SEQ ID NO: 39540 - RNA, 363 nt, synthetic construct
  misc_feature 1..363: note = derived and/or modified sequence opt5 from anti-HIV-1_HeavyChain
  source 1..363: mol_type = other RNA
caggtgagactggtccaaagcggcaaccaggttcggaagcccggggcctccgtgcgcatctcttgcgaggctagcggatacaagttcattgaccactttatccattgggtgagacaggtccctggccacgggctcgaatggctgggatggattaatccgcggggcgggggagtgaactattcccgcggcttccagggcaaactttctatgaccatgacaagagataattttgaggaaacggcctacctggacctcagccggctgaaccccggggataccgcggtttattactgtgctcgcggattcgccggctatgagtggtcctttctttgggggcaaggaacactggtgatcgtctctagc

SEQ ID NO: 39541 - RNA, 357 nt, synthetic construct
  misc_feature 1..357: note = derived and/or modified sequence opt5 from anti-HIV-1_HeavyChain
  source 1..357: mol_type = other RNA
caggtgagcctggtccaatccggcaaccagctcaagaaacccggggcctctgttagaatcagctgcgagacctccggatacaatttcctgaaccactttattcattgggtgcgccaggtgcctggccacgggcttgaatggctgggatggatcaatccgcggggcgggggagtcaactattctagaaatttccagggcaaggtgagcctcacacggaacattgacatggagacggtttacctggatgtgcgcggccttacccccggggacacagctgtctattactgtgccagaggatttggcgggtccgattggaatttcgtgtggggacaaggcacccggatcacagtttctgcg

SEQ ID NO: 39542 - RNA, 357 nt, synthetic construct
  misc_feature 1..357: note = derived and/or modified sequence opt5 from anti-HIV-1_HeavyChain
  source 1..357: mol_type = other RNA
agaatcaacctgcaccagagcggctcccaagtgaagcggtctggggccagcgtccgcatttcctgcgagacctctggattcaaatttatggacagccatctccactgggttagacaggtggctggccaggggttcgaatggatgggatggatctttacatccggcgggggagtgaattacgcccggcagttccaaggccgcctgacgcttaccagagatgtctttacagacaccgtgttcatggatctgtctggcgttaacgtgggggacacaggagtctattactgtgtgaagggcaccgggggaaatgagtggggctttagctgggggcagggaacagttgtggtcgtgtccccc

SEQ ID NO: 39543 - RNA, 357 nt, synthetic construct
  misc_feature 1..357: note = derived and/or modified sequence opt5 from anti-HIV-1_HeavyChain
  source 1..357: mol_type = other RNA
agaatcaacctggaccagagcggctcccaagtgaagaaatctggggccagcgtccggatttcctgcgagacctctggattcaagtttatggatagccacctccattgggttcgccaggtggctggccagcccttcgaatggatggggtggatctttacatccggaggcggggtgaattacgccagacagttccaaggacggctgacgcttacccgcgacgtcttttctgagacagtgttcatggatctgagcggcctcaacgcgggcgacaccggggtttatttttgtgtgaaaggaacaggcgggaatgaatggggattcgtctggggccaggggaccgtggttgtggtctcccct

SEQ ID NO: 39544 - RNA, 357 nt, synthetic construct
  misc_feature 1..357: note = derived and/or modified sequence opt5 from anti-HIV-1_HeavyChain
  source 1..357: mol_type = other RNA
agaatcgagctgcaccagagcggctcccaagtgaagaaatctggggccagcgtccggatttcctgcgaaacctctggattcaagtttatggacagccatctccactgggttcgccaggtggctggccagagattcgagtggatggggtggatctttacatccggaggcggggtgaactacgcccggcagttccaaggacgcctgagacttacgcgggatgtcttttctgaaagcgtgttcatggacctgtccggcctcaatagcggcgataccggggtttattactgtgtgaaaggaacaggcgggaacgagtggggatttgtctggggccaggggtctctggtggttgtgtccccc

SEQ ID NO: 39545 - RNA, 372 nt, synthetic construct
  misc_feature 1..372: note = derived and/or modified sequence opt5 from anti-HIV-1_HeavyChain
  source 1..372: mol_type = other RNA
caggccctggtgcaaagcggctcccagatgaagaaacccggggactctgtcagactcagctgccagacctccgattctgctatcacaaagtacttcattcactggatccggcaggcccctggaaaaggcctggagtggattgcgtggatcagcccgtatgggggacgcgttaactacggctggcaagtgagagaccgggctacgcttacccgcaatattcatatggaaacagtgtatatggatctgagagggctccggcccgacgataccgccacatactattgtgccatgcgcgactactgcagagatgacaactgtaatcggtgggatctgggacactggggccagggctcccttatcgtcgtgtctgct

SEQ ID NO: 39546 - RNA, 357 nt, synthetic construct
  misc_feature 1..357: note = derived and/or modified sequence opt5 from anti-HIV-1_HeavyChain
  source 1..357: mol_type = other RNA
caggtgaccctggtccaaagcggcaaccagctcaagagacccggggcctccgttcggatctcttgcgagacaagcggatacaatttcatggaccactttattcattgggtgcgccaggtgcctggccacgggccggaatggctgggatgggtcaaccccagaggcgggggagtgaattattcccggaaattccagggccgcttttctatgacgagagatgtttacatggagaccgcttatcttgacgtgacaggcctgagccctgccgataccgcggtctactattgtgctcgggggttcggaggctccgactggtcttttctctgggggcaaggaacactgatcattgtgagctcc

SEQ ID NO: 39547 - RNA, 324 nt, synthetic construct
  misc_feature 1..324: note = derived and/or modified sequence opt5 from anti-HIV-1_LightChain
  source 1..324: mol_type = other RNA
gagatcgtgctgacccagagccccggcacactctccctgtctgccggggaaagagctagcctttcctgccgggcctctcaaacgctgaacagcaatttctttgcgtggtaccaccagaagcctggacaggctccgcgcctcctgatttatggcgcctccaacagagccaccgggatccccgaccggttctctggaagcggctccgggagcgattttacacttaccatttctcgcctggagcctgaagacttcggaaaatactattgtgagcagtacgatgtctcccccagaacatttggccaaggcaccaaggttgaaatcaaa

SEQ ID NO: 39548 - RNA, 324 nt, synthetic construct
  misc_feature 1..324: note = derived and/or modified sequence opt5 from anti-HIV-1_LightChain
  source 1..324: mol_type = other RNA
gaggtggtcctgacccagagccccggcacactctccctgtctcctggggaaagagccacgcttagctgccgggcttcccaatctatcaacagcaatttctttgcctggtaccaccagaagccgggacaggcgccccgcctgctcatttatggcgcttcctctagagccaccgggatccctgaccggattagcggaacaggctccggggccgatttcaccctgacaatcaccggacttgagcccgaagactttggcctgtactattgtcagcaatacgatttcagccctcgcacatttggccaggggaccagagttgagattaaa

SEQ ID NO: 39549 - RNA, 324 nt, synthetic construct
  misc_feature 1..324: note = derived and/or modified sequence opt5 from anti-HIV-1_LightChain
  source 1..324: mol_type = other RNA
gaggtggtcctgacccagagccccggcacactctccctgtctcctggggaaagagccacgcttagctgccgggcttcccaaaccatcaactctaatttctttgcctggtaccaccagaagccgggacaggcgccccgcctgctcatttatggcgctagctccagagccacagggatccctgaccggatttctggaagcggctccgggaccgatttcacactgaccatcacaggacttgagcccgaagactttggcctgtactattgtcagcaattcgattttagccctcgcaccttcggccaggggacgagagttgagattaaa

SEQ ID NO: 39550 - RNA, 324 nt, synthetic construct
  misc_feature 1..324: note = derived and/or modified sequence opt5 from anti-HIV-1_LightChain
  source 1..324: mol_type = other RNA
gagatcgtgctgacccagagccccggcacactctccctggcccctggggaaagagctacgctttcttgccgggccagccaatccatttctaccacatacctggcgtggtatcagcagaagccgggacaggctccccgcctcctgatctacgagaccagctccagagcctctgacattcctgatcggttcagcggctccgggagcggaacagactttacccttacaatctctcgcctggaacccgaggatttcgccgtctattactgtcaccaatatgacagatcccctcggacctttggccaggggacgaaagttgaaattaag

SEQ ID NO: 39551 - RNA, 336 nt, synthetic construct
  misc_feature 1..336: note = derived and/or modified sequence opt5 from anti-HIV-1_LightChain
  source 1..336: mol_type = other RNA
gacatcgtgatgacccagagccccgcctccctgtctgtcacacctggcgagacggctagcatttcctgcaagtgttctagaagcctccgggaagaggttgggtacaactatctggattggtaccttcaacgcccgggaaaatctccccagctgctcatctatgtgggctccttcagagcccctggggtgagcgaacggtttcgcggatccggcgagcacaaggacttcaccctgaaaattgcgagagtcgaacccggggatgctggaatctactattgcatgcagggcattgacacacctcggacctttggccaggggacaacccttgagatcaat

SEQ ID NO: 39552 - RNA, 321 nt, synthetic construct
  misc_feature 1..321: note = derived and/or modified sequence opt5 from anti-HIV-1_LightChain
  source 1..321: mol_type = other RNA
gacatccagatgacccaaagcccctcctctctgagcgcctccgtgggcgatagagtcacaattacgtgccgggcttctcaggccttccgcaacgacctcgggtggtaccagcacaagcctggaaaagcgccggagagactgatctatgctaccagcacacttgaatccggcgttccctctcggtttagcgggtccggaagcggcaccaatttcacactgaccatttcttccctccaggccgaggattttgccacatactattgtctgcaatacaacaccttccctcgcacgtttgggcagggaaccaaggtggaaatcaaa

SEQ ID NO: 39553 - RNA, 333 nt, synthetic construct
  misc_feature 1..333: note = derived and/or modified sequence opt5 from anti-HIV-1_LightChain
  source 1..333: mol_type = other RNA
aacttcatgctgacccagccccacagcgtgtccgagtctcctggcaagacagtcacgatcagctgcgccagaacccgcgggggaattgactccgcttacgttcattggtatcaacagcggccgggctctgtgcccacaaccgtgatctttgaagataatagacggcctcccggggtccctgaccgcttcagcggatccattgatacatctagcaacaccgcctccctcacaatcagcggcctgaagaccgaggacgaagcggattactattgtcagtcttacgacgatacgtatttttgggtgttcgggggaggcaccaaacttacagttctg

SEQ ID NO: 39554 - RNA, 333 nt, synthetic construct
  misc_feature 1..333: note = derived and/or modified sequence opt5 from anti-HIV-1_LightChain
  source 1..333: mol_type = other RNA
aacttcatgctgacccagccccacagcgtgtccgagtctcctggcaagacagtcacgatcagctgcgccagaacccgggggacaattgactccgcttacgttcattggtatcaacagcgcccgggagccgtgcccaccacagtgatctttgaagatgacagacggccttctggcgtccccgatcgcttcagcgggtccattgactctagctccaatagcgcgtctctcaccatctccggactgaagacagaggatgaagctgactactattgtcagagctacgattctaactattactgggtgtttggcgggggaaccaaacttacggttctg

SEQ ID NO: 39555 - RNA, 396 nt, synthetic construct
  misc_feature 1..396: note = derived and/or modified sequence opt5 from anti-HIV-1_HeavyChain
  source 1..396: mol_type = other RNA
caggtgcaactgcagcagagcggccccgccctcgtcaagccttccgagaccctgtctcttacatgcagcgtttcctctgggagagtgagctcctactattggtcttggatccggcagagcccgggaaaaggcctggaatggattgggtacatccactatgaccccgatacgaacaccaattaccgcacacattatcacccttccctcagaggacgggtggtcattagcgtggactcttccaagagccaagtttctctgaaagtgcgctccgtcaccgctgccgatagcgcgctttactattgtgctagacatcggtacgacccctggtctaagggctacgatatccgctcccctttcgacttttgggggcagggaacactggtgaccgttagctcc

SEQ ID NO: 39556 - RNA, 396 nt, synthetic construct
  misc_feature 1..396: note = derived and/or modified sequence opt5 from anti-HIV-1_HeavyChain
  source 1..396: mol_type = other RNA
caggtgcatctgcaacagagcggccccgggctcgtcaagccttccgagaccctgtctcttacatgcacggttagcggaggcagagtgtcctcttactattggagctggatccggcagtccccggggaaaggactggaatggattggctacatccactatgaccccgatacctctacaaactaccgcacccactatcatcctagcctcagagggcgggtggtcatttccgtggacacaagcaagaatcaggtttctctgaccgtgcgctccgtcacagccgctgatagcgccctttactattgtgcgagacaccggtacgacgtgtggtctaacggatacgatatccgctccccctatgacttctggggcagaggcaccctggttacggtgagctct

SEQ ID NO: 39557 - RNA, 396 nt, synthetic construct
  misc_feature 1..396: note = derived and/or modified sequence opt5 from anti-HIV-1_HeavyChain
  source 1..396: mol_type = other RNA
caggtgcacctggagcaaagcggccccgccctcgtcaagccttccgaaaccctgtctcttacatgcacggttagcgggggaagagtgtcctcttactattggagctggatccggcagtccccgggcaaagggctggagtggattggatacatccattatgaccccgatacctctacaaactaccgcacccactatcatcctagcctcagaggccgggtggtcatttccgtggacagctctaagaatcaggtttccctgaaagtgcgcagcgtcacagctgccgattctgcgctttactattgtgctagacaccggtacgacgtgtggtccaaggggtacgatatccgcagccccttcgacttttggggaagaggcaccctggttacagtgtcttcc

SEQ ID NO: 39558 - RNA, 390 nt, synthetic construct
  misc_feature 1..390: note = derived and/or modified sequence opt5 from anti-HIV-1_HeavyChain
  source 1..390: mol_type = other RNA
caggtggtcttccaaaagcccggccctggggttgtgaaaccgagcgagaccctgtccctcacatgcacggtgtctggaggcagagtccggagctactattggtcctggatccgcctgccccctgggcagggacttgaatggattggctacatccactatgacgagaccacagaatacaagagatcttataaccccagcctgaaatcccggattaccatctctatggatacaagcaagaatcaggtgtccctcaaactgagctctgttaccgccgctgacgccgcggtgtactattgtgctcgccatagatacgatcggtggtccgacagctacgatattcgctctccttttgacatctgggggcagggaacagtcgtgaccgtttccgcc

SEQ ID NO: 39559 - RNA, 396 nt, synthetic construct
  misc_feature 1..396: note = derived and/or modified sequence opt5 from anti-HIV-1_HeavyChain
  source 1..396: mol_type = other RNA
caggtgcaactgcagcagtggggcgccgggctcctgaagcccagcgagaccctttccctgacatgcgctatctacggatctagcttctccggccactattggatgtggattagacagtctcctgccaaaacgctcgaatggatcgcggagattaaccataccgggggaacacggtacaatccgagcctggcttcccgcgtcagagtgttttctgacaccagcaagaaccaattctcccttaatatgacaagcctgaccgccgccgatacaggcatctattactgtgttcgggggcacctctctcgcgacagactgggacagtatgctttttggtccggcgccctgattgattacctcgacccctggggccaggggaccctggtgacggtcagctct

SEQ ID NO: 39560 - RNA, 387 nt, synthetic construct
  misc_feature 1..387: note = derived and/or modified sequence opt5 from anti-HIV-1_HeavyChain
  source 1..387: mol_type = other RNA
caggtgcaactgcaccagtggggcgccgggctcctgaagcccagcgagaccctttccctgacatgcgctgtctacggatctttcacgggctttcagtggacctgggttagacagacacctgggaaaggactcgaatggatcggcgagattaaccatagcgggctgcttgtgaccggaaagacagactataatccgtccctggaatctcgggtgaccatcagcgtcgatacatccaaaaaccaattctctctcaagctgaccagcgtgacggccgcggacaccggcgtttactattgtgctcgcgccggcgggatgtccgattgggcctacccctattactatggaatggacgtgtggggccaggggacaatggtcaccgtgagctct

SEQ ID NO: 39561 - RNA, 357 nt, synthetic construct
  misc_feature 1..357: note = derived and/or modified sequence opt5 from anti-HIV-1_HeavyChain
  source 1..357: mol_type = other RNA
caggtgcaactggtcgagagcggcgggggagttgtgcagcccggcagatccctcaccctgtcttgcgccacaagcgggttcgacttttcctcttacggattccactgggtgcggcaggctcctggcaaggggcttcagtgggtcagcatcatttcccatgatggatctatcaaaaactatggcgacagcatgaagggccgcttttccgtgagcagagataatgccaaagacattctgtacctccaaatgaactctctgcggccggatgacacggcgctttatcactgtgttcgcggggatggagaaaatggcgggaccgactactggggactgggcacactcgtgaccgtctccgct

SEQ ID NO: 39562 - RNA, 357 nt, synthetic construct
  misc_feature 1..357: note = derived and/or modified sequence opt5 from anti-HIV-1_HeavyChain
  source 1..357: mol_type = other RNA
caggtggacctggtcgagagcggcgggggagttgtgcaacccggcaagtccctcaaactgtcttgcaccgccagcgggttcacatttacgtcctacggaatgcactgggtgagacagatccctggcaaggggcttgaatgggtcgctattatctctcatgatggaaccattaaaaactatggcgacagcgtgaagggccggttcacaatctcccgcgataatgccatgaacattctgtacctccagatgaataacctgagaggggacgataccgcgctttattactgtgttcggggagacggcgagaatgggggaacagattattggggccaggggaccgtggtcacagtgtctagc

SEQ ID NO: 39563 - RNA, 369 nt, synthetic construct
  misc_feature 1..369: note = derived and/or modified sequence opt5 from anti-HIV_V3_HeavyChain
  source 1..369: mol_type = other RNA
gaggtgcagctggtccaaagcggcgccgaagttaagaaacccggggagtccctcaagatctcttgccagggattcggctacacctttagcacatattggattgggtgggtgagacagatgcctggaaaaggcctggaatggcttgggatcatttacccggaggactccgaaacgatctattctcccagcttccagggacaagctaccatttccgccgataagtctctgagcacagcgtacctccagtggtccggcctgcgggctagcgactctgccatctattactgtgcccgccttggctattgcgggtccaccagctgttcctttttcgatttttggggaagaggcacactggtgaccgtctctagc

SEQ ID NO: 39564 - RNA, 369 nt, synthetic construct
  misc_feature 1..369: note = derived and/or modified sequence opt5 from anti-HIV_V3_HeavyChain
  source 1..369: mol_type = other RNA
gaggtgcagctggtccaaagcggcgccgaagttaccaagcccggggagtccctcaaaatctcttgcaagggaagcggctactccttctctacacactggattgcttgggtgagacagatgcctgggcggggactggaatggatgggctttatctatccggacgatagcgacacgcgctactccccctctcttcaggggcatgtgattatcagcgccgataaatccctgagcaccgcgtatctccagtggtcttccctgaaggctagcgacacagccatgtactattgtgccagacttggaggcgatgagtaccaatcttccggcgggatggacgtctggggacagggcaccacagtgattgttagctct

SEQ ID NO: 39565 - RNA, 393 nt, synthetic construct
  misc_feature 1..393: note = derived and/or modified sequence opt5 from anti-HIV_V3_HeavyChain
  source 1..393: mol_type = other RNA
gaggtgcagctggtccaaagcggcgccgaagttaagaaacccggggctaccgtgaagatctcctgcaaagtgtctggatacacactcacggactattacattcactgggtccagcaggcccctggcagagggctggagtggcttggactggtggatccggaaaacggcgagaccctctatgcggaaaagttccaggggcgggttacactgaccgctgacacaagcaccgatacagcctacatggagcttaaatccctgcgctatgaggacaccgccgtgtactattgtgctacggaaggacccccttcttactacgatagcggcacctatgccaagtccctccccgcttcttttgcctgctggggccaagggacactggtcaccgtgagctcc

SEQ ID NO: 39566 - RNA, 369 nt, synthetic construct
  misc_feature 1..369: note = derived and/or modified sequence opt5 from anti-HIV_V3_HeavyChain
  source 1..369: mol_type = other RNA
caggtgcaactgcaggagagcggccccgggctcgtcaagccttccgaaaccctgtctcttacatgcacggttagcggaggctccatcaacaattactattggtcttggattagacagccgcccgggaagggactggagtacatcggctatattttctacagcgggtccaccaactataatccttctctcaagagccgggtgacattttccgtggacaccagcaaaaaccagttctctctgaaacttacatccgtcaccgccacagataccgctgtgtactattgtgcccgcggacccctgctctactttggcgcgcctagaacgcacttcgactactggggccaaggggctctggttaccgtgagctct

SEQ ID NO: 39567 - RNA, 372 nt, synthetic construct
  misc_feature 1..372: note = derived and/or modified sequence opt5 from anti-HIV_V3_HeavyChain
  source 1..372: mol_type = other RNA
gaggtgcagctggtccaaagcggcgccgaagttaagaaacccggggagtccctcaagatctcttgcaaaggaagcggctactccttctctagccactggattgggtgggtgagacagctgcctggaaagggccttgaatggatggggatcatttatccggacgattccgacaccaaatacaacccctcttttcagggacaggtgacaatcagcgctgatcggtccattagcacggcctatctgcaatggtcttccctcaaggcgagcgacaccgctatgtactattgtgcccgcgtcggctacgattcttatggctactccgggagcaatttcgacgagtggggacagggcacactggtgaccgtttcttcc

SEQ ID NO: 39568 - RNA, 357 nt, synthetic construct
  misc_feature 1..357: note = derived and/or modified sequence opt5 from anti-HIV_V3_HeavyChain
  source 1..357: mol_type = other RNA
gaggtgcagctggtccaaagcggcgccgaagttaagaaacccggggagtccctcaagatctcttgcaaaggaagcggctacaacttcaattccgactggattgggtgggtgagacagatgcctggaaagggcctggaatgggtggggatgatctatccggatgactttgaggtccggcactctccccctttccagggacgcgtgaccatgagcgttgataaatccatttctacagcttaccttcagtggagctccctcaagagctctgacacgggcatgtatttttgtgccagactggatggcaacgcggctgccttcgactactgggggcaaggaacccaggtgacagtctccagc

SEQ ID NO: 39569 - RNA, 360 nt, synthetic construct
  misc_feature 1..360: note = derived and/or modified sequence opt5 from anti-HIV_V3_HeavyChain
  source 1..360: mol_type = other RNA
gacgtgcagctggtccaaagcggcgccgaggttaagaaagctggggaatccctcaagatctcttgcagacccagcggatacaacttcgccgattattggattggctgggtgcggcagatgcctgggaaaggactggagtggatgggcatcatttttccggacgattccgacacccgctacgggccctctttcgaaggacaggtgacaatcagcgcggataagtccattaatacggcttatcttcagtggaactctctgaaagccagcgacaccgccatgtacttttgtgctagacacggcggctccggggccgctcctggagattattggggccaagggacactcgtcaccgtgagctct

SEQ ID NO: 39570 - RNA, 363 nt, synthetic construct
  misc_feature 1..363: note = derived and/or modified sequence opt5 from anti-HIV_V3_HeavyChain
  source 1..363: mol_type = other RNA
gaggtgcagctggtccaaagcggcgccgaagttaagaaacccggggctaccgtgaagatctcctgcaaagtgtctggatacacattcacggactattttatgcactgggtccaggaggcccctggcaaggggctcgcgtggatgggactggtggatccggaaaacggcgacaccgtttacgctgagaaacttcaggggagagtgacaatgagcgccgatacctcccgggacacagcctatatggaactgacctctctccgcagcgaggatacagctgtctactattgtgccattggaaagtccgtggctggcacctctgcctacgacatctggggccaggggacgatggttaccgtgagctcc

SEQ ID NO: 39571 - RNA, 369 nt, synthetic construct
  misc_feature 1..369: note = derived and/or modified sequence opt5 from anti-HIV_V3_HeavyChain
  source 1..369: mol_type = other RNA
caggtgcaactggtccagagcggcgccgaggttagaaagcccggggcttccgtgaaagtgtcttgcaaggccagcggagacaccttcaacaatcacgatatcaactgggtccggcaggcgcctggccaggggccggaatgggtgggatggatgaatcccaaatccggcaacgctgggtacgcccaaaagtttcagggacgcgttacaatgacgagagacacctctattagcacagcctatatggagctccggtccctgacctctgaagatacaggcgtgtactattgtgctcgccttaccgtcgactgcgatgacggcgggtgttacggagattattggggccaggggacactggtgaccgttagctcc

SEQ ID NO: 39572 - RNA, 354 nt, synthetic construct
  misc_feature 1..354: note = derived and/or modified sequence opt5 from anti-HIV_V3_HeavyChain
  source 1..354: mol_type = other RNA
gaggtgtacctgcagcaaagcggcgccgaactcaaggagcccggggctaacgtcaaaatctcctgcaaggccttcggatttattttcaccgactattttatccactggctgagacaggcgcctggcaaagggccgcagtgggttggagtggtggatcccgaagacggctctacaacgtacgctgaggccttccaggggcgggtcagcattaccgccgatcgctccacagacaccgcttatatggatcttgccggactgacatctgacgataccgctgtgtactattgtgccctcatgtggaatgaaagcggccctgacaactggggccaagggacactggttatcgtgtcctct

SEQ ID NO: 39573 - RNA, 393 nt, synthetic construct
  misc_feature 1..393: note = derived and/or modified sequence opt5 from anti-HIV_V3_HeavyChain
  source 1..393: mol_type = other RNA
gaggtgcaggtcgttgagttcggcggggaagtgaagaaacccggagccagcgtgaaggtctcctgcgaggcttctggctacacctttgccaaattcgcgatccactgggtgagacaagctcctcggcaggggctggaatggatgggatggattaacggcgacgatgggaagacagaatatagccagaaatttcaggaccgcgttacgatgaccagagatacatccgcctctaccgtgtacatggagctcagctccctgcggtctgaggacacagccctttattactgtgctcgcgccatgtatccggataccgtcacaggaaatgacaaccccgctcctccccctttcgaaggcgattactggggccaagggaccctggtgacggttagctcc

SEQ ID NO: 39574 - RNA, 393 nt, synthetic construct
  misc_feature 1..393: note = derived and/or modified sequence opt5 from anti-HIV_V3_HeavyChain
  source 1..393: mol_type = other RNA
gaggtgcagctggtcgaaagcggcgggggactcgttaagcccggcgggtccctgagacttacctgcgtggcctctggattcacatttagcgacgtgtggctgaactgggtccggcaagctcctggcaaagggctcgagtgggtgggacgcatcaagtccagaacggatggcggcaccacagactacgccgcgtctgttaaagggcggttcaccattagccgcgatgactccaagaatacactgtatcttcagatgaactctctgaaaaccgaagatacagctgtgtacagctgtaccacggacggatttatcatgattagaggcgtctccgaggattattactattactatatggacgtgtgggggaagggaaccacagttaccgtgagctct

SEQ ID NO: 39575 - RNA, 387 nt, synthetic construct
  misc_feature 1..387: note = derived and/or modified sequence opt5 from anti-HIV_CD4bs_HeavyChain
  source 1..387: mol_type = other RNA
gaggaacagctggtggagagcggcgggggactcgtcaagcccggcgggtcccaaagactgtcttgcgccgctagcgagttcaccttttcccggtacacaatgaactgggttcgccaggcccctggaaaaggccttgaatgggtgtctagcatctccgggaatgacaacaatatttattacgcggattctgtgaagggaagattcacgatcagccgggacaacgctcgcaattccctgtatctccagattaacagcctgagagtcgaagataccgccgtgtactattgtgcccggggcccgcttgactcttacgatttttggtccggcagccgccactattacgggctggacgtttggggacagggcacaaccgtgacagtctcttcc

SEQ ID NO: 39576 - RNA, 372 nt, synthetic construct
  misc_feature 1..372: note = derived and/or modified sequence opt5 from anti-HIV_CD4bs_HeavyChain
  source 1..372: mol_type = other RNA
caggtgcaactggtccagagcggctccgagctcaagaaacccggggcctctgttaaggtgagctgcaaggcttccggatacaccttcacatctcacatcattaactgggtgagacaggcccctggccaggggctggaatggatgggatggatcaatacgaacaccggcaatccgacatatgcgcaagggtttaccggacggttcgtctttagccttgacacatccgtgtctatggcttacctgcagattagctccctcaaagccgaggataccggcgtttattactgtgcccgcggcttcagacagtggctggtggctcggatcacatattttgactactgggggcagggaacccttgtcacggtgagctct

SEQ ID NO: 39577 - RNA, 369 nt, synthetic construct
  misc_feature 1..369: note = derived and/or modified sequence opt5 from anti-HIV_CD4bs_HeavyChain
  source 1..369: mol_type = other RNA
gagctgagactccaggccagcggccccgggctggtgaagccttccgaaaccctttctctggtctgcagcgtttccggagtgtctatcagcgactcctactggaactggattcggcaaccggctggcaaagggctcgagtggatcggacgcgtgtatacaagaggcacgcacacctacaatccctctcttgggggacgggccacagtcagcggcgataccaacaagaatgaagtgtccctgaaactgatgagcgttacagcggctgacaccgccgtgtattactgtgcccgcgctctctctggcgattggacaagacggtatttctacatggacgtctgggggcgcggaacccctgtgacggtttccagc

SEQ ID NO: 39578 - RNA, 381 nt, synthetic construct
  misc_feature 1..381: note = derived and/or modified sequence opt5 from anti-HIV_CD4bs_HeavyChain
  source 1..381: mol_type = other RNA
cagctgcaactccaggagagcggccccagactggtgaagccttccgaaaccctttctctgacatgcacggtcagcgggggatccatctctagcggcgactactattggacctggattcggcagccgcccggggagggactcgaatacatcggctatatttactccgggggatctacagattataaccctagcctgaaatcccgcgccagcatctctcaggacacctccacaaatgagttcagccttaagctgacctctgttacagctgccgataccgcggtgtacttttgtgctagagaccggcgcgtgctcctgtggttcggcgaacccagacggggcctggatttttgggggcctggaacgctcgtcaccgtgtccagc

SEQ ID NO: 39579 - RNA, 396 nt, synthetic construct
  misc_feature 1..396: note = derived and/or modified sequence opt5 from anti-HIV_CD4bs_HeavyChain
  source 1..396: mol_type = other RNA
gaggtgcagctggtcgaaagcggcgggggactcgttaagcccggcgggtccctgagactttcttgcgccgctagcggattcaccttttcctctgcctggatgagctgggtgcggcaagcgcctggcaaagggctggagtgggtgggacgcatcaagtccaaatctgacggcgaaacaacggattacgctgccccggtcaagggcagattcaccattagccgggacaacctcgagtccacactgtatcttcagctgaatagcctcaaaaccgaagatacagccgtgtactattgtgctaccgccacaccctcttactatgacatcatgaccgggaactacaagtattactactatatggatgtttggggaaagggcacgaccgtgacagtctccagc

SEQ ID NO: 39580 - RNA, 363 nt, synthetic construct
  misc_feature 1..363: note = derived and/or modified sequence opt5 from anti-HIV_CD4bs_HeavyChain
  source 1..363: mol_type = other RNA
caggtgcaactggtcgagagcggcgggggactcgttaagcccggcgggtccctgagactttcttgcgccgctagcggattcatctttcgggaccactacatgacctggattcgccaggcccctggcaaagggctggaatgggtgtcctatatctctagctcctctaacaatattcagtacgcggatagcgtgaagggaagattcacagtctcccgggacaacgctaaaaatagcctctatctgcagatgaactctcttcgcgccgatgacacggccgtgtactattgtgctagatccggcccgttttacaattatgggccccctaacaattggggccaaggaaccctggttacagtgagctct

SEQ ID NO: 39581 - RNA, 378 nt, synthetic construct
  misc_feature 1..378: note = derived and/or modified sequence opt5 from anti-HIV_CD4bs_HeavyChain
  source 1..378: mol_type = other RNA
caggtgcaactggtcgagagcggcgggggagttgtgcagcccggcgggtccctcaccctgtcttgcacagccagcggattcccttttaactcctacgctatgcactgggtgagacaggccccgggcaaggggcttgaatgggtctctatgacgagccatgacggaggcaataaagatttcgtggactccgttaagggccggtttaccatctctcgcgataacagcagaaatacactgttcctccagatgaactccctgagccaagacgataccggggtgtattactgtgtccggggaaaacttgaggactataatttttggggccactaccgcgatttcgactcttgggggcagggaacactggtgaccgtttccgcg

SEQ ID NO: 39582 - RNA, 405 nt, synthetic construct
  misc_feature 1..405: note = derived and/or modified sequence opt5 from anti-HIV_CD4bs_HeavyChain
  source 1..405: mol_type = other RNA
gagccccacgtggtcgaaagcggcgggggaatggccaagcctggcgggtccctgagactctcttgcgctggaagcggcttcacctttacaaacgcctggatgaattgggttcggcaggcgccggggaaaggactggagtgggtgggccttatcaagtccaaatctgacggcgggacgaccgattacgctgccgacgtggaaggacgcttcacaattagcagagatgacctggagtccaccatgtttctcgaaatgcattctctgcaaatcgaggatacagccgtctatttctgtaccacacagtacccccggtattacgaccttatgaccggcaactataagcgcagatactttagctccgggatggatgtgtggggacagggcacggctgttaccgtgagctct

SEQ ID NO: 39583 - RNA, 384 nt, synthetic construct
  misc_feature 1..384: note = derived and/or modified sequence opt5 from anti-HIV_CD4bs_HeavyChain
  source 1..384: mol_type = other RNA
caggtgcaactgcaggagagcggccccgggctcgtcaagccttcccagaccctgtctcttacatgcacggttagcggagactccgtgtctagcggcaactactattggtcctggatcagacagccggccgggaaacccctggaatggattggacacatctctaccggcgggggaacaaagaataaccctagcctccaatcccgggtgaccattagcctggattcttccaaaaatcaggtcagcctttctctgtccagcgtgacagctgccgacaccgcggtttacacatgtgctcgcgggccccctagatctctctggttcggcgatcccacctattcctacatggacgtgtggggcaagggaacgaccgtcacagtgagctcc

SEQ ID NO: 39584 - RNA, 372 nt, synthetic construct
  misc_feature 1..372: note = derived and/or modified sequence opt5 from anti-HIV_CD4bs_HeavyChain
  source 1..372: mol_type = other RNA
caggtgcaactggtccagagcggcgccgaggttaagaaacccgggtcctctgtgaaggtgagctgcaaggcttccggaggcaccttcaactctcacgcctttacatgggtcagacaggcgcctgggcagggactcgaatggatgggcgggatcattccgacgctgggacttgctaatgacgcccaaaaattccagggccggtttaccatcacagccgatgagagcaccacaaccgtgtacatggaactgtcctctctccgcagcgaggacacagctgtttattactgtgccagacggccctattacgatcaggtgtccggcgtcggggctttcgacatttggggacagggcacccgcgtgacggttagctct

SEQ ID NO: 39585 - RNA, 390 nt, synthetic construct
  misc_feature 1..390: note = derived and/or modified sequence opt5 from anti-HIV_V2_HeavyChain
  source 1..390: mol_type = other RNA
caggtgcaactggtccagagcggcgccgaggttaagaaacccgggtcctctgtgaaggtgagctgcgaggcttccggagtcacctctagctcctacacaatctcttgggtgagactcgcccctggccaggggctggaatggatgggacggattacgccgatcttcgacattaccaactatgcgcagaaatttcaaggccgcgttacacttaccgctgataagagcacagggaccacatacatggaactgtccagcctcagatctgacgataccgccgtgtattactgtgcccgggacaaatccgatgtcgtggttgtgacgagcatccgccccgcttattactatggaatggacgtctggggccagggcaccacagtgaccgtgtcttcc

SEQ ID NO: 39586 - RNA, 366 nt, synthetic construct
  misc_feature 1..366: note = derived and/or modified sequence opt5 from anti-HIV_V2_HeavyChain
  source 1..366: mol_type = other RNA
caggtgcaactggtccagagcggcgccgaggttaagaaacccgggtcctctgtgaaggtgagctgcaaggcttccggaggcaccttcagatcttacgccatcagctgggtccggcaggcgcctgggcagggactcgaatggatgggcgggattatcccgatttttggaacagctgactatgcccaaaaattccagggcaaagtgacgatcaccgccgatgagtccacatctaccgcttacatggaactgagctcccttacaagcgaggacaccgccatgtattactgtgctcgctctagagatcactttttcgacacacgggtttttcagggctgggggcagggaaccctggtgacggtctccagc

SEQ ID NO: 39587 - RNA, 363 nt, synthetic construct
  misc_feature 1..363: note = derived and/or modified sequence opt5 from anti-HIV_V2_HeavyChain
  source 1..363: mol_type = other RNA
caggtgcaactggtccagagcggcgccgaggttaagaaacccgggtcctctgtgaaggtgagctgcaaggcttccggaggcaacttcaatacctacacaatctcttgggtcagacaggcccctgggcagggactcgaatggatgggccggattatcccgatttttgggatcgtgaaccccgcgcaaaaattccctggacgcgttacgattaatgtggacaaaagcaccaacacagcttatatggagctgtcctctcttagaagcgaagataccgccgtctactattgtgccacatccggcgtgggcctgcactttgggtacttcgactattggggacagggcacccaggttacagtgagctct

SEQ ID NO: 39588 - RNA, 378 nt, synthetic construct
  misc_feature 1..378: note = derived and/or modified sequence opt5 from anti-HIV_V2_HeavyChain
  source 1..378: mol_type = other RNA
caggtgcaactgcagcagtggggccccgggctcctgaagcctagcgagaccctttccctgacatgcgccgtctacggaggctctttcgggagatattactggagctggatccggcagtcctctggagaaggcctcgagtggctggggcaaattgaccacacgggaagcaccacatataacccgtcccttaaaggccgcgttaccatctctattgatagctccacaaatcagtttagcctgaaggtgacctctgtgatcgctgccgacacagcggtctactattgtgctagagccccctccggctaccctggggtgagcctctatcagtactacggactggatgtttggggccaggggaccacggtgaccgtctctccc

SEQ ID NO: 39589 - RNA, 366 nt, synthetic construct
  misc_feature 1..366: note = derived and/or modified sequence opt5 from anti-HIV_V2_HeavyChain
  source 1..366: mol_type = other RNA
caggtgcaactggtccagagcggcgccgaggttaagaaacccgggtcctctgtgaaggtgagctgcaaggcttccggaggcaccttctctaactacgccatcagctgggtcagacaggcgcctgggcagggactcgaatggatgggcgggattatcccgatttttggaacaacggactatgctcaaaaattccagggccgggtgaccatcacagccgatgcctccacctctacagcttacatggagctgagctcccttcgcagcgacgataccgccgtttattactgtgctagatctcggggccactattttgacacacgcgtgttcgaagggtggggacagggcaccctggtcacggtgtccagc

SEQ ID NO: 39590 - RNA, 372 nt, synthetic construct
  misc_feature 1..372: note = derived and/or modified sequence opt5 from anti-HIV_V2_HeavyChain
  source 1..372: mol_type = other RNA
caggtgcacctggtccaaagcggcaccgaggttaagaaacccggggcctccgtgacagtgtcttgcaaggctagcggatactccttcacgggctattacctccattgggtcagacaggcccctgggcagggactggaatggatgggctggatcaaccccaattctgggggaacctattacgcgcagaactttcaagctcgggtgacaatgacccgcgacacaagcatttccaccgtttatatggatctttctagactgcggagcgacgatacagccgtgtactattgtgtccgcagagccgtgctcaccgctctgccgcctcggtactacttcgacttttggggccagggcacgcttgttaccgtgtccagc

SEQ ID NO: 39591 - RNA, 318 nt, synthetic construct
  misc_feature 1..318: note = derived and/or modified sequence opt5 from anti-HIV_V3_LightChain
  source 1..318: mol_type = other RNA
agcctggagctcacccaacccccttccgtgtctgtcagcccgggccaaacagtttccatcacgtgctctgggaacctgcttggagacaaggatgccagctggtaccagctgaaacccggccagtcccctattctcgtgatctatctggacaccgaaagaccctctgggattcctgagcggttcagcggatccaagagcggcaatacagctacccttacaatctctgggacccaggccatggatgaagcggagtacttttgtcaggcttgggacacaaccacggtgctgttcggaggcggcacccgcctcacagtcctg

SEQ ID NO: 39592 - RNA, 324 nt, synthetic construct
  misc_feature 1..324: note = derived and/or modified sequence opt5 from anti-HIV_V3_LightChain
  source 1..324: mol_type = other RNA
agcgacgagctgacccagcccccttccgtgtctgtcagcccgggccaaacagccagaatcacgtgctccggggatgctctccccgaaaagtacgcctattggtaccagcagaaatctggacaggcgcctgttctggtgattgacgaggataacaagcggcccttcggcacccctgaacgctttagcgggtccagatctggaacaatggctacccttacaatcaccggcgcccaaatggaggacgaagccgattattactgtagctccacagacagccgggggacctattgggtgttcggaggcggcacgaaactgaccgtcctc

SEQ ID NO: 39593 - RNA, 336 nt, synthetic construct
  misc_feature 1..336: note = derived and/or modified sequence opt5 from anti-HIV_V3_LightChain
  source 1..336: mol_type = other RNA
cagagcgtgctgacccaacccccttccgtctctgccgctccgggccagaaggttacaatcagctgctccgccgggaactctaaaattggagacaattacatcagctggtatcagcacgtgcccggcgcggctcctaagctcctgatttacgagaacgataaaagaccctccgggatccctgaccggttctctggaagcaagtccggcacgagcgcctctcttgggattaccggactgcagacaggcgatgaagccgactattactgtgctgcctgggataattccctcagctctgctctgtatgtgtttggcaccgggacaaaagtcaccgtgctt

SEQ ID NO: 39594 - RNA, 339 nt, synthetic construct
  misc_feature 1..339: note = derived and/or modified sequence opt5 from anti-HIV_V3_LightChain
  source 1..339: mol_type = other RNA
gacatcgtgatgacccagagccccgattccctggccgtctctctcggcgagagagctacaattaactgcaagagctcccaaaatgttttctactctagcaacaatcggaactatctggcctggtaccagcagcgccctgggcagccgcccaaacttctgttttattgggcgtccacgagagaatctggagtgcctgaccggttcagcggctccgggagcggaaccgattttacactcaccatctcttccctgcaaacagaggacgtggctatttactattgtcagcagtactataatacaccccctaccttcggccccgggaccaaggtcgaaatcaaa

SEQ ID NO: 39595 - RNA, 318 nt, synthetic construct
  misc_feature 1..318: note = derived and/or modified sequence opt5 from anti-HIV_V3_LightChain
  source 1..318: mol_type = other RNA
agctacgagctgacccagcccccttccgtgtctgtcagcccgggccaaacagccacgattacctgctccggggacctcctgggagataagtatgcttcttggtacagacagaaacccggccagagccctgttcttgtgatctatgaagacacaaagcggccctccgggctgcctgagcgcttctctggaagcaactccggcaataccgccacactcaccatcagcgaaacacaggcgatggatgaggctgactactattgtcaagcctgggataccagaacggtggtctttgggggaggcaccaaactgacagtgctt

SEQ ID NO: 39596 - RNA, 327 nt, synthetic construct
  misc_feature 1..327: note = derived and/or modified sequence opt5 from anti-HIV_V3_LightChain
  source 1..327: mol_type = other RNA
cagagcgtgctgacccaacccccttccgtctctgccgctccgggccagaaggttacaatcagctgctccgggagatctagcgacattgagaacaaattcgtgtcctggtaccagcagctccccggaacggcccctaagctgcttatctatgaagataataaacggccctctggcattcctgaccgctttagcgggtccaagagcggaacctctgcgacactgggcatcaccgggctccaaacaggagatgaggctgactactattgtggcacctgggataacaatctgagagccggcttcgggggaggcacacaccttaccgtgctg

SEQ ID NO: 39597 - RNA, 324 nt, synthetic construct
  misc_feature 1..324: note = derived and/or modified sequence opt5 from anti-HIV_V3_LightChain
  source 1..324: mol_type = other RNA
agctacgagctgacccagcccccttccgtgtctgtcagcccgggccaaacagccagaatcacgtgctccggggacgctctccccaacaagtatgccttctggtaccagcagaaatctggacaggcgcctgttctggtgatttttgatgacaatcggcgccccgctggcatccctgaaagattcagcgggtcccggtctggaacccttgccacactgaccattagcggcgcccaagtggaggatgaagctgactattactgttattccacagataacgacgggaagtactttgtcttcggaagcggcaccatggtgacagttctc

SEQ ID NO: 39598 - RNA, 318 nt, synthetic construct
  misc_feature 1..318: note = derived and/or modified sequence opt5 from anti-HIV_V3_LightChain
  source 1..318: mol_type = other RNA
agctacgagctgacccagcccccttccgtgtctgtcagcccgggccaaacagcctccatcacgtgctctgggcacaagctcggagacaaatatgctagctggtaccagcataagcccggccagtcccctgttctggtgatttatgaagatacccagagaccctctgggatccctgagcggattagcggatccaaaagcggcaacacagccacccttacaatctctgggacccaagcgatggacgaagctgattactattgtcaggcctgggactcccgcgccgctgtgttcggaggcggcacaagactgaccgtcctc

SEQ ID NO: 39599 - RNA, 327 nt, synthetic construct
  misc_feature 1..327: note = derived and/or modified sequence opt5 from anti-HIV_V3_LightChain
  source 1..327: mol_type = other RNA
cagagcgccctgacccaacccgcttccgtgtctggcagccctgggcagtccatcacaatttcttgcacgggaatcagctccgacattggcaccgataactacgtctcttggtatcagcagcacccggggaaggcccccaaactcatcatttacgaggttagcaatagaccttccggaatcagccatcggttctctggctccaagagcgggaacacagcgtctctgatcatttccggacttcaagtggaagacgaggctcactattactgtaatagctatcgctctgataccctggtgtttggcggcgggacaaaagtcaccgtgctc

SEQ ID NO: 39600 - RNA, 333 nt, synthetic construct
  misc_feature 1..333: note = derived and/or modified sequence opt5 from anti-HIV_V3_LightChain
  source 1..333: mol_type = other RNA
cagagcgtgctgacccaacccccttccgcctctggcacaccggggcagagagtcacgatcagctgctccggatctagctccaacattggctctaataccgttaactggtaccagcacctccccgggacagctcctaagctgcttatctatagcaatgaccagcggccctccggagtgcctgatcgcttcagcgggtcttccagcggcacctctgcctccctggcgattagcggactccaatctgaggacgaagctgattactattgtgccgcctgggacgattccctgaacggcccctttgtgttcggcacagggaccaaagtcacagtgctt

SEQ ID NO: 39601 - RNA, 318 nt, synthetic construct
  misc_feature 1..318: note = derived and/or modified sequence opt5 from anti-HIV_V3_LightChain
  source 1..318: mol_type = other RNA
gacatccagatgacccaaagcccctcctctctgagcgcctccgtgggcgatagaattacaatcacgtgccggacctctcagagcattgacaaccacctcaattggtaccagcataagcctgggaaagctccgaagctgcttatctccgccgcgtctcgcctgcagagcggagtcccctccagattcacaggcagcgggtctggaaccgagtttacactcaccatttccagcctgcaacctgaagatttcgctgtttattactgtcagcagtcttatatcacaatcacctttggccccgggacgaaagtggacattaag

SEQ ID NO: 39602 - RNA, 321 nt, synthetic construct
  misc_feature 1..321: note = derived and/or modified sequence opt5 from anti-HIV_V3_LightChain
  source 1..321: mol_type = other RNA
gagatcgtgatgacccagagccccgccacactgtccgtctctcctggcgaaggggttacgctcagctgcagagcttcccaatctgtgagctccaacattctgtggtaccagcagcggccgggacaggcgccccgccttctgctctatggcgcctctaccagagctacagggatccctgcccggttcagcggatccggcagcgggaccgagtttacactgaccattaattctatgcaatccgaagacttcgccatctactattgtcagcagtaccacgattggctttggacactgggacagggcacccaagtggagattaag

SEQ ID NO: 39603 - RNA, 327 nt, synthetic construct
  misc_feature 1..327: note = derived and/or modified sequence opt5 from anti-HIV_V3_LightChain
  source 1..327: mol_type = other RNA
agctacgagctgacccagcccccttccgtgtctgtcagcccgggccaaacagcctccatcacgtgctctggggacaagatgggagaaagatataccagctggtaccagcagaaacccggccagtcccctgttctcgtgatgtctgagaacattaagcggcccgctgggatccctgaacgcttcagcggatccagctctggcaatacagccattctgaccatctccgggacacaagcggtggatgaggctgactattactgtcaggtctgggataccacaaccacgagctatgtgatttttggaggcggcaccaaacttacagttctg

SEQ ID NO: 39604 - RNA, 321 nt, synthetic construct
  misc_feature 1..321: note = derived and/or modified sequence opt5 from anti-HIV_V3_LightChain
  source 1..321: mol_type = other RNA
gacatccagatgacccaaagcccctcctctctgagcgcctccgtgggcgatagagtcacaattacgtgccaggcttctcaggacatcgggaactacctcaattggtatcaccagaagcctggaaaagccccgaagctgcttatttacgatgcgagcaacgttgagaccggcgtggcttcccggttctctgggagcggatccggcacagactttaccctgacaatcagctctctccaacccgaagatattgggacctatttctgtcagcagtacgagtccctgccttgggcctttggaggcggcacaaaagtggaaatccgc

SEQ ID NO: 39605 - RNA, 333 nt, synthetic construct
  misc_feature 1..333: note = derived and/or modified sequence opt5 from anti-HIV_V3_LightChain
  source 1..333: mol_type = other RNA
aacttcaagctgacccagccccacagcgtgtccgagtctcctggcaagacagtcacgatcagctgcaccagaacatccgggaccattgccacaaattacgttcaatggtttcagcagcggccgggatctagccccaccacaatgatctatgaaaacgacaagcgcccttccggcgtgcccgatagattctctgggagcattgacacctccagcaattctgcttccctcacgatcagcggactgaaaaccgaggatgaagccgactactattgtcagtcttacaactccacagatattgtggtctttggcgggggaaccaaacttacagtgctg

SEQ ID NO: 39606 - RNA, 327 nt, synthetic construct
  misc_feature 1..327: note = derived and/or modified sequence opt5 from anti-HIV_V3_LightChain
  source 1..327: mol_type = other RNA
cagagcgtgctgacccaacccccttccgtctctgccgctccgggccagaaggttacaatcagctgctccgggtctagctccaacattggaaataacatggtgtcttggtaccagcagcaccccggcacggcccctaaactcctgatctatgagaatagcaagagaccctccgggattcctgaccggttcagcggatctcgctccggcaccagcgcgacacttgggatcattggactgcaaaccggcgatgaagctgagtactattgtgccacatgggacggctctctcagaaccgtgtttgggggaggcacaaaactgaccgtcctt

SEQ ID NO: 39607 - RNA, 324 nt, synthetic construct
  misc_feature 1..324: note = derived and/or modified sequence opt5 from anti-HIV_V3_LightChain
  source 1..324: mol_type = other RNA
agctacgagctgacccagcccccttccgtgtctgtcagcccgggccaaacagccagaatcacgtgctccggggacgctctccccaaccagtatggatactggtatcagcagaagcctggccaagcccccgttctggtgattttcaaagattctgaacggcctagcgggatccccgagcgcttttccggatctagctccggcaccacagtgacccttacaattagcggggtccaggcggaagacgaggctgattactattgtcagtctgccgactccagcggaaattacgaagtgttcggcggcgggaccaagctgacagttctc

SEQ ID NO: 39608 - RNA, 330 nt, synthetic construct
  misc_feature 1..330: note = derived and/or modified sequence opt5 from anti-HIV_V3_LightChain
  source 1..330: mol_type = other RNA
cagagcgtgctgacccaacccccttccgtctctgaggccccgagacagcgggttacaatcagctgctccggctctagctccaacattgggaataacgctgtgaattggtaccaacaggtgcccggaaaggcccctaaactcctgatctattacgacgatcttctgccctctggcgtcagcgaccgcttctccgggagcaagtctggatccagcgcgtctctcgctatttccggcctgcagagcgaagatgaggccgactattactgtgccgcttgggatgactctcttaaagtgtatgtttttgggacgggaacctccgtgacagtcctg

SEQ ID NO: 39609 - RNA, 333 nt, synthetic construct
  misc_feature 1..333: note = derived and/or modified sequence opt5 from anti-HIV_V3_LightChain
  source 1..333: mol_type = other RNA
gacatcgtgatgaaccagagccctccctccctggccgtcaccccgggcgagcccgcttctattagctgcagagcctcccaatctctcctgtacagcgatgggcacaattatcttgactggtacctgcagaagcctggacaggcgccccagctcctgatctatcttggctccacacgggcttctggggttcctgatcgcttcagcggatccggcagcgggacggactttaccctgaaaatttctagagtggaagccgaggatgtgggagtctactattgtatgcaacccctccagtcctacacattcggccagggcaccaagctggaaatcaaa

SEQ ID NO: 39610 - RNA, 321 nt, synthetic construct
  misc_feature 1..321: note = derived and/or modified sequence opt5 from anti-HIV_V3_LightChain
  source 1..321: mol_type = other RNA
gcctacgagctgacccagccccctagcgtgtccgtctctccgggccaaacagctagaatcacgtgcagcggggacgccctccccaaccagtatgcgtactggtatcaccagcggcctggacaggctcccgttctggtgattcataaggataccgaacgcccttccggcatccccgccagattctctgggagctcctctggaacaaccgtgacacttaccattagcgaggtccaagccgaagacgagggcgattactattgtcagtccgctgacacaagcgcctacgtggtttttgggggaggcaccaaactgacggtgctc

SEQ ID NO: 39611 - RNA, 330 nt, synthetic construct
  misc_feature 1..330: note = derived and/or modified sequence opt5 from anti-HIV_V3_LightChain
  source 1..330: mol_type = other RNA
cagagcgtgctgacccaagccccctcctctagcggcacacctgggcagtccgtcacgatctcttgcagcggatcctctagcaacatggagattaattacgtttattggtacagacagttcccgggcaccgctccccagctcctgatctataacgacaatcaacggccttccggggtgcccgatcgctttagcgcctctaagtccggaacaagcgcgtctcttgctattggcgggctgagatccgaagacgaggccgattacttctgtgccgtgtggcacggagaccggggcggccctgtctttgggggaggcaccaaactcacagtgctg

SEQ ID NO: 39612 - RNA, 327 nt, synthetic construct
  misc_feature 1..327: note = derived and/or modified sequence opt5 from anti-HIV_V3_LightChain
  source 1..327: mol_type = other RNA
agctacgagctgaagcagcccagatccgtgtctgtcagccctggccaaaccgcccggatcacatgctccggggacgctatgccgaaccagtatgcctactggtatcagcagcgccccggcagagcgcctgttctcctgattttcaaagataatgaacgggcttctggaatccccgagcgcattagcgggtcctctagcggaacgaccgccacacttaccatcaacagagtgcaagccgaagacgaggctgattacctgtgtcagtccgccgacagctctggcgcttttccttgggtgttcgggggaggcacaaccctcacagtcctg

SEQ ID NO: 39613 - RNA, 324 nt, synthetic construct
  misc_feature 1..324: note = derived and/or modified sequence opt5 from anti-HIV_V3_LightChain
  source 1..324: mol_type = other RNA
agctacgagctgacccagcccccttccgtgtctgtcagcccgggccaaacagccagaatcacgtgctccggggacgctctccccaaggaatatgcctactggtatcagcagaaatctggacaggcgcctgttctggtgatttacgaggatacccggcgccccagcggcatccctgaaagattctccgggtctagctccggaacaatggctacccttacagtgagcggcgcccacgtcgacgatgaggccgactattactgttattctcgggatacctccgctaaccaatgggtgtttgggggaggcacaaagctgaccgttctc

SEQ ID NO: 39614 - RNA, 318 nt, synthetic construct
  misc_feature 1..318: note = derived and/or modified sequence opt5 from anti-HIV_V3_LightChain
  source 1..318: mol_type = other RNA
gagatcgtgctgacccagagccccgccacactctccctgtctcctggcgaaagagctacgcttagctgccgggcctcccaatctattagcacctacctggggtggtatcagcagaagccgggacaggcgccccgcctcctgatctacgacgcttccaacagagccacaggcattcctgcccggttctctgggagcggatccggcaccgattttacacttaccatcagctctctggagcccgaagacttcgctgtctattactgtcaacagcgctatacatggattacctttgggcagggaacgagactcgagatcaaa

SEQ ID NO: 39615 - RNA, 327 nt, synthetic construct
  misc_feature 1..327: note = derived and/or modified sequence opt5 from anti-HIV_V3_LightChain
  source 1..327: mol_type = other RNA
agctacgagctgacccagcccccttccgtgtctgtcagcccgggccaaacagccagaatcacgtgctccggggacgctctccccaaccagtatgtttactggtatcagcagcggcctggacaagcccccgtggtggtcctgtacaaggataccgaacgcccttctggcattcccgagagattcagcgggtcctctagcggaacaaccgtgacacttaccatctccggcgttcaggcggaagacgaggctgattattactgtcagagcgccgacaattctggggcctatcctctgtttttcggaggcggcacaaaactcaccgtgctg

SEQ ID NO: 39616 - RNA, 333 nt, synthetic construct
  misc_feature 1..333: note = derived and/or modified sequence opt5 from anti-HIV_V3_LightChain
  source 1..333: mol_type = other RNA
cagagcgtgctgacccaacccccttccgtctctgccgctccgggccagaaggttacaatcagctgctccgggtctagctccaacattggaaataactacgtgctctggtatcagcagttccccggcacggcccctaagctgcttatctacgggaataacaagagaccctctggcattcctgaccggtttagcggatccaaaagcgggacctctgcgacactgggaatcaccggcctccaaacaggcgatgaggctgactatttctgtgccacctgggattccgggctgagcgccgactgggtgtttggaggcgggacaaaacttaccgtcctg

SEQ ID NO: 39617 - RNA, 321 nt, synthetic construct
  misc_feature 1..321: note = derived and/or modified sequence opt5 from anti-HIV_V3_LightChain
  source 1..321: mol_type = other RNA
gacatccagatgacccaaagcccctcctctctgagcgcctccgtgggcgatagagtcacaattacgtgccgggcttctcaggagatcgacaactacctcgcctggtatcagcagcgccctgggaaggcgccgaaaagcctgatttacgctgcctcctctcttcaaggaggcgttccccctaagttcagcgggtccggaagcggcaccgaatttacactgaccatctcttccctccaggccgaggatttcgctacatattactgtcagcagtataatgcctaccccctgacctttgggcaaggaacaagacttgacattaac

SEQ ID NO: 39618 - RNA, 324 nt, synthetic construct
  misc_feature 1..324: note = derived and/or modified sequence opt5 from anti-HIV_V3_LightChain
  source 1..324: mol_type = other RNA
agctacgagctgacccagcccccttccctctctgtgagcccgggccaaacagcctccatcacgtgctctggggacggactgcccaagcagtatggctactggtatcagcagaaacctgggcaagctccccttctggtcattctcaaggataccgaaagacctagcggaatccccgagcggttctccggctctagctccgggacaaccgttacactgaccattagcggagtgcaggccgaagacgaggcggattactattgtcagtctgtggactccacaggcagctactatgtctttggccctgggaccaaagtgacggttctt

SEQ ID NO: 39619 - RNA, 324 nt, synthetic construct
  misc_feature 1..324: note = derived and/or modified sequence opt5 from anti-HIV_V3_LightChain
  source 1..324: mol_type = other RNA
agctacgagctgacccagcccccttccgtgtctgtcagcccgggccaaacagccagaatcacgtgctccggggacgttctccccaagaaatatgcttactggtatcagcagaagtctggactggcccctgtgcttgtgatttacgaagataaccggcgccccagcggcatccctgagagattctccgggtctagctccggaaccatggcgacactgaccattagcggcgctcaggtcgaagacgagggggattattactgttcttccacagacagctctggagatcactatgtgtttggcaccggcacaaaagttaccgtgctc

SEQ ID NO: 39620 - RNA, 321 nt, synthetic construct
  misc_feature 1..321: note = derived and/or modified sequence opt5 from anti-HIV_V3_LightChain
  source 1..321: mol_type = other RNA
gcctacgagctgacccagccccctagcgtgtccgtctctccgggccaaacagctagaatcacgtgcagcgccgaagcgctctccaaccagtatgcttactggtatcggcagcgccccgggcaggcccctctgcttattatctacaaggacaccaaaagaccctctggcattcctgagcggttcagcggatccacatctgggaccacagttaccctgacaatcagcggagtgcaagccgaagatgaggctgactattactgtcagtccgccgatagctctggcgactatgtgtttgggggaggcaccaaggtcacggtgctc

SEQ ID NO: 39621 - RNA, 333 nt, synthetic construct
  misc_feature 1..333: note = derived and/or modified sequence opt5 from anti-HIV_CD4bs_LightChain
  source 1..333: mol_type = other RNA
cagcccgtgctgacccaaagctcctctgccagcgcttccctcggctctagcgtcaagctgacatgcacgcttgggtccggacactctggcagcatcattgcctggcatcagcagcagcctgggaaagcgccgagatacctgatgaaggttcaatccagcggatcttataacaaaggctccggggtgcccgaccggttcagcggatcttccagcggcgctgatcgctacctcaccatctctaatctgcagtttgaggacgaaggcgattattactgtgagacatgggacaccaacaagtatgtgttcgggacaggaaccaaagtcacagtgctt

SEQ ID NO: 39622 - RNA, 324 nt, synthetic construct
  misc_feature 1..324: note = derived and/or modified sequence opt5 from anti-HIV_CD4bs_LightChain
  source 1..324: mol_type = other RNA
gagctggtgctcacccagagccccggcacactgtccctttctcctggggaaagagccacgctgagctgccgggcttcccaatctgtcgccagctactatctcgcgtggtaccagcagaagccgggacaggctccccgcctgcttatctatggcgcctcctctagagccaccgggattcctgaccggttcagcggatccgttagcggcacagattttaccctgacaatctctcgcctcgagcccgaagacttcgctctgtactattgtcaacagtacgggtccagccctctgtcttttggaggcggcaccaaagtggagattaga

SEQ ID NO: 39623 - RNA, 333 nt, synthetic construct
  misc_feature 1..333: note = derived and/or modified sequence opt5 from anti-HIV_CD4bs_LightChain
  source 1..333: mol_type = other RNA
cagagcgccctgacccaacccccttccatgtctggcagcccggggcagtccatcacaatttcttgcacgggaagcggctccgacgtggggtctcacaacttcgtcagctggtaccagcagcatcccgctagagttcctaagctcctgatctatgccgtgggaaatcggccctccggcgtgagcgagcgcttttctgggtccaaaagcggaaacaccgcgtaccttacaatttctggcctgcaagctgatgacgaagccgattattactgttccagccacaccacaggcaccacactcgaggtcttcgggggaggcaccagactgacggtgctt

SEQ ID NO: 39624 - RNA, 333 nt, synthetic construct
  misc_feature 1..333: note = derived and/or modified sequence opt5 from anti-HIV_CD4bs_LightChain
  source 1..333: mol_type = other RNA
gacatcgtgatgacccagagccccctgtccctccctgtcacaccgggcgagcccgcctctattagctgcagatcctctgaaagcctgcttcactccaacgggttcatctacctggattggtatctccaaaagcctggacagtctccccagctgcttatttacctgggcagcaaacgggcttccggggttagcgaccgcttttctggatccggcagcgggacggccttcaccctcaagatctctagagtggaggcggaagatgtgggagtctattactgtatgcaggctctggagtcccggacatttggccaaggcaccaaactggaaattaag

SEQ ID NO: 39625 - RNA, 327 nt, synthetic construct
  misc_feature 1..327: note = derived and/or modified sequence opt5 from anti-HIV_CD4bs_LightChain
  source 1..327: mol_type = other RNA
gagatcgtgctgacccagagccccggcacactctccctgtctcctggggaaagagccacgcttagctgccgggcttcccaatctgtcagctcctcttacctggcctggtatcagcagaagccgggacagagcccccgcctcctgatttacggcgcgtccagcagagctaccgggatccctgaccggttctctggatccggcagcgggacagattttacccttacaatttctcgcctggagcccgaagacttcgccgtttattactgtcaacactatggatccagctctatctttaccttcggccctggcacaaaagtggatattaga

SEQ ID NO: 39626 - RNA, 330 nt, synthetic construct
  misc_feature 1..330: note = derived and/or modified sequence opt5 from anti-HIV_CD4bs_LightChain
  source 1..330: mol_type = other RNA
aacttcatgctgacccagccccacagcgtgtccggctctcctgggaagacagtcacgatcagctgcaccagatcctctggaagcattgccggcaattacgttcaatggtatcagcagcggccggggacatcccccaccacagtgatctacgagaacgaccagcgctctagcggagtgcctgatagattttccggcagcattgactcttccagcaattctgcttccctcaccatcagcgggctgaagacagaagatgaggccgactattactgtcattcttatgatgcgaccaaccaagtcttcggaggcggcacgaaacttaccgtgctg

SEQ ID NO: 39627 - RNA, 333 nt, synthetic construct
  misc_feature 1..333: note = derived and/or modified sequence opt5 from anti-HIV_CD4bs_LightChain
  source 1..333: mol_type = other RNA
gacgtggtcgttacccagagccccctgtccctccctgtgacactgggccaaccggcctctatcagctgcagatcctctcagagccttgtgtactccgatgggacgacccacctgaactggtatcatcagcggcccggacagcctccccgcagactcatttaccgggtctctaatcgcgacagcggcgtgcctgatagattctccgggagcggatctggcacagactttaccctgcggatctcccgcgttgaggctgaagatgtggggctttattactgtatgctggccacacaccccttcacctttggacctggcacaaaggtcgagattaaa

SEQ ID NO: 39628 - RNA, 336 nt, synthetic construct
  misc_feature 1..336: note = derived and/or modified sequence opt5 from anti-HIV_CD4bs_LightChain
  source 1..336: mol_type = other RNA
cagagcgtgctgacccaacccccttccgtctctggcgccccggggcagacagttacgatcagctgcaccggatcctctagcaacattggcccctcctacgacgtgcagtggtatcagcaattccctgggagagctcccaagctcctgatctctggaaataacaatcgggccagcggcgtgcctgatcgcttttccgggagcaaatctggaacatccgcgagccttgctattaccggcctgcagtctgaggacgaagccgattactattgtcagacatacgactccagcctctctggccacgtcgtgttcgggggaggcaccagactgacagttctt

SEQ ID NO: 39629 - RNA, 321 nt, synthetic construct
  misc_feature 1..321: note = derived and/or modified sequence opt5 from anti-HIV_CD4bs_LightChain
  source 1..321: mol_type = other RNA
gacatccagatgacccaaagcccctccacactgtctgccagcgtgggcgatagagtcacgattacctgccgggcttccgcctctatctacacatggctcgcgtggtatcagcagcgccctgggaaggctccggaggttctgatttacaaagccagcacccttaagtccggagtgccctctagattcagcggctccgggagcggaacagaatttaccctgacaatctcttccctccagcctggcgacttcgccacctattactgtcaacagtatacgacctaccccctgacatttgggggaggcaccacagtggagattaaa

SEQ ID NO: 39630 - RNA, 330 nt, synthetic construct
  misc_feature 1..330: note = derived and/or modified sequence opt5 from anti-HIV_CD4bs_LightChain
  source 1..330: mol_type = other RNA
cagagcgccctgacccaacccgcttccgtgtctggcagccctgggcagtccatcacaatttcttgcacgggaaccagcaacgacatcggcacatacaatctcgtctcctggtatcagcaccatccgaacaaggcccccaaagttgtggtgtacgagaataacaagagaccttctgggattagcaatcggttctccggaagcaaatctggcaacaccgcgtccctgacaatcagcgggcttcaggctgaagatgaggccgactattactgttgctcttatgccggatccagcacctgggtctttggcggcgggacaaagctgaccgtgctc

SEQ ID NO: 39631 - RNA, 321 nt, synthetic construct
  misc_feature 1..321: note = derived and/or modified sequence opt5 from anti-HIV_V2_LightChain
  source 1..321: mol_type = other RNA
gacatccagatgacccaaagcccctccacactgtctgccagcgtgggcgatagagtcacgattacctgccgggcttcccagacaatctctagctggctcgcctggtaccagcagaagtccgggaccgcgcctaaactgcttatttataaggcttctagcatcgtttccggagtgccgagccgcttctctggctccgggagcggaacagagtttaccctgacaattacctctctccaacccgacgatttcgccacgtactattgtcagcagtacaactccagccctgaaacctttggccaggggacaaaagtggagatcaag

SEQ ID NO: 39632 - RNA, 318 nt, synthetic construct
  misc_feature 1..318: note = derived and/or modified sequence opt5 from anti-HIV_V2_LightChain
  source 1..318: mol_type = other RNA
gagatcgtgctgacccagagccccggcacactctccctgtctcctggggaaagagccacgcttagctgccgggcttcccaatctgtcagctcctacctggcctggtatcagcagaagccgggacaggcgccccgcctcctgatttacgacgcttctagcagagccaccggcatccctgatcggttctccgggagcggatctggcacagactttacccttacaatttcccgcctggagcccgaagatttcgccgtttattactgtcaacactatgctgggagcagaacctttggacagggcacaaaagtggagatcaag

SEQ ID NO: 39633 - RNA, 333 nt, synthetic construct
  misc_feature 1..333: note = derived and/or modified sequence opt5 from anti-HIV_V2_LightChain
  source 1..333: mol_type = other RNA
cagagcgtgctgacccaacccccttccgtctctggcgccccggggcagagagttacaatcagctgcacgggatcctctagcaacattggcgctcactacgacgtgcattggtatcagcagctccccgggaccgcccctaagctgcttatctacggaaattccaaccggccctctggcgtgcctgatcgcttcagcgggtccaaaagcggaacatctgcgtccctggctattaccggcctccaagccgaggacgaagccgattattactgtcagagctatgactcttccctgagcggctacgtctttgggacaggaaccaaggtgacagttctt

SEQ ID NO: 39634 - RNA, 324 nt, synthetic construct
  misc_feature 1..324: note = derived and/or modified sequence opt5 from anti-HIV_V2_LightChain
  source 1..324: mol_type = other RNA
gacaccgtgatgacacagagccccgccacgctgtccgtctctcctggcgagagagttaccctcagctgccgggcttcccaaatcattaacacaaatctggcctggtaccagaagcgcccggggcaggcgcccagacttctgatctatgctgcctctgcccgggctaccggcattcctgcccgcttcagcggatccgggtctggaacagaatttaccctcacaatcagcggcctgcagtccgaggatagcgctgtgtactattgtcaacagtacaagcactggcccccttataccttcgggagaggaacgaaacttgaaattcgg

SEQ ID NO: 39635 - RNA, 321 nt, synthetic construct
  misc_feature 1..321: note = derived and/or modified sequence opt5 from anti-HIV_V2_LightChain
  source 1..321: mol_type = other RNA
gagatcgtgctgacccagagccccggcacactctccctgtctcctggggaaagagccacgcttagctgccgggcttcccaatctgtcagctcctcttacctggcctggtatcagcagaagccgggacaggcgccccgcctcctgatttacggcgctagctccagagccaccgggatccctgaccggttcagcggatctggctccgggacagattttacccttacaattagccgcctggagcccgaagacttcgccgtttattactgtcaacagtatggatcttccagaacctttggccagggcacaaaagtggagatcaag

SEQ ID NO: 39636 - RNA, 321 nt, synthetic construct
  misc_feature 1..321: note = derived and/or modified sequence opt5 from anti-HIV_V2_LightChain
  source 1..321: mol_type = other RNA
gacatccagatgacccaaagcccctcctctctgagcgcctccgtgggcgatagagtcacaattacgtgccgggcttctcagagcatctccgggaacctcaattggtaccagcagaagcctggaaaagccccgaacctgcttatttatggcgcgtctagcctgcaatccggggttcccagccgcttctctggatccggcagcgggaccgactttacactcaccatctcttccctgcagcctgaggatttcgctacataccactgtcagcagagccattctacctcctggacatttggacaaggcaccaaggtggtgattaaa

SEQ ID NO: 39637 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccacagtgtccgtcgctctcggccaaacggttaccatcacatgcagaggggattctctgcggaaccactacaccagctggtatcagcagaagacaggacaggcccctgtgcttctgatttacccgaaacataatcgctcccccggcatctctgacagattcagcgcgtcctctagcgggaacaccgcttccctcacaattaccggagcccaaacggaagatgagggcgactattactgtagctctcgggataagtccgggagccgcctggtgacctttggaggcggcacagaagtcaccgggctt

SEQ ID NO: 39638 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccacagtgtccgtcgctctcggccaaacggttaccatcacatgcagaggggattctctgcggaaccactacaccagctggtatcagcagaagacaggacaggcccctgtgcttctgatttacccgaaacataatcgctcccccggcatctctgacagattcagcgcgtcctctagcgggaacaccgcttccctcacaattaccggagcccaaacggaagatgagggcgactattactgtagctctcgggataagtccgggagccgcctggtgacctttggaggcggcacaaaagtcaccgtggtt

SEQ ID NO: 39639 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccacagtgtccgtcgctctcggccaaacggttaccatcacatgcagaggggattctctgcggaactactataccagctggtaccagcagaagcctggacaggccccggtgcttctgatttatcccaaacacaatcgccctcccggcatctccgacagattctctgcgagctcctctgggaacacagctagcctcaccattacaggagcccaaaccgaagatgagggcgactactattgttccagccgggataagtctgggtcccgcctggtgacgtttggaggcggcaccaaagtcacagggctt

SEQ ID NO: 39640 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccacagtgtccgtcgctctcggccaaacggttaccatcacatgcagaggggattctctgcggaactactataccagctggtaccagcagaagcctggacaggccccggtgcttctgatttatcccaaacacaatcgccctcccggcatctccgacagattctctgcgagctcctctgggaacacagctagcctcaccattacaggagcccaaaccgaagatgagggcgactactattgttccagccgggataagtctgggtcccgcctggtgacgtttggaagaggcaccaaacttacagtcgtg

SEQ ID NO: 39641 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccacagtgtccgtcgctctcggccaaacggttaccatcacatgcagaggggattctctgcggaaccactacaccagctggtatcagcagaagacaggacaggcccctgtgcttctgatttacccgaaacataatcgctcccccggcatctctgacagattcagcgcgtcctctagcgggaacaccgcttccctcacaattaccggagcccaaacggaagatgagggcgactattactgtagctctcgggataagtccgggagccgcctggtgacctttggaggcggcacaaaagtcaccgtgctt

SEQ ID NO: 39642 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccacagtgtccgtcgctctcggccaaacggttaccatcacatgcagaggggattctctgcggaactactataccagctggtaccagcagaagcctcgccaggccccggtgcttctgatttatcccaaacacaatagacctcccggaatctccgaccggttctctgcgagctcctctggcaacacagctagcctcaccattacaggggcccaaaccgaagatgagggagactactattgttccagccgcgataagtctggctccagactggtgacgtttgggggaggcaccaaacttacagtcctg

SEQ ID NO: 39643 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccacagtgtccgtcgctctcggccaaacggttaccatcacatgcagaggggattctctgcggaactactataccagctggtaccagcagaagcctggacaggccccggtgcttctgatttatcccaaacacaatcgccctcccggcatctccgacagattctctgcgagctcctctgggaacacagctagcctcaccattacaggagcccaaaccgaagatgagggcgactactattgttccagccgggataagtctgggtcccgcctggtgacgtttggaggcggcaccaaacttacagtcctg

SEQ ID NO: 39644 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccacagtgtccgtcgctctcggccaaacggttaccatcacatgcagaggggattctctgcggaaccactacaccagctggtatcagcagaagacaggacaggcccctattcttctgatctacccgaaacataatagaccccctggcatttccgaccgcttctctgcgagctcctctgggaacaccgctagcctcacaatcaccggagcccaaacggaagatgagggcgactattactgttccagccgggataagtctgggtcccgcctggtgacctttggaggcggcacaaaacttaccgtgctg

SEQ ID NO: 39645 - RNA, 327 nt, synthetic construct
  misc_feature 1..327: note = derived and/or modified sequence opt5 from anti-HIV_10E8
  source 1..327: mol_type = other RNA
agctccgacctgacccaggatcccgccgtgtctgtcgctctcggccaaacagttagaatcacgtgccagggggacagcctgcggcgctactatgccggatggtaccagcagaagcctggccaagcgccggtgcttgtggtctatgggagagataaccggccctccggcattcctgaccgcttctctggaagcacctccgggaatacagcttctctgaccatcgccggagcccaggctgaggatgacgccgattactattgtagctccagagacaaaagcggctctcggctctccgtgtttggcgggggaacaaagctgaccgttctt

SEQ ID NO: 39646 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccgctgtgtccgtcgccttcgaaaagacagttacgattacctgccaaggcgattctctcagaagccactacgtgtcctggtatcagaaacggcctgggcaggcgccggtgctggtcttttacggaaagaacaatcgcccctctggcatccctgacagattcagcgggtccacatctggaaacaccgctagccttacaatcgccggcgcccaggctgaggatgacgccgattattactgttccagccgggacaaatctgggtcccgcctgagcgtgtttggaggcggcaccaagctcacagttccc

SEQ ID NO: 39647 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccgctgtgtccgtcgccctcaagcaaacagttacgattacctgcagaggcgattctctgcggagccactacgtgtcctggtatcagcagaaacctgggcaggcgccggtgcttgtcttctacggaaagaacaatcgcccctctggcatccctgacagatttagcgggtcctctagcggaaacacagcttccctgaccatcgccggcgcccaagctgaagatgacgccgattattactgtagctctcgggacaaatccgggagccgcctctctgtgttcggaggcggcacaaagctgaccgttctt

SEQ ID NO: 39648 - RNA, 327 nt, synthetic construct
  misc_feature 1..327: note = derived and/or modified sequence opt5 from anti-HIV_10E8
  source 1..327: mol_type = other RNA
agctccgagctgacccaggaccccggcgtgtctgtcgccctcaagcaaacagttacgattacctgcagaggggatagcctgcggtcccactacgtgtcttggtatcagaaaaagcctggacaggctccggtgcttgtcttctacggcaaaaacatcgggcccagcggaatccctgaccgcttttccggctctacaagcgggaataccgcctccctgacaattgcgggagctcaggccgaagatgacgccgattattactgtagctctagagacaagtccggcagccggctctctgtgttcggcgggggaaccaaactgacagttctt

SEQ ID NO: 39649 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccgctgtgtccgtcgccctcaagcaaacagttacgattacctgcagaggcgattctctgcggagccactacgtgtcctggtatcagaaaaagcctgggcaggcgccggtgcttgtcttctacggcaaaaacaatcgcccctctggaatccctgacagatttagcgggtcctctagcggaaacacagcttccctgaccatcgccggcgcccaggctgaagatgacgccgattattactgtagctctcgggacaagtccgggagccgcctctctgtgttcggaggcggcacaaaactgaccgttctt

SEQ ID NO: 39650 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccggcgtgtccgtcgctctcaagcaaacagttacgattacctgcagaggggattctctgcggagccactacgtgtcctggtatcagaaacgccctggacaggccccggtgcttgtcttctacggcaagaacaatagaccctctgggatccctgaccggtttagcggatccacatctggcaacaccgcgagcctgacaatcgctggggcccaggccgaagatgacgctgattattactgttccagccgcgacaaatctggatccagactcagcgtgttcggcggcgggaccaagctgacagttctt

SEQ ID NO: 39651 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccggcgtgtccgtcgctctcgaacaaacagttacgattacctgcagaggggattctctgcggagccactacgtgtcctggtatcagaagaaacctggacaggccccggtgcttgtcttctacggcaagaacaatcgcccctctgggatccctgacagatttagcggatccacatctggcaacaccgcgagcctgacaatcgctggggcccaggccgaggatgacgctgattattactgttccagccgggacaaatctggatcccgcctcagcgtgttcggcggcgggaccaagctgacagttctt

SEQ ID NO: 39652 - RNA, 327 nt, synthetic construct
  misc_feature 1..327: note = derived and/or modified sequence opt5 from anti-HIV_10E8
  source 1..327: mol_type = other RNA
gccagcgagctgacccaggaccccggcgtgtccgtcgctctcaagcaaacagttacgattacctgcagaggggattctctgcggagccactacgtgtcctggtatcagaaaaagcctggacaggccccggtgcttgtcttctacggcaaaaacaatcgcccctctgggatccctgacagatttagcggatccacatctggcaacaccgcgagcctgacaatcgctggggcccaggccgaagatgacgctgattattactgttccagccgggacaagtctggatcccgcctcagcgtgttcggcggcgggaccaaactgacagttctt

SEQ ID NO: 39653 - RNA, 327 nt, synthetic construct
  misc_feature 1..327: note = derived and/or modified sequence opt5 from anti-HIV_10E8
  source 1..327: mol_type = other RNA
agctccgagctgacccaggaccccggcgtgtctgtcgccctcaagcaaacagttacgattacctgcagaggggatagcctgcggtcccactacgtgtcttggtatcagaaaaagcctggacaggctccggtgcttgtcttctacggcaaaaacaatcgccccagcgggatccctgacagattttccggatctacaagcggcaacaccgcctccctgacaatcgcgggggctcaggccgaagatgacgccgattattactgtagctctcgggacaagtccggaagccgcctctctgtgttcggcggcgggaccaaactgacagttctt

SEQ ID NO: 39654 - RNA, 327 nt, synthetic construct
  misc_feature 1..327: note = derived and/or modified sequence opt5 from anti-HIV_10E8
  source 1..327: mol_type = other RNA
agctccgagctgacccaggaaacaggcgtgtctgtcgccctcgggagaacggttaccatcacatgccggggagacagcctgcgctcccactacgcttcttggtatcaagagaagcccggccaggcccctaaacttctgttctacgggaagaacaatagaccgagcggcattcccgatcggttttccggatctgcgagcgggaaccgcgcttccctcaccatcagcggagcccaggccgaagacgatgctgagtattactgttcttccagagacaaaagcggctctcggctgtccgtgttcggcgggggaacaaagctggccgtgctt

SEQ ID NO: 39655 - RNA, 327 nt, synthetic construct
  misc_feature 1..327: note = derived and/or modified sequence opt5 from anti-HIV_10E8
  source 1..327: mol_type = other RNA
agctccgagctgacccaggaaacaggcgtgtctgtcgccctcgggagaacggttaccatcacatgccggggagacagcctgcgctcccactacgcttcttggtatcaaaagaaacccggccaggcccctaaacttctgttctacgggaagaacaatagaccgagcggcattcccgatcggttttccggattcgcgtctgggaaccgcgctagcctcaccatctccggagcccaggccgaggacgatgctgaatattactgtagctctagagacaagtccggcagccggctgtctgtgtttggcgggggaacaaaacttaccgtgctg

SEQ ID NO: 39656 - RNA, 327 nt, synthetic construct
  misc_feature 1..327: note = derived and/or modified sequence opt5 from anti-HIV_10E8
  source 1..327: mol_type = other RNA
agctccgagctgacccaggaaacaggcgtgtctgtcgccctcgggagaacggttaccatcacatgccggggagacagcctgcgctcccactacgcttcttggtatcaaaagaaacccggccaggcccctaaacttctgttctacgggaagaacaatagaccgagcggcattcccgatcggttttccggatctgcgagcgggaaccgcgcttccctcaccatcagcggagcccaggccgaggacgatgctgaatatatttgttcttccagagacaagagcggctctcggctgtccgtgttcggcgggggaacaaaacttaccgtgctg

SEQ ID NO: 39657 - RNA, 327 nt, synthetic construct
  misc_feature 1..327: note = derived and/or modified sequence opt5 from anti-HIV_10E8
  source 1..327: mol_type = other RNA
agctccgagctgacccaggaaacaggcgtgtctgtcgccctcgggagaacggttaccatcacatgccggggagacagcctgcgctcccactacgcttcttggtatcaaaagaaacccggccaggcccctaaacttctgttctacgggaagaacaatagaccgagcggcattcccgatcggttttccggatctgcgagcgggaaccgcgcttccctcaccatcagcggagcccaggccgaggacgatgctgaatattactgttcttccagagacaagagcggctctcggctgtccgtgttcggcgggggaacaaaacttaccgtgctg

SEQ ID NO: 39658 - RNA, 327 nt, synthetic construct
  misc_feature 1..327: note = derived and/or modified sequence opt5 from anti-HIV_10E8
  source 1..327: mol_type = other RNA
agctccgagctgacccaggaaacaggcgtgtctgtcgccctcgggagaacggttaccatcacatgccggggagacagcctgcgctcccactacgcttcttggtatcaaaagaagcccggccaggcccctattcttctgttctacgggaagaacaatagaccgagcggaatccatgatcggttttccggctctgcgagcgggaaccgcgcttccctcaccattagcggagcccaggccgaggacgatgctgaatattactgttcttccagagacaaaagcggctctcggctgtccgtgttcggcgggggaacaaaacttaccgtgctg

SEQ ID NO: 39659 - RNA, 393 nt, synthetic construct
  misc_feature 1..393: note = derived and/or modified sequence opt5 from anti-HIV_10E8
  source 1..393: mol_type = other RNA
gaggtgcagctggtcgaaagcggcggggacctcgttaagcccggaggctccctgagactttcttgcagcgcctccgggttctcttttaaaaacacctggatgacatgggtgcggcaagctcctggaaagggcctggagtgggtggggcgcatcacgggaccgggcgaaggctggaccagcgattacgccgcgacagtccaggggagattcaccatttcccggaataacatgatcgacatgctctatctggagatgaatcgccttagaacagatgacaccggactgtactattgtgtgcacacagaaaaatactataacttttggggcgggtatccccctggagaggagtacttccagcattggggccgggggaccctcgttattgtgtctagc

SEQ ID NO: 39660 - RNA, 393 nt, synthetic construct
  misc_feature 1..393: note = derived and/or modified sequence opt5 from anti-HIV_10E8
  source 1..393: mol_type = other RNA
gagatcagactggtggaaagcggcgggggactcgtcaagcccggcgggtccctgcggctttcttgcagcgcctccggattcaactttgactctgcttggatgacctgggttcgccagcctccgggcaaagggctggagtgggtgggaagaattacaggccccggcgaagggtggagcgtgggatacgccgagtccgtcaagggccggttcatcatttctcgcatcaatagcattaactttctctatctggaaatgaataaccttagacctgaggatacggggtcctacttctgtgcgcacaccggaaaacattatgacttttggcggggctatccccctggggaggaatacttccaagattggggacagggcacacaggtgatcgttagctct

SEQ ID NO: 39661 - RNA, 393 nt, synthetic construct
  misc_feature 1..393: note = derived and/or modified sequence opt5 from anti-HIV_10E8
  source 1..393: mol_type = other RNA
gagatcagactggtggaaagcggcgggggactcgtcaagcccggcgggtccctgcggctttcttgcagcgcctccggattcaactttgactctgcttggatgacctgggttcgccagcctccgggcaaagggctggagtgggtgggaagaattacaggccccggcgaagggtggagcgtggattacgccgagtccgtcaagggacggttcatcatttctcgcatcaatagcattaactttctctatctggaaatgaataaccttagacctgaggacacgggctcctacttctgtgcgcacaccgggaaacattatgatttttggcggggatatccccctggcgaggaatacttccaagactgggggcagggaacacaggtgatcgttagctct

SEQ ID NO: 39662 - RNA, 393 nt, synthetic construct
  misc_feature 1..393: note = derived and/or modified sequence opt5 from anti-HIV_10E8
  source 1..393: mol_type = other RNA
gaggtgagactggtcgaaagcggcgggcggctcgttcgccccggaggctccctgagactttcttgcagcgcctccgggttcaactttgacaatgcttggatgacctgggtgcggcagcctccgggaaagggcctggagtgggtggggcgcatcacaggacccggcgaaggctggtctgtcgattacgccgcgagcgtgaaagggagattcacgatttcccggatgaactctatcaactttttctatctcgagatgaataatctgaagattgaagacaccggactttacttttgtgctcgcacaggcaaacactatgccttctggggagggtaccctcccggcgaggagtatctggaagattgggggcaaggaaccctcgttatcgtgagctcc

SEQ ID NO: 39663 - RNA, 393 nt, synthetic construct
  misc_feature 1..393: note = derived and/or modified sequence opt5 from anti-HIV_10E8
  source 1..393: mol_type = other RNA
gaggtgagactggtcgaaagcggcgggggactcgttaagcccggcgggtccctgcggctttcttgcagcgcctccggattcaactttgacgatgcttggatgacctgggtgcgccagcctccgggcaaagggctggagtgggtgggaagaatctctggccccggcgaagggtggagcgtcgactacgccgagtccgtgaagggacggttcacaatttctcgcctcaatagcatcaactttctgtatcttgaaatgaataacgttagaacggaggataccggctactatttctgtgcgcggacagggaaacactacgacttttggtccggatatcctcccggcgaggaatacttccaagattgggggcagggaaccctggtgattgtcagctct

SEQ ID NO: 39664 - RNA, 393 nt, synthetic construct
  misc_feature 1..393: note = derived and/or modified sequence opt5 from anti-HIV_10E8
  source 1..393: mol_type = other RNA
gaggtgagactggccgaaagcggcgggggactcgtcaagcccggcgggtccctgcggctttcttgcagcgcttccggattcgactttgataacgcctggatgacctgggttcgccagcctccgggcaaagggctggagtgggtgggaagaatcacaggccccggcgaagggtggtctgtggactacgcggctcctgtcgagggacggttcacgattagccgcctcaattccatcaactttctgtatcttgaaatgaataacctgagaatggaggattctggcctctacttctgtgcccggaccgggaagtattacgacttttggagcggatatccccctggcgaggaatacttccaagattgggggcagggaacactggtgattgttccctcc

SEQ ID NO: 39665 - RNA, 393 nt, synthetic construct
  misc_feature 1..393: note = derived and/or modified sequence opt5 from anti-HIV_10E8
  source 1..393: mol_type = other RNA
gaggtgagactggtcgaaagcggcgggggactcgttaagcccggcgggtccctgcggctttcttgcagcgcctccggattcgactttgataacgcttggatgacctgggtgcgccagcctccgggcaaagggctggagtgggtgggaagaatcacaggccccggcgaagggtggtctgtcgactacgccgcgcctgtggagggacggttcacgattagccgcctcaattccatcaactttctgtatcttgaaatgaataacctgagaatggaggattctggcctctacttctgtgctcggaccgggaagtattacgacttttggagcggatatccccctggcgaggaatacttccaagattgggggcagggaacactggttattgtgccctcc

SEQ ID NO: 39666 - RNA, 393 nt, synthetic construct
  misc_feature 1..393: note = derived and/or modified sequence opt5 from anti-HIV_10E8
  source 1..393: mol_type = other RNA
gaggtgagactggtcgaaagcggcgggggactcgttaagcccggcgggtccctgcggctttcttgcagcgcctccggattcgactttgataacgcttggatgacctgggtgcgccagcctccgggcaaagggctggagtgggtgggaagaatcacaggccccggcgaagggtggtctgtcgactacgccgcgcctgtggagggacggttcacgattagccgcctcaattccatcaactttctgtatcttgaaatgaataacctgagaatggaggattctggcctctacttctgtgctcggaccgggaagtattacgacttttggagcggatatccccctggcgaggaatacttccaagattgggggcagggaacactggttattgtgtccagc

SEQ ID NO: 39667 - RNA, 393 nt, synthetic construct
  misc_feature 1..393: note = derived and/or modified sequence opt5 from anti-HIV_10E8
  source 1..393: mol_type = other RNA
gaggtgagactggccgaaagcggcgggggactcgtcaagcccggcgggtccctgcggctttcttgcagcgcttccggattcgactttgataacgcctggatgacctgggttcgccagcctccgggcaaagggctggagtgggtgggaagaatcacaggccccggcgaagggtggtctgtggactacgcggctcctgtcgagggacggttcacgattagccgcctcaattccatcaactttctgtatcttgaaatgaataacctgagaatggaggattctggcctctacttctgtgcccggaccgggaagtattacgacttttggagcggatatccccctggcgaggaatacttccaagattgggggcgcggaacactggtgattgtttccagc

SEQ ID NO: 39668 - RNA, 393 nt, synthetic construct
  misc_feature 1..393: note = derived and/or modified sequence opt5 from anti-HIV_10E8
  source 1..393: mol_type = other RNA
gaggtgagactggtcgaaagcggcgggggactcgttaagcccggcgggtccctgcggctttcttgcagcgcctccggattcgactttgataacgcttggatgacctgggtgcgccagcctccgggcaaagggctggagtgggtgggaagaatcacaggccccggcgaagggtggtctgtcgactacgccgcgcctgtggagggacggttcacgattagccgcctcaattccatcaactttctgtatcttgaaatgaataacctgagaatggaggattctggcctctacttctgtgctcggaccgggaagtattacgacttttggagcggatatccccctggcgaggaatacttccaagattgggggcgcggaacactggttattgtgtccagc

SEQ ID NO: 39669 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggagatctagcaacattggaaataacaatgtgttctggtaccagcagctccccggcacggcccctaaactgcttatctatgacaacgataagcggccctccgggattcctgaccgcttttctggaagcaaatccggcaccagcgcgacactggggatcaccggactccaaacaggcgatgaggctgactactattgtggcacctgggattcttccctgagcgccgggggagtgttcggcacagggaccaaggtcacggtgctt

SEQ ID NO: 39670 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccgcctccgtctctggcagccctgggcagtccatcacaatttcttgcacgggaaccaagagcgacatcggcgggtacaaatatgtttcctggtaccagcagcacccgggaaaggctcccaaaattctcatctatgatgtgaacaagagaccttctggcattcccgaccggttcagcgggtccaaaagcggaacatctgccaccctgggcatcacaggccttcaaaccggggatgaggcggactactattgtggaacatgggataattccctgagcaccggcggggtgtttggaacgggcaccaaggtcacagtgctc

SEQ ID NO: 39671 - RNA, 321 nt, synthetic construct
  misc_feature 1..321: note = derived and/or modified sequence opt5 from anti-HIV-1_LightChain
  source 1..321: mol_type = other RNA
cagagcgtgctgacccaacccccttccgtctctgccgctccgggccagagagttacaatcagctgcttcgggtcccggttttctagcgtgtcctggtaccagcagctccccggaacggcccctaagctgcttatttatgagaacaccaaacgcccctctggcatccctgacagattcagcgggtccaagagcggaacatctgcgaccctgggcattacagggctccaaaccggagatgaagctgactactattgtggcacatgggatcggtccctgagcgccggcggggtgtttggaaccggcacgaaagtcaccgtgctt

SEQ ID NO: 39672 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagacgatcaccattagctgctccggatctagctccaacatcggctctaatgacgtctactggtatcagcacctccccgggacaacccctaaggttgtgatttacaaaaacaatagacggcccagcggaatccctgatcgcttctccggcagcaagtctgggacatccgctaccctgggaattacaggccttcagaccggcgacgaggccgattattactgtgggacgtgggacagaagcctgtctgcgggaggcgtgtttgggaccggaacaaaagtcaccgtgctc

SEQ ID NO: 39673 - RNA, 327 nt, synthetic construct
  misc_feature 1..327: note = derived and/or modified sequence opt5 from anti-HIV-1_LightChain
  source 1..327: mol_type = other RNA
cagagcgtgctgacccaacccccttccatgtctgccgctccgggccagaaggtcacaatcagctgctccgggtctacgagcattatcggaaacaattacatttcctggtatcagcagctccccggcaccgcccctaaactgcttatctacgaggacaacaagagaccctctgggattcctgatcggttcagcggatccaaaagcggcacatctgcgaccctggggatcacaggactccaaaccggcgacgaagctgattattactgtggcacatggcactccagcctgtctgccgggggagtttttggcaccgggacgaaggtgacc

SEQ ID NO: 39674 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggcctcaaggttacaatcagctgctccgggaacacgtctaatgtgggagacaacttcgtgagctggtacagatatctgcccggcaccgcccctaaacttctgtcctacgaggatgacaagcggccctctgggattcctgatcgctttagcggatccaaaagcggcacatctgcgaccctcgggatcacaggactgcagaccggcgacgaagctgattattactgtggcacatgggactccagcctttctgccgggggagtcttcggcaccgggacgaaggtgaccgttctg

SEQ ID NO: 39675 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagagagtcacgatcagctgctccggatctagctccaacattggctctaataccgttaactggtaccagcagttccccgggacagctcctaagctcctgatctatgagaataaccggcgccccagcggagtgcctgccagattttccggcagcaaatctgggacctccgcgacacttgctattaccggactgcaaacaggcgacgaagccgattactattgtgccacctgggacagctctctctccgctggcggggtgttcggaacgggcaccaaggtcacagtgctg

SEQ ID NO: 39676 - RNA, 318 nt, synthetic construct
  misc_feature 1..318: note = derived and/or modified sequence opt5 from anti-HIV-1_LightChain
  source 1..318: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgagaataacaagagacccagcgggattcctgaccggttctccggaagcaaatctggcacctccgcgacactggggatcaccggactccaaacaggcgatgaagctgactattactgtggcacctgggataatagcctgtctacagggggagtgtttggcaccgggacg

SEQ ID NO: 39677 - RNA, 288 nt, synthetic construct
  misc_feature 1..288: note = derived and/or modified sequence opt5 from anti-HIV-1_LightChain
  source 1..288: mol_type = other RNA
ggcctgagcccctccctctgctctgggagctcctctaacatcggaaataactacgtgagctggtatcagcaactgcctggcaccgccccgaaacttctgatttacgagaatacaaagagaccctccgggatccctgaccggttctctggaagcaagtccggcacgagcgctaccctcgggattacaggactgcagaccggcgatgaaggcgactattactgtgggacatgggatcgctctctttccgccggaggcgtctttgggaccggaacaaaagttaccgtgctg

SEQ ID NO: 39678 - RNA, 333 nt, synthetic construct
  misc_feature 1..333: note = derived and/or modified sequence opt5 from anti-HIV-1_LightChain
  source 1..333: mol_type = other RNA
cagttcgtgctgacccaaccccctagcgtctccgccgctccgggccagagagttacagtgtcttgcagcgggacgacctccgacatcggagagaactacgtgtcttggtatcagaagtttagcgaagccgcgcccaaactcctgctttacgataatgacaagcggccttccggcattcccgatcgcttctctgggagcaaatccggaacaagcgctaccctgggcatcacagggctccagaccggagacgaggccgattattactgtggcacatgggactcttccctgagcgccggcggggtctttggaaccggcacgaaggtgaccgttctt

SEQ ID NO: 39679 - RNA, 327 nt, synthetic construct
  misc_feature 1..327: note = derived and/or modified sequence opt5 from anti-HIV-1_LightChain
  source 1..327: mol_type = other RNA
cagagcgtgctgacccaacccccttccgtctctgccgctccgggccagaaggttacaatcagctgctccgggggatctagcaacattggcaattactatgtgtcctggtacctccagctgcccgggacggcccctaaacttctgatctatgagaacaataagagaccctctggcattcctgaccggttcagcggatccaaaagcgggacctctgcgacactcggaatcaccggcctgcagacaggcgatgaagctgactactattgtgggacctggcactccagcctttctgccggaggcgtgtttgggacaggaaccaaggtcacg

SEQ ID NO: 39680 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggaacatgtctaatattggagacaacgccgtgagctggtacagacaggtgcccgaggcgcctccccagctcctgatcttcggcaatgataaacggccttccggggtcacggaccgcttttctggaagcaagtccggcaccagcgctacacttgggattaccggactgcaaacaggcgatgaagccgactattactgtggcacctgggatagatctctctccgccgggggagtgttcggcacagggaccaaagttacggtgctg

SEQ ID NO: 39681 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagagttacaatcagctgcacgggatcctctagcaacattggcgctgggtacgacgtgcactggtatctccagctgcccggaaccgcccctcggcttctgatctacgataatgacaagcgcccctccggcattcctgatagattctctgggagcaaatccggaacaagcgcgaccctcggcatcacaggcctgcagaccggggacgaggctgattattactgtggaacatggcattcttcccttagcgccggcggggtgtttggaaccggcacgaaggtcaccgtgctg

SEQ ID NO: 39682 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctacgagcaacattggaaataacttcgtgtcctggtaccagcagctccccggcaccgcccctaaactgctgttttatgacaattacaagagaccctctgggatccctgatcggttcagcggatccaaaagcggcacatctgcgacccttgctattacagggctccaaaccggagacgaggccgattattactgtgccacatgggactccagcctgtctgctggcggcgtgtttgggaccggaacgaaggtcaccgtgctt

SEQ ID NO: 39683 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagagttacaatcagctgcacgggaggctcctctaacattggggctggatacgacgtgcactggtatcagcatctccccggcaccgcccctcagctgcttatctacgagaatacaaagcggcccagcgggattcctgatcgcttctccggatctaaaagcggcacctccgcgacactgggcatcaccgggctccaaacaggagacgaagctgattattactgtggcacctgggacagaagcctgtctgccgggggagtgtttggcacggggaccaaggtcacagtgctt

SEQ ID NO: 39684 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccctctctgccgctccgggccagagagtcacagttagctgctccgggtctagctccaacatcggagacaattacgtgtcttggtatcagcagctgcccggcgccgcgcctcggcttctgatttacgagaacaataagcgccccagcgggatccctgatagattctccggaagcaaatctggcacgtccgctaccctcgggattacaggactgcaaaccggcgacgaagccgattattactgtggcacatgggacaacagcctttctaccgggggagtgtttggcacagggaccaaggtcacggtgctg

SEQ ID NO: 39685 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggagatctagcaacattggaaattacttcgtgtcctggtatcagcagtttcccggcacggcccctaaactcctgatctacgacaacaataagcggccctctgggattcctgatcgcttcagcggatccaaaagcggcacctctgcgacacttgggatcaccggactgcaaacaggcgacgaggctgattattactgtggcacctgggacagatccctcagcgccgggggagtgtttggcacagggaccaaggtcacggtgctg

SEQ ID NO: 39686 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagagagtcacgatcagctgctccggatctagctccaacattggctctaatgctgttcactggttccggcagctccccgggaccgcccctaagctgcttatctacgagaacaataaacgccccagcggcattcctgacagattttccggaagcaagtctgggacatccgcgaccctgggaatcacaggcctccagaccggcgatgaagctgactattactgtgccacatgggatagctctctgtccgccgggggagtgttcggcaccgggacgaaagtgaccgtcctt

SEQ ID NO: 39687 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctagcggccagaaggttacaatctcctgctctgggagctcctctaacattggaaataactacgtgagctggtatcaccagctcccgggcacggcccccaaactgcttatctacgacaccaataagagaccttccgggattcccgatcggttcagcggatctacatccggcaccagcgcgacactggggatcaccggactccagacaggcgacgaggctgattattactgtggcacctgggacaactctctgtccaccgggggagtgtttggcacggggacaaaagtcaccgtgctt

SEQ ID NO: 39688 - RNA, 333 nt, synthetic construct
  misc_feature 1..333: note = derived and/or modified sequence opt5 from anti-HIV-1_LightChain
  source 1..333: mol_type = other RNA
cagcccgtgctgacccaacctccgagcgtctccgccgctcccggccagacagttacgatctcttgcagcgggtccttctctaacattgagaccaattacgtgagctggtatcagcagctccctggaacagcccccaagctgcttatctacgacaacaatatgagaccttccggcattcccgatcggttttctgggagcaaatccggaaccagcgcgacactgggcatcaccgggctccaaacaggagacgaagctgattattactgtggcacctgggacacgtctctgtccgccggcggggtgttcggaaccggcacaaaggtcaccgtgctt

SEQ ID NO: 39689 - RNA, 336 nt, synthetic construct
  misc_feature 1..336: note = derived and/or modified sequence opt5 from anti-HIV-1_LightChain
  source 1..336: mol_type = other RNA
cagcccgtgctgacccaacctccgagcgtctccggcgcccccgggcagagagttacaatctcttgcacgggaagctcctctaacattggcgctgggtacgacgtgcactggtatcagcagctccctggaaccgcccccaagctgcttatctacgagaataacaaacggcctagcggcattcccgatcgcttctccgggtctaagagcggaacatccgcgaccctgggcatcacaggcctccaaaccggggacgaagctgattattactgtggaacatgggacaatagcctgtctaccggcggggtgtttggaacgggcaccaaagtcacagtgctt

SEQ ID NO: 39690 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccctctctgccgctccgggccagagaatcacaattagctgctccgggtctagctccaacatcggaaataactacgtctcttggtatcagcagttccccggcacggcccctaagctgcttatttacgagaataacaaacggcccagcgggatccctgaccgcttttccgcgagcaagtctggaacctccgctacactgggcattaccgggctccaaacaggagatgaagccaattattactgtggcacctggcacagctctctgtccgccggcggggttttcggaacaggcaccaaagtgacggtgctt

SEQ ID NO: 39691 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacaatcagctgcttcgggtcccggtttaacgtgggaacgtctagcgtgtcctggtaccagcagctccccggcaccgcccctaagctgcttattgacgcgaatggggagcgcccctctggaatccctgatagattcagcggctccaaaagcgggacatctgctaccctgggaattacaggcctccaaaccggcgacgaagccgattattactgtgggacatgggactccagcctgtctgccggaggcgtctttgggaccggaacgaaggtgaccgttctt

SEQ ID NO: 39692 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccacaccgggccagaaggttacgatcagctgctccgggtctagaagcaacattggatcccactacgtgtcttggtatcagcagttccccggcaccgctcctaaactcctgatctacgacaataacaagcggcccagcgggattcctgatcgcttttccggaagcaaatctggcacatccgccacccttgggatcacaggactgcaaaccggcgacgaggcggattattactgtggcacatggcatagctctctctccgctgggggagtgttcggcaccgggacgaaggtcaccgtgctg

SEQ ID NO: 39693 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagagagtcacgatcagctgctccggatctagctccaacattggctctaatcacgtttactggtatcagcagctccccgggaagacccctaaactgcttatctaccggaacaatcaacgccccagcggcattcctgacagattctccggaagcaagtctgggacatccgctaccctgggaatcacaggcctccagaccggcgatgaggccgactattactgtgggacatgggatagctctctgtccaccggaggcgtgtttgggacgggaaccaaagtgacagtcctt

SEQ ID NO: 39694 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagcgccaacattggaaataactacgtgtcctggtatcagcagttccccggcacggggcctagactcatcatttacgagtctaataaacggcccagcggaatctccgaccgctttagcggctctcaatccgatgcggctgccaccctggacattacagggcttcagaccggagatgaagccgactattactgtggcacatgggatagctctctgtccgctggcggggtgttcggaaccggcacaagagtcaccgtgctc

SEQ ID NO: 39695 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagacagttacgatcagctgcaccggagacacatccaacattggcgctgattacagagtgcactggtatcagcagctccccgggaccgcccctaagctgcttatctacgagaataacaaacggccctctggcattcctgaccgcttcagcggatccaagtctgggacaagcgcgaccctgggaatcacaggcctccaaaccggcgatgaagctgactattactgtgggacgtgggataattccctgagcaccggaggcgtgtttgggacaggaaccaaagtcacagtgctt

SEQ ID NO: 39696 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccctctctgccgctccgggccagagagtcacagttagctgctccgggtctagctccaacatcggaaataactacgtgtcttggtatcagcagctgcccggcgccgcgcctaaacttctgatttacaataacaatatccggcccagcgggattcctgagcgcttctccggaagcaagtctggcacgtccgctaccctcgggatcacaggactgcaaaccggcgacgaaggcgattattactgtgggacatgggacagaagcctttctgccggaggcgtgtttgggaccggaacaaaggtcaccgtgctg

SEQ ID NO: 39697 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagagagtcacgatcagctgctccggatctagctccaacattggcgggaattacgtttcttggtatcagcagctccccggaaccgctcctaagctgcttatcagcgagaacaataaacggccctccggcattcctgaccgcttcagcgggtctaagtccggaacaagcgccaccctgggcatcacaggcctccaaaccggggatgaagcggactactattgtggaacatgggattcttccctgagcgctggcggggtgtttggaaccggcacgaaagtgaccgtcctt

SEQ ID NO: 39698 - RNA, 333 nt, synthetic construct
  misc_feature 1..333: note = derived and/or modified sequence opt5 from anti-HIV-1_LightChain
  source 1..333: mol_type = other RNA
cagagcctgctcacccaacccccttccgtgtctgccgctccgggccagaaggtcacaatcagctgctccgggtctagctccaacattggaaataacttcgtttcttggtaccagcagctgcccggcacggcccctaaacttctgatctatgagaataacatgagacccagcgggattcctgaccggttttccggaagcaagtctggcacctccgcgacactcgggatcaccggactgcaaacaggcgatgaagctgactactattgtggcacctgggatagctctctttccgccgggggagtgttcggcacagggaccaaagtgacggtcctg

SEQ ID NO: 39699 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggacgtctagcaacattgccaattactatgtgtcctggtacagacagctccccggaaccgcgcctaaactgcttatctatgagaacaataagcggccctctggcattcctgaccgcttcagcgggtccaaaagcggaacatctgctaccctgggcatcacagggctccagaccggagatgaagccgactactattgtggcacatgggattccagcctgtctgccggcggggtgtttggaaccggcacgaaggtcaccgtgctt

SEQ ID NO: 39700 - RNA, 333 nt, synthetic construct
  misc_feature 1..333: note = derived and/or modified sequence opt5 from anti-HIV-1_LightChain
  source 1..333: mol_type = other RNA
cagcccgtgctgacccaacctccgagcgtctccggcgcccccgggcagagagttacaatctcttgcagcggatcctctagcaacattggcaataacgacgtgtcctggtaccaacaggtgcctgggacggctcccaagctcctgatctatgagaataacaaacggccttctggcattcccgatcgcttcagcggatccaagagcgggacctctgccacacttggaatcaccggcctgcagacaggcgacgaagcggattactattgtgggacctgggacacatccctcagcgctggaggcgtctttgggaccggaacgaaagtgaccgttctg

SEQ ID NO: 39701 - RNA, 333 nt, synthetic construct
  misc_feature 1..333: note = derived and/or modified sequence opt5 from anti-HIV-1_LightChain
  source 1..333: mol_type = other RNA
cagctggtgctcacccaaccccctagcgtctccgccgctccgggccagagagttacaatctcttgcttcgggagccggtttaacgtgggaacgtcctctgtgagctggtaccagcagctgcccggcaccgcccctaaacttctgattgacgcgaatggggagcgcccctccggaatccctgatagattctttggctctgaaagcgggacatccgctaccctcggaattacaggcctgcaaaccggcgacgaggccgattattactgtgggacatggcacagctctctttccgccggaggcgtcttcgggaccggaacgaaggtgaccgttctg

SEQ ID NO: 39702 - RNA, 333 nt, synthetic construct
  misc_feature 1..333: note = derived and/or modified sequence opt5 from anti-HIV-1_LightChain
  source 1..333: mol_type = other RNA
agctacgagctgacccagcccccttccgtgtctgccgctccgggccaaaaggtcacaatcagctgctccgggtctagctccaacattggaaataactatgtttcttggtaccagcagctccccggcacggcccctaaactgcttatctatgaaaataacaagagacccagcgggattcctgaccggttctccggaagcaaatctggcacctccgcgacactggggatcaccggactccagacaggcgatgaggctgactactattgtggcacctgggatacaagcctgtctgccgggggagtgtttggcaccgggacgaaggtgaccgtcctt

SEQ ID NO: 39703 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagagagtcacgatcagctgctccggatctaccagcaacattggcacatactatgtttcctggtaccagcagctccccgggaccgctcctaagctgcttatctatgagaatacaaaacggccctctggcattcctgaccgcttcagcggatccaagagcgggacctctgccacactgggaatcaccggcctccaaacgggcgatgaaggggactactattgtggaacctgggatagatccctgagcgcgggcggggtgtttggaacaggcaccaaagtgacagtcctt

SEQ ID NO: 39704 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccgcttccgtgtctgccagccctggccagtccatcgcgatttcttgcacagggacgagctccgacgtcggatcttacaactatgttagctggtaccagcagctcccgggcaccgctcccaagctgcttatctatgagaatacaaaaagaccttccgggattcccgatcggttcagcggatctaagtccggcaccagcgccacactggggatcaccggactccaaacaggcgacgaagccgattactattgtggcacctgggaccgctctctgtccgctgggggagtgtttggcacggggaccaaagtgacagtcctt

SEQ ID NO: 39705 - RNA, 330 nt, synthetic construct
  misc_feature 1..330: note = derived and/or modified sequence opt5 from anti-HIV-1_LightChain
  source 1..330: mol_type = other RNA
cagagcgtgctgacccaacccccttccgtctctgccgctccgggccagagagttacaatcagctgctccgggggatctagcaacattggcaataaccacgtgtcctggtaccagcatctccccgggcgggcccctcagctgcttatctatgacacgacccaacgcccctctggcattcctgatagattcagcggatccaagagcgggacatctgcgaccctgggaatcacaggcctccagaccggcgacgaggctgattactattgtgggacatgggactccagcctgtctaccggaggcgtgtttgggacgggaaccaaagtcacagtg

SEQ ID NO: 39706 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagagagtcacgatcagctgctccggatctagctccaacattggctctaagtacgtttgttggtatcagcagctccccgggaccgctcctaaactgcttatctaccggaataaccaacgccccagcggcattcctgacagattctccggaagcaagtctgggacatccgccaccctgggaatcacaggcctccagaccggcgatgaggcggactattactgcgggacatggcacagctctctgtccgctggaggcgtgtttgggaccggaacgaaagtgaccgtcctt

SEQ ID NO: 39707 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccggggactctagcacgttcgagaacgattacgtgtgttggtatcagcagctccccggaaccgcccctaaactgcttatttacgacaataacaagagaccctccggcatccctgatcggttttctgggagcaaatccggaacaagcgcgaccctgggcattacagggctccaaaccggagacgaagctgattattactgcggcacatggcactcttccctgagcgccggcggggtgttcggaaccggcacgaaggtcaccgtgctt

SEQ ID NO: 39708 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaactgcttatctacgggaatagcaacagaccctccggagtgcctgaccggttcagcggctctaagtccgggaccagcgcgtctctggctattacaggactccaagccgaggatgaagccgactattactgtggcacctgggattccagcctgtctgctggcggggtctttggaacaggcaccaaagtgacagttctt

SEQ ID NO: 39709 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagacagttacgatcagctgctccgggtctagctccaacattggatctaataccgtgaactggtaccagcagctccccggcacagcccctaagctgcttatctatgagaataacaaaagacccagcgggattcctgaccggttctccggaagcaagtctggcacctccgcgacactggggatcaccggactccaaacaggcgatgaagctgactactattgtggcacctgggataatagcctgtctaccgggggagtgtttggcacggggacaaaagtcaccgtgctt

SEQ ID NO: 39710 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagagttacaatcttctgcacgggaagctcctctaacgtgggcgggggatacgacgtgcactggtatcagcagctccccggcaccgctcctaagctgcttatttacgagaataacaaacggcccagcgggatccctgatcgcttttccggatctaagagcggcacatccgccaccctgggcattacagggctccaaaccggagacgaagcggattattactgtggcacatgggacagctctctgtccgctgggggagtcttcggcaccgggacgaaagtgaccgttctt

SEQ ID NO: 39711 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacactcagctgctccgggtctagctccaacatcggaaataactctgtgagctggtaccagcagttccccggcacggcccctaaactgcttatttatgactccgataagagacccagcgggatccctgaccggttttctggatccaaaagcggcacctctgcgacactggggattaccggactccaaacaggcgatgagggcgactactattgtgggacctgggatcgctccctgagcgctggaggcgtgttcgggacaggaaccaaggtcacggtgctt

SEQ ID NO: 39712 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagaaggtcacgatcagctgctccggatctagctcccagattggctctaacagcgtttactggtatcagcaactccccgggaccacacctaaactgcttatctacggaaataaccagagaccctccggcattcctgaccggttcagcgggtctaagtccggaaccagcgctacactgggcatcaccggcctccagacaggggatgaggccgactattactgtggaacctgggattcttccctgagcgcgggcggggtgtttggaacgggcaccaaagtgacagtcctt

SEQ ID NO: 39713 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccgcttccgtgtctggcagccctgggcagtccatcacaatttcttgcacgggaaccggcagcgacgtcgggggatacaaccacgtttcctggtatcagcagcatccgggcaaggcccccaaactcctgatctacgataataacaagagaccttctgggattcccgaccggttcagcggatccaaaagcggcacatctgcgacccttggcatcacagggctgcaaaccggagatgaggctgactattactgtggcacatggcactccagcctctctgccgggggagtgtttggcaccgggacgaaggtgaccgtcctg

SEQ ID NO: 39714 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacaatcagctgctccgggtctggaagcaacattggcgaccggttcgtgtcctggtaccagcacctccccgggacggtgcctaagctgcttatctatgataatgagcatcgcccctctggcattcctgacagatttagcggatccaaaagcgggacctctgccacactgggaatcaccggcctccagacaggcgatgaagcggactactattgtgggacctgggattccagcctgtctgctggaggcgtcttcgggacaggaaccaaggtgacggttctt

SEQ ID NO: 39715 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaagatcacaattagctgctccgggtctagctccaacatcggaaaatctgttgtgagctggtacagacagttccccggcacggcccctaagctcctgatttatgacacctacaaacggccctccgggatccctgatcgctttagcggatctaagtccggcacaagcgcgacccttgggattacaggactgcagaccggcgacgaggctgattattactgtggcacatggcactcttccctcagcgccgggggagtgttcggcaccgggacgaaagtcaccgtgctg

SEQ ID NO: 39716 - RNA, 333 nt, synthetic construct
  misc_feature 1..333: note = derived and/or modified sequence opt5 from anti-HIV-1_LightChain
  source 1..333: mol_type = other RNA
cagcccgtgctgacccaacctccgagcgcctccggcacacccgggcagagagtcacgatctcttgcagcggatcctctagcaacattggcgggaataccgttaactggtaccagcagttccctggagctgcgccccggctcctgatctatgaggacaataagcgcccttccggcattcccgatagattttctgggagcaaatccggaacaagcgccacccttggcatcacaggcctgcaaaccggggacgaagctgattactattgtggaacatgggactcttccctcagcgccggcggggtgttcggaaccggcacgaaggtgaccgtcctg

SEQ ID NO: 39717 - RNA, 333 nt, synthetic construct
  misc_feature 1..333: note = derived and/or modified sequence opt5 from anti-HIV-1_LightChain
  source 1..333: mol_type = other RNA
aacttcatgctgacccagccccacagcgtgtccgagtctcctggcaagacagtcacgatcagctgcaccagatcctctgggagcgttgcctccaattacgtgcaatggtatcagcagctcccgggaacagctcccaaactgcttatttacgaaaacaataagcggccttctggcatccccgaccgctttagcgggtccaaaagcggaacctctgccacactgggcattaccgggctccagacaggagatgaggcggactattactgtggcacctggcattccagcctgtctgctggcggggtgttcggaacgggcaccaaggtcacagtgctt

SEQ ID NO: 39718 - RNA, 333 nt, synthetic construct
  misc_feature 1..333: note = derived and/or modified sequence opt5 from anti-HIV-1_LightChain
  source 1..333: mol_type = other RNA
cagagcatgctgacccaacccccttccgtgtctgccgctccgggccagagagtcacagttagctgctccgggtctagctccaacatcggatctcacttcgtgagctggtaccagcagctccccggcacggcccctaagctgcttatttatgacaattccaaccggcccagcgcgatccctgatcgcttttctgggtccaaaagcggaacctctgctacactgggcatttccgggctccataccggagacgaggccgattactattgtgccacatgggacaatagcctgtctaccggcggcgtgttcgggacaggaaccaaggtcacggtgctt

SEQ ID NO: 39719 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttatcattagctgctccgggggatctagcaacatcggcaataacttcgtgtcctggtaccaccagctccccgggacagcccctaaactgcttatttatgagaatacgaagagaccctctaaaatccctgcgcggtttagcggatccaagagcggcacctctgctacactggggattaccggactccagacaggcgacgaagccgattactattgtggcacctgggactccagcctgtctgccgggggagtgttcggcacagggaccaaagtcacggtgctt

SEQ ID NO: 39720 - RNA, 315 nt, synthetic construct
  misc_feature 1..315: note = derived and/or modified sequence opt5 from anti-HIV-1_LightChain
  source 1..315: mol_type = other RNA
cagagcctgctcacccaacccccttccgtgtctgccgctccgggccagaaggtcacaatcagctgctccgggtctagctccaacattggaaataactacgtttcttggtatcagcagctgcccggcacggcccctaaacttctgatctacgagaataacaagagacccagcgggattcctgaccggttctccggaagcaaatctggcacctccgcgacactcgggatcaccggactgcaaacaggcgatgaagctgactattactgtggcacctgggatagctctctttccgccgggggagtgtttggcacaggg

SEQ ID NO: 39721 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccgcttccgtgtctggcagccctgggcagtccatcacaatttcttgcacgggaaccagctccgacatcggctcttacagcttcgtctcctggtatcagcagcacccggggaaggcccccaaactcattatctacgatgttaacaagagacctagcggcattcccgaccggttttctggatccaaaagcgggacatctgcgaccctgggaatcacaggccttcaaaccggcgatgaggctgactattactgtgggacatgggatcgctccctgagcgccggaggcgtgttcgggaccggaacgaaggtgaccgtcctc

SEQ ID NO: 39722 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagagttacaatcagctgcacgggaaactcctctaatattggcgctgggttcgacgtgcactggtaccggcatctccccggaaccgcccctaagctgcttatctatgagaacacaaaacgccccagcggcattcctgatagattttccgggtctaagagcggaacctccgcgacactgggcatcaccggcctccagacaggggacgaagctgattactattgtggaacctgggaccggagcctgtctgccggcggggtgttcggaacgggcaccaaagtcacagtgctt

SEQ ID NO: 39723 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggggatctagcaacattggcaattactatgtgtcctggtacctccagctgcccggggccgcgcctaaacttctgatctatgacacggataagagaccctctggcattcctgaccggttcagcggatccaaaagcgggacctctgctacactcggaatcaccggcctgcagacaggcgatgaggccgactactattgtgggacctgggatcgctcccttagcgccggaggcgtgtttgggacaggaaccaaggtcacggtgctg

SEQ ID NO: 39724 - RNA, 333 nt, synthetic construct
  misc_feature 1..333: note = derived and/or modified sequence opt5 from anti-HIV-1_LightChain
  source 1..333: mol_type = other RNA
cagagcgtgctgaccagacccccttccgtctctgccgctccgggccaaaaggttacaatcagctgctccgggcggtctagcaacattggaaataactacgtgtcctggtatcagcagctccccggcgccgcgcctaaactgcttatctacgagaataacaagcgcccctctgggattcctgacagattcagcggatccaaaagcggcacgtctgctaccctggggatcacaggactccagaccggcgatgaagccgactattactgtggcacatgggattccagcctgtctgccgggggagtgtttggcaccgggacaaaggtcaccgtgctt

SEQ ID NO: 39725 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggacgatttctaacatcggagccaatctcgtgagctggtacagacagctgcccggcaccgtgcctacagtccttattcacgagaacaataaacggccctccgggatccctgaccgcttctctggaagcaagtccggcaccagcgcgacactggggattaccggactccagacaggcgatgaagctgactattactgtggcacctggcattcttccctgagcgccgggggagtgtttggcacggggaccaaagttacagtgctt

SEQ ID NO: 39726 - RNA, 327 nt, synthetic construct
  misc_feature 1..327: note = derived and/or modified sequence opt5 from anti-HIV-1_LightChain
  source 1..327: mol_type = other RNA
cagagcgtgctgacccaacccccttccgtctctgccgctccgggccagaaggttacaatcagctgctccgggtctagctccaacattggaaataacttcgtgtcttggtaccagcagctccccggcacggcccctaaactgcttatctatgagaataccaagagacccagcgggattcctgaccggttttccggaagcaaatctggcacatccgcgaccctggggatcacaggactccaaaccggcgatgaagctgactactattgtggcacatgggatcgcagcctgtctgccgggggagtgttcggcaccgggacgaaggtcacc

SEQ ID NO: 39727 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaatccccctctgtcagcgccgctcctggccagagagttacaatctcctgctctgggggaagctccaacattggctctaatgccgtgagctggtaccagcagctcccggggacggcgcccaagctgcttatctatggagacaccatgcggccttccggcattcccgatcgcttcagcgggtctaaatccggaacaagcgctaccctgggcatcacaggcctccaaaccggggacgaggccgattactattgtggaacatgggacagatctctgtccgccggcggggtgtttggaaccggcacgaaggtcaccgtgctt

SEQ ID NO: 39728 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagcaggttacaatcagctgctccgggacgacctctaacattggaacaaattacgtgagctggtatcagcaaatgccccctgccgcgcccaagctcctgatctacgacaacaaaaagagaccttccgatattcccgaccggttctctggcagcaaatccgggaccagcgctacacttggaatcaccggcctgcagacaggggatgaggccgactattactgtggaacctgggatcgctctctctccgccggcggcgtgtttgggacgggaaccaaggtcacagtgctg

SEQ ID NO: 39729 - RNA, 333 nt, synthetic construct
  misc_feature 1..333: note = derived and/or modified sequence opt5 from anti-HIV-1_LightChain
  source 1..333: mol_type = other RNA
cagagcgtggtcacccaatccccctctgccagcggcacacctgggcagagagttatcatttcctgctctggaagctcctctaacatcggcaatatttacgtgagctggtatcagcagctgccggggacggctcccaagctcctgatctacgagaacaataaacggccttccggcattcccgaccgcttcagcggatctaagtccgggaccagcgccacacttggaatcaccggcctgcaaacaggcgatgaagcggactattactgtgggacctggcactcttccctcagcgctggaggcgtgtttgggacaggaaccaaagtcacggtgctg

SEQ ID NO: 39730 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccatgtctgccgctccgggccagaaggtcacaatcagctgctccgggtctacgagcattatcggaaacaattacatttcctggtatcagcagctccccggcaccgcccctaaactgcttatctacgaggacaacaagagaccctctgggattcctgatcggttcagcggatccaaaagcggcacatctgcgaccctggggatcacaggactccaaaccggcgacgaagctgattattactgtggcacatgggaccgctccctgagcgccgggggagtttttggcaccgggacgaaggtgaccgtgctt

SEQ ID NO: 39731 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccccttccgcttctggcagcagagggcagtccgtgatcatttcttgcacaggaacgagctccgacgtcggcgtttacaacctcgtgtcttggtatcagcagctgccggggaccgcccccaaacttctgatctacgagaataacaagcggcctagcggcattcccgatcgcttctccggaagcaagtctgggacatccgcgaccctcggaatcacaggcctgcaaaccggcgacgaagctgattattactgtgggacatggcacagctctctttccgccggaggcgtgtttgggaccggaacgaaagtcaccgtgctg

SEQ ID NO: 39732 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccatgtctgccgctccgggccagagcgtctccatctcttgcagcgggtcctctgacaacattgagagaaatcaggttatctggctccgccaggtgcccggagccgcgcctacagtgctgattatcttcaacaatcggagacccagcggcgtccctgatcggttttccgggagccgctctggaacgtccgctacccttggcattacagggctgcaaaccggagacgaagccgattactattgtggcacatgggacagaagcctctctgccggcggggtgttcggaaccggcacaaaggttaccgtgctg

SEQ ID NO: 39733 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagacagttacgatcagctgctccgggtctttcagcaacattgagaccaattacgtgtcctggtatcagcagctccccggaacagcccctaagctgcttatctacgaaaacaccaaaagaccctctggcattcctgaccggtttagcgggtccaagagcggaacatctgcgaccctgggcatcacagggctccaaaccggagatgaggctgactattactgtggcacgtgggatcgctccctgagcgccggcggggtgttcggaaccggcacaaaagtcaccgtgctt

SEQ ID NO: 39734 - RNA, 333 nt, synthetic construct
  misc_feature 1..333: note = derived and/or modified sequence opt5 from anti-HIV-1_LightChain
  source 1..333: mol_type = other RNA
cagagcctgctcacccaacccccttccgtgtctgccgctccgggccagaaggtcacaatcagctgctccgggtctagctccaacattggatctaaatacgtttgttggtatcagcagctgcccggcacggcccctaaacttctgatctacgagaataccaagagacccagcgggattcctgaccggttctccggaagcaagtctggcacatccgcgaccctcgggatcacaggactgcaaaccggcgatgaagctgactattactgcggcacatgggatcgcagcctttctgccgggggagtgtttggcaccgggacgaaagtgaccgtcctg

SEQ ID NO: 39735 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccagatccgtgtctggcagccctgggcagtccgtcacaatctcttgcacgggaaccacaagcgacgttggcgggtacaactatgtgtcctggtaccagcagctcccgggaaccgctcccaagctgcttatttatgagaataacaaacggccttctggcatccccgatcgcttcagcgggtccaagagcggaacatctgccaccctgggcattacaggcctccaaaccggggacgaagcggattactattgtggaacgtgggacaattccctgagcaccggcggggtgtttggaacaggcaccaaagtcacagtgctt

SEQ ID NO: 39736 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacaatcagctgcacggggttcacctccaacattggactcaattacgtgtcttggtatcaacaggtgcccggcacaacccctaagctggtcatctttgagaacgaccggcgcttccttgggattcccgatagatttagcggatccaaatctggcgccagcgcgacactggggatcaccggactccagacaggcgacgaagctgattactattgtggcacctgggactccagcctgtctgccgggggagtgttcggcacggggaccaaggttacagtgctt

SEQ ID NO: 39737 - RNA, 333 nt, synthetic construct
  misc_feature 1..333: note = derived and/or modified sequence opt5 from anti-HIV-1_LightChain
  source 1..333: mol_type = other RNA
cagagcgtgctggcccaacccccttccgtctctgctgccccgggccagaaggttaccatcagctgctccgggagaacatctaacattggaaataactacgtgagctggtatcagcagctccccggcacggcgcctaaactgcttatctacgagaataacaagcggccctccgggattcctgaccgcttctctggaagcaaatccggcaccagcgctacactggggatcaccggactccaaacaggcgatgaagccgactattactgtggcacctgggatacatctctgtccgccgggggagtgtttggcaccgggacgaaggtcaccgtgctt

SEQ ID NO: 39738 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccacatccgtctctgccgctcctggcagatgggttacggtgagctgctccgggacccggtctaacatcggagaccacagcgtgtcctggttccagcatctcccgggcgccgcgcccaagctgcttatttacgagaataacaaacgcccttctgggatccccgatagatttagcggatccaagagcggcacatctgctaccctggggattacaggactccagaccggcgacgaagccgattattactgtggcacatgggactccagcctgtctaccgggggagtcttcggcacggggaccaaagtgacagttctt

SEQ ID NO: 39739 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggagacaattacgtgtcttggtatcagcagttccccggcacggcccctaaactcctgatcagcgagaacaataagagaccctccgggattcctgatcggtttagcggatctaaatccggcaccagcgcgacacttgggatcaccggactgcaaacaggcgacgaagctgattactattgtggcacctgggactcttccctcagcgccgggggagtgttcggcacagggaccaaggtcacggtgctg

SEQ ID NO: 39740 - RNA, 333 nt, synthetic construct
  misc_feature 1..333: note = derived and/or modified sequence opt5 from anti-HIV-1_LightChain
  source 1..333: mol_type = other RNA
caggccctgctcacccaaccccctagcgtgtccgctgccccgggccagaaggtcacaatctcttgcagcgggtcctctagcaacattggaaataactacgtttcctggtatcagcagctgcccggcacggcgcctaaacttctgatctctgagaataacaagagacccagcgggattcctgaccggttctccggaagcaaatctggcacctccgctacactcgggatcaccggactgcaaacaggcgatgaagccgactactattgtggcacctgggatacaagcctttctgccgggggagtgtttggcaccgggacgaaggtgaccgtcctg

SEQ ID NO: 39741 - RNA, 333 nt, synthetic construct
  misc_feature 1..333: note = derived and/or modified sequence opt5 from anti-HIV-1_LightChain
  source 1..333: mol_type = other RNA
cagctggtgctcacccaaccccctagcgcctccggcacaccggggcagagagtcacgatctcttgcagcggatccacctctaacattggcacatactatgtttactggtatcagctgcttcccgggaccacacctaaggtgctgatctacgctaatgaccagcggcccagcggcattcctgatcgcttctccggatctaaaagcgggacctccgccacactcggaatcaccggcctgcaaacgggcgacgaggcggattattactgtgggacctgggacagctctctttccacaggaggcgtgtttgggaccggaacaaaggtcaccgtgctg

SEQ ID NO: 39742 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggacgtctagcaacattggaaataacttcgtgtcctggtaccagagactccccggcaccgcccctaaactgcttatctttgagaatgacaagcggccctctgggattcctgatcgcttcagcggatccaaaagcggcacatctgcgaccctggggatcacaggactccagaccggcgacgaagctgattattactgtggcacatgggacagatccctgagcgccgggggagtgtttggcaccgggacgaaggtcaccgtgctt

SEQ ID NO: 39743 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaatccccctctgtcagcgccacacctggccagagagttacgatctcctgctctgggaacaccagcaatattggaaagaacttcgtgtcctggtaccagcagtttccgggcacagctcccaaactcctgatctatgacaatgataagcggccttctgggattcccgaccgcttcagcggatccaaaagcggcacctctgccacacttgggatcaccggactgcaaacaggcgatgaggcggactactattgtggcacctgggattccagcctctctgctgggggagtgtttggcacggggaccaaggtcacagtgctg

SEQ ID NO: 39744 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggcagagaggttatcattagctgctccgggtctagctccaacatcggaaataaccacgtgtcttggtaccagcagctccccggcacagcccctaaggtgctgatttatgaaagcaataaacggcattccgggatccccgaccgcttcagcggatctaagtccggcacgagcgcgacccttgctattacagggctgcagaccggagatgaggccgactactattgtggcgcctgggattcttccctcagcgctggcggggtctttggaacaggcaccaaagtgacagttctg

SEQ ID NO: 39745 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagagagtcacgatcagctgctccggatctagctccaacattggcgactctaccgttaattggtaccagcagctccccgggacagctcctaagctgcttatctatgagaacaccaaacggcccagcggcattcctgatcgcttctccggaagcaagtctgggacatccgccaccctgggaatcacaggcctccaaaccggcgacgaagcggattactattgtgggacgtgggacagaagcctgtctgctggaggcgtgtttgggaccggaacaaaagtgaccgtcctt

SEQ ID NO: 39746 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctacgagcaacattggaaataactacgtgtcctggtatcagcagctccccggcaccgcccctaaactgcttatctacgagaataacagacaaccctctgggattcctgaccggttcagcggatccaagagcggcacatctgcgaccctggggatcacaggactccagaccggcgatgaaggcgactattactgtgggacatgggatcgctccctgagcgctggaggcgtgtttgggaccggaacgaaagtcaccgtgctt

SEQ ID NO: 39747 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggatctaattacgtgagctggtatcagcagctccccggcacggcccctaaactgcttatctacgagaacaataagagaccctccgggattcctgaccggttcagcggatctaaatccggcaccagcgcgacactggggatcaccggactccaaacaggcgatgaagctgtgtattactgtggcacctgggactcttccctgacagccgggggagtctttggcagcgggaccaaggtgacggttctt

SEQ ID NO: 39748 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagagttacaatcagctgcattggatcctctagcaacatcggcgctgactaccgggtgcactggtatcagcagctccccgggacggcccctaagctgcttatttacgagaataacaaacgcccctccggaatccctgatagattctctggcagcaagtccgggaccagcgcgacactgggaattaccggcctccaaacaggcgacgaagctgattattactgtgggacctgggactcttccctgagcacaggaggcgtgtttgggaccggaacgaaagtcaccgtgctt

SEQ ID NO: 39749 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagaatcacagttagctgcacgggaacctcctctaacattggcgctccctacgacgtgaattggtatcagcagctccctgggacagcccccaagctgcttatctacgagaacaccaaacggcctagcggcattcccgatcgcttctccggatctaagagcgggacatccgcgaccctgggaatcacaggcctccaaaccggcgacgaagctgattattactgtgggacgtgggacagaagcctgtctgccggaggcgtgtttgggaccggaacaaaagtcaccgtgctt

SEQ ID NO: 39750 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaaccccctgccatgtccgctgccccgggccagtctgtcacaatcagctgctccgggtctgcgttcaacattgagagacaccaggttacgtggctccggcatctgcccggaaccgctcctacaagcgtgatcattatgaataaccagcgcccctccggcgtgcctgacagattttctgggagccggtccggaaccagcgccacacttggcatcaccgggctgcaaacaggagatgaaggcgactactattgtggcacctgggatcgctctctctccgccgggggagtcttcggcacggggaccaaggtgacagttctg

SEQ ID NO: 39751 - RNA, 333 nt, synthetic construct
  misc_feature 1..333: note = derived and/or modified sequence opt5 from anti-HIV-1_LightChain
  source 1..333: mol_type = other RNA
cagagcgtgctggcccaacccccttccgcttctggcaccccggggcagagagtcacaatcagctgctccggatctgccagcaacattggcttcaattccgttacgtggtaccagcagctccccgggaccgcgcctacagtgctgatctatggaaacgaccttcggccctctggcattcctgatcgctttagcgggtccaagagcggaacctctgctacactgggcatcaccggcctccaaacaggggacgagggagattactattgtggcacctgggacagatccctgagcgccgggggagtgttcggcacggggaccaaagtcacagtgctt

SEQ ID NO: 39752 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccgcttccgtgtctggcagccctggggagtccatcacaatttcttgcacgggaaccagaagcgacatcggcaactacgcctatgtctcctggtaccagcagctcccggggacagcgcccaagctgcttatttctgaaaataacaaacggcctagcggaatccccgatcgcttctccggcagcaagtctgggacctccgctacactgggaattaccggcctccagacaggcgacgaggccgattattactgtgggacctgggacagctctctgtccgccggaggcgtttttgggacgggaaccaaagtgacagtgctt

SEQ ID NO: 39753 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccccgcccggccagaaggttacaatcagctgctccgggacgacctctaacattggaagcaattacgtggcttggtatcagcagctccctggcacagcccccaaactgcttatctacgacaacgataagagaccttccgggattcccgaccggttctctggaagcaaatccggcaccagcgcgacactggggatcaccggactccaaacaggcgatgaggctgactattactgtggcacctgggatcgctctctgtccgccgggggagtgtttggcacggggaccaaggtcacagtgctt

SEQ ID NO: 39754 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaatccccctctgtcagcggcacacctgggcagagagttacgatcttctgctccggatctgacagcgatattggcatcaactccgtgtcttggtaccagcagctcccggggaccgcccccaagctgcttatttatgacaataacaaacggcctagcggaatccccgatcgcttttccggcagcaagtctgggacatccgctaccctgggaattacaggcctccaaaccggcgacgaggccgattactattgtgggacatgggacagaagcctgtctgcgggaggcgtgttcgggaccggaacgaaagtcaccgtgctt

SEQ ID NO: 39755 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggaactctagcaatattggaaacaattacgtgtcctggtatcagcacctccccggcacggcccctaaactgcttatctacgagaacaccaagagaccctctgggattcctgaccggttcagcggatccaaaagcggcacatctgcgaccctggggatcacaggactccagaccggcgatgaagctgactattactgtggcacatgggatcgctccctgagcgccgggggagtgtttggcaccgggacgaaggtcaccgtgctt

SEQ ID NO: 39756 - RNA, 333 nt, synthetic construct
  misc_feature 1..333: note = derived and/or modified sequence opt5 from anti-HIV-1_LightChain
  source 1..333: mol_type = other RNA
cagagcctgctcacccaacccccttccgtgtctgccgctccgggccagaaggtcacaatcagctgctccgggggaaactctgacattggcaaaaatttcgttagctggtaccagcagctgcccgggacggcccctaaacttctgatctatgagaacaataagagaccctccggcattcctgatcggttttctggaagcaagtccgggaccagcgcgacactcggaatcaccggcctgcaaacaggcgacgaagctgattactattgtgggacctgggacaactctctttccacaggaggcgtgttcgggaccggaacgaaagtgaccgtcctg

SEQ ID NO: 39757 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttatcattagctgctccgggtctagctccaacatcggcaaaaattacgtggcctggtatcagcagctccccggaacagcgcctaagctgcttgtgtacgagaacacgaatagaccctctgggattcctgaccggttcagcggatccaaaagcggcacctctgctacactggggatcaccggactccaaacaggcgatgaagccgactattactgtggcacctgggattccagcctgtctgccgggggagtctttggcacagggaccaaggtgacggttctt

SEQ ID NO: 39758 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctatgagcgacattggactcaaccccgtgtcctggtacagacagctgcctgaggcgccccctcaccttctgatcttcgataatgacgaacggccctctggcacggccgggcgctttagcgcttccaaaagcggaacctctgccacactcgatattaccggcctgcagacaggggacgaggccgattattactgtggaacctgggactccagcctttctgctggcggcgtgttcgggacaggaaccaaggtcacggtgctg

SEQ ID NO: 39759 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccgcttccgtgtctggcagccctgggcagtccatcacaatttcttgcacgggaaccagctccgacgtcggctcttacaacctcgttagctggtatcagcagtacccggggagagcccccaagctgcttatctatgagaataacaaacggccttccggcattcccgatcgcttcagcggatctaagtccgggacaagcgcgaccctgggaatcacaggcctccaaaccggcgacgaagctgattactattgtgggacatgggacaattctctgtccaccggaggcgtgtttgggacgggaaccaaagtgacagtcctt

SEQ ID NO: 39760 - RNA, 333 nt, synthetic construct
  misc_feature 1..333: note = derived and/or modified sequence opt5 from anti-HIV-1_LightChain
  source 1..333: mol_type = other RNA
cagagcctgctcacccaacccccttccgtgtctgccagcccgggccagaaggtcacaatctcctgctctgggacgagctccaacattggaaataactacgtttcttggtatcagcagttccccggcaccgctcctaaactgcttatctacgagaataacaagagaagctccgggattcccgaccggtttagcggatctaaatccgatacaagcgccaccctgggcatcacagggctccaaaccggagacgaagcggattattactgtggcacatgggaccgctctctgtccgctggcggggtgttcggaaccggcacgaaggtgaccgtcctt

SEQ ID NO: 39761 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagagttacaatcagctgcacgggacggcgctccaacattggcgctgggtacgacgtgcactggtatcagcagctccccggaaccgcccctaagctgcttatctacgagaataacaaaagaccctctggcattcctgatcggttcagcgggtccaagtctggaacaagcgcgaccctgggcatcacaggcctccaaaccggggacgaagctgattattactgtggaacatgggacacctccctgagcgccggcggggtgtttggaacgggcaccaaagtcacagtgctt

SEQ ID NO: 39762 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacaatcagctgctccgggtctagctccaacattggaaataacttcgtgtcttggtaccagtttttccccggcacggcccctaagctcgtgatctatgagaatgacaaacggcccagcgggacccctgatcgcttttccggaagcaagtctggcacatccgcgaccctggctattatcgggcttcagacaggagacgaaggcgattactattgtggcacctgggacaacagcctgtctacagggggagtcttcggcaccgggacgaaagtgaccgttctc

SEQ ID NO: 39763 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacaatcagctgctccgggggatctagcaacattggcaataaccacgtgtcctggtaccagcagctccccgggacggcccctaagctgcttatctctgagaataacaaacggcccagcggcattcctgaccgcttctccggaagcaagtctgggacctccgcgacactgggaatcaccggcctccaaacaggcgatgaagctgactattactgtgggacctgggatagctctctgtccgccggaggcgtgtttgggacaggaaccaaagtcacggtgctt

SEQ ID NO: 39764 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggaagagacttcgtgtcttggtaccaacaggtgcccggcacggcccctaaactcctgatctatgataatgacaagcggcccagcgggattcctgatcgcttttccggaagcaaatctggcacctccgcgacacttgggatcaccggactgcagacaggcgacgaggctgattactattgtggcacctgggacagctctctctccgccgggggagtcttcggcacagggaccaaggtgacggttctg

SEQ ID NO: 39765 - RNA, 336 nt, synthetic construct
  misc_feature 1..336: note = derived and/or modified sequence opt5 from anti-HIV-1_LightChain
  source 1..336: mol_type = other RNA
cagaccgtggtcacacaaccccctagcgtttccggcgccccggggcagacggctaccatctcttgcacaggaagctcctctaacattggcgccgactacgatgtgcactggtatcagcagctgcccgggaccgcgcctaagctcctgatctacgacaataacaaaagacccagcggcattcctgatcggttctccggatctaagagcgggacatccgctacccttggaatcacaggcctgcaaaccggcgacgaggccgattattactgtgggacgtgggaccgcagcctctctgccggaggcgtgtttgggaccggaacaaaagtcaccgtgctg

SEQ ID NO: 39766 - RNA, 333 nt, synthetic construct
  misc_feature 1..333: note = derived and/or modified sequence opt5 from anti-HIV-1_LightChain
  source 1..333: mol_type = other RNA
aacttcatgctgacccagccccctagcgcctccggcacaccggggcaaagagtgacgatctcttgcagcggatcctctagcaatattggctccaactacgtctattggtaccagcagctccccgggaccacacctaagctgcttatctatcggaataaccagcgcccctctggcattcctgacagatttagcggatccaaaagcgggacctctgctacactgggaatcaccggcctccaaacaggcgatgaggccgactactattgtgggacctgggattccagcctgtctgcgggaggcgttttcgggacgggaaccaaggtgacagtgctt

SEQ ID NO: 39767 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagccccaacattggaaataacttcctctcctggtaccagcagctgcctggcacggcccccaaacttctgatctatgagaataccaagagaccttctgggattcccgaccggtttagcggatccaaaagcggcacatctgcgaccctcgggatcacaggactgcaaaccggcgatgaagctgactactattgtggcacatgggatcgctcccttagcgccgggggagtgttcggcaccgggacgaaggtgaccgtcctg

SEQ ID NO: 39768 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaatccccctctgtcagcgccgctcctggccagaaggttacaatctcctgctctgggagctcctctgacattggaaacaatttcgtgagctggtaccagcagctcccgggcacggcccccaaactgcttatctatgagaacaataagagaccttccgggattcccgatcggtttagcggatctaaatccggcaccagcgcgacactggggatcaccggactccaaacaggcgacgaagctgattactattgtggcacctgggactcttccctgagcgccgggggagtgttcggcacagggaccaaggtcacggtgctt

SEQ ID NO: 39769 - RNA, 333 nt, synthetic construct
  misc_feature 1..333: note = derived and/or modified sequence opt5 from anti-HIV-1_LightChain
  source 1..333: mol_type = other RNA
cagttctttctgacccaaccccctagcctctccgccacaccgggccagagagtgtctatcagctgctccgggggaggctctaacattgctaataacgacgtcttctggtttcagcagttccccggggccggacctcggctgcttatctacgataatctgaagcgccactatggcacgcccgacagatttagcgggtccaaatctggaaccagcgcgacactcggcattaccggcctgcaaacaggggatgaggctgactactattgtggaacctgggataactcccttagcacaggcggggttttcggaaccggcacgaaggtgaccgtgctg

SEQ ID NO: 39770 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctggacccaacattggcagcaattccgtgtcttggtaccagcacttccctgggacggcccccaaactcctgatctatgacaacaataagagacctagcggcattcccgatcggttttccggaagcaaatctgggacctccgcgacacttggaatcaccggcctgcagacaggcgacgaggctgattactattgtgggacctgggaccgcagcctctctgccggaggcgtgttcgggacaggaaccaaggtcacggtgctg

SEQ ID NO: 39771 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaatccccctctgccagcggcacacctgggcagagagtcacgatctcctgctctggaagctcctctaacattggcagcaataccgtttcctggttccagcacctcccggggacagctcccaagctgcttatctacgagaacaataaacggcctagcggcattcccgaccgcttttctggatccaagagcgggacctctgccacactgggaatcaccggcctccagacaggcgatgaagcggactattactgtgggacctggcattccagcctgtctgctggaggcgtgttcgggacgggaaccaaagtgacagtcctt

SEQ ID NO: 39772 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctggcgccccggggcagaacgttatcattagctgctccggatctagctccaatatcggcaagaactacgtggcttggtatcagcagctccccgggacagcccctaaaattgtgatctacgagacgaccaatagaccctctggcattcctgcgcggttcagcggatccaagagcgggacatctgctaccctgggaatcacaggccttcaagccggcgacgaagccgattattactgtgggacctgggactccagcctgaacgctggaggcgtctttgggacaggaaccaaagtgacggttctc

SEQ ID NO: 39773 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggaaataacttcctctcttggtaccagcatctgcccggcacggcccctagacttctgatctatgacaatgatcagcggcccagcgggattcctgaccgcttttccggaagcaaatctggcacctccgcgacactcgggatcaccggactgcaaacaggcgatgaggctgactactattgtggcacctggcacagctctctttccgccgggggagtgttcggcacagggaccaaggtgacggtcctg

SEQ ID NO: 39774 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagaaggtcacgatcagctgctccggatctagctccaacattggcaataactacgtttcttggtatcagcagctccccgggaccgctcctaaactgcttatctacgagaataacaagagacccagcggcattcctgaccggttctccggaagcaaatctgggacatccgccaccctgggaatcacaggcctccaaaccggcgatgaagcggactattactgtgggacatgggatagctctctgtccaccggaggcgtgtttgggacgggaaccaaggtgacagtcctt

SEQ ID NO: 39775 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggacgacctctaacattggaaatcactacgtgagctggtatcagcagttccccggcacagcccctaaactcatcatttacgagaccgacagacggccctccgggatccctgcgcgcttttctggaagcaagtccggcacaagcgctaccctggccattgccgggcttcaaacaggagatgaagctgactattactgtggcacctgggattcttccctgagcacgggcggggtgttcggaaccggcacaaaagtcaccgtgctc

SEQ ID NO: 39776 - RNA, 333 nt, synthetic construct
  misc_feature 1..333: note = derived and/or modified sequence opt5 from anti-HIV-1_LightChain
  source 1..333: mol_type = other RNA
cagctggtgctcacccaaccccctagcgtctccgccgctccgggccagaaggttacaatctcttgcagcgggtcctctagcaacattggaaataactacgtgtcctggtatcagcagctgcccggcacggcccctaaacttctgatctacgagaataacaagagaccctctgggattcctgaccggttcagcggatccaaaagcggcacctctgcgacactcgggatcaccggactgcaaacaggcgatgaagctgactattactgtggcacctgggattccagcctttctacagggggagtgtttggcaccgggacgaaggtcaccgtgctg

SEQ ID NO: 39777 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacaatcagctgctccgggggatctagcaacattggcaataaccacgtgtcctggtaccagcatctccccgggcgggcccctcagctgcttatctatgacacgacccaacgcccctctcggattcctgatagattcagcggatccaagagcggcacatctgcgaccctggggatcacaggactccagaccggcgacgaggctgattactattgtggcacatgggacaattccctgagcaccgggggagtgtttggcacggggaccaaagtcacagtgctt

SEQ ID NO: 39778 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaagatcacaattagctgctccgggtctagaagcaacatcggaaataactacgtttcctggtatcagcagttccccggcacggcccctaaactcctgatttacgacaataaccaacggccctctcgcatccctgatagatttagcgggtccaagagcggaacctctgcgacacttggcattaccgggctgcagacaggagacgaggctgattattactgtggcacctgggactccagcctctctgccggcggggtgttcggaacaggcaccaaagtgacggtcctg

SEQ ID NO: 39779 - RNA, 321 nt, synthetic construct
  misc_feature 1..321: note = derived and/or modified sequence opt5 from anti-HIV-1_LightChain
  source 1..321: mol_type = other RNA
cagagcgtgctgacccaacccccttccgtctctgccgctccgggccagagagttacaatcagctgcttcgggtcccggttttctagcgtgtcctggtaccagcagctccccggaacggcccctaagctgcttatttatcccaacggcgagcgcccttctgggatccccgacagattctttggaagcgaatccggcaccagcgcgacactggggattaccggactccaaacaggcgatgaggctgactactattgtgccacctgggattcttccctgagcgccggcggggtgttcggaacaggcaccaaacttacggtcctg

SEQ ID NO: 39780 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccctctctgccgctccgggccagaaggtcacaatcagctgctccgggtctagcctgaacattggaaatcactacgtttcctggtatcaacaggtgcccggcacggcccctaaacttctgatctacgaggacaacaagagaccctctgggattcctgatcggttcagcggatccaaaagcggcacctctgcgacactcgggatcaccggactgcagacaggcgacgaagctgattattactgtggcacctggcattccagcctttctgccgggggagtgtttggcacagggaccaaggtcacggtgctg

SEQ ID NO: 39781 - RNA, 333 nt, synthetic construct
  misc_feature 1..333: note = derived and/or modified sequence opt5 from anti-HIV-1_LightChain
  source 1..333: mol_type = other RNA
cagttcgtgctgacccaaccccctagcgtctccgccgctccgggccagaaggttacagtgtcttgcagcgggacgacctccgacatcggagagaactacgtgtcttggtatcagaaatttcccgaagccgcgcctaagctcctgatttacgataatgacaaaagacccagcggcatccctgatcggttctccgggtctaagagcggaacatccgctacccttggcattacagggctgcagaccggagacgaggccgattattactgtggcacatgggaccgcagcctctctgccggcggggtctttggaaccggcacgaaagtgaccgttctg

SEQ ID NO: 39782 - RNA, 333 nt, synthetic construct
  misc_feature 1..333: note = derived and/or modified sequence opt5 from anti-HIV-1_LightChain
  source 1..333: mol_type = other RNA
ctgagcgtgctcacccagcccccttccgtctctgccgctccgggccaacaggttacaatcagctgctccgggacgacctctaacattggaacaaattacgtgagctggtatcagcagatgccccctaccgcccccaagctgcttatctacgagaacaataaaagaccttccggcattcccgaccggttctctgggagcaagtccggaacaagcgcgaccctgggcatcacagggctccaaaccggagatgaagctgactattactgtggcacgtgggattcttccctgagcgccggcggggtgtttggaaccggcacaaaagtcaccgtgctt

SEQ ID NO: 39783 - RNA, 336 nt, synthetic construct
  misc_feature 1..336: note = derived and/or modified sequence opt5 from anti-HIV-1_LightChain
  source 1..336: mol_type = other RNA
cagagcatgctgacccaacccccttccgtgtctggcgccccggggcagagagtcacaatcagctgcacgggatcccggtctaacattggcgctgggtacgacgttcactggtatctccagctgcccggaaccgcccctaaacttctgatctacgagaataacaagcgccccagcggcattcctgatagattctccgggtctaagagcggaacatccgcgaccctcggcatcacaggcctgcagaccggggacgaagctgattattactgtggaacatgggacaatagcctttctaccggcggggtgtttggaacgggcaccaaagtgacagtcctg

SEQ ID NO: 39784 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccacaccgggccagaaggttacgatcagctgctccgggtctagaagcaacattggatcccactacgtgtcttggtatcagcagttccccgagagcgctcctaccctcctgatctacgaaaatgtggagcggccctccggcattcctgaccgctttagcgggtctaaatccggaacaagcgccacccttggcatcacagggctgcaaaccggagatgaagcggactattactgtggcacatgggattcttccctcagcgctggcggggtcttcggaaccggcacgaaggtgaccgttctg

SEQ ID NO: 39785 - RNA, 333 nt, synthetic construct
  misc_feature 1..333: note = derived and/or modified sequence opt5 from anti-HIV-1_LightChain
  source 1..333: mol_type = other RNA
cagttctttctgacccaaccccctagcctctccgccacaccgggccagagagtgtctatcagctgctccgggggaggctctaacattgctaataacgacgtcttctggtttcagcagttccccggggccggacctcggctgcttatctacgataatctgaagcgccactatggcacgcccgacagatttagcgggtccaaatctggagcgaccggcacactcgagattaccgaagttcaaacagctgatgaggccgactactattgtggcacctgggatagctccctgagcgccgggggagtgttcggcacagggaccaaggtgacggtcctt

SEQ ID NO: 39786 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggggatctagcaacattggcgacaattccgtgtcttggtaccagcagctccccgggacggcccctaaactgcttatctatgagaacaataagagacccagcggcattcctgatcggttctccggaagcaaatctgggacctccgcgacactgggaatcaccggcctccaaacaggcgacgaagctgattactattgtgggacctgggacagctctctgtccacaggaggcgtgtttgggaccggaacgaaggtcaccgtgctt

SEQ ID NO: 39787 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagacagttacgatcagctgctccgggtctgccagcaacattggaagaaattccgtgtcttggtaccagtatgtgcccggcgcggctcctaagcggctcatctacgagaacaataaacgccccagcgggattcctgacagattctccggaagcaagtctggcacctccgccacactggggatcaccggacttcagacaggcgatgaagccgactattactgtggcacctgggatacaagcctgtctgctgggggagtctttggcaccgggacgaaagtgaccgttctc

SEQ ID NO: 39788 - RNA, 333 nt, synthetic construct
  misc_feature 1..333: note = derived and/or modified sequence opt5 from anti-HIV-1_LightChain
  source 1..333: mol_type = other RNA
cagagcgtgctggcccaacccccttccgtctctgctgccccgggccagaaggttaccatcagctgctccgggagaacatctaacattggaaattacttcgtgagctggtatcagcagtttcccggcacggcgcctcggctcctgatctacgacaacgatcaacgcccctccgggattcctgacagattctctggaagcaaatccggcaccagcgctacacttgggatcaccggactgcagacaggcgatgaggccgactattactgtggcacctgggattcttccctcagcgccgggggagtgtttggcacagggaccaaggtcacggtgctg

SEQ ID NO: 39789 - RNA, 333 nt, synthetic construct
  misc_feature 1..333: note = derived and/or modified sequence opt5 from anti-HIV-1_LightChain
  source 1..333: mol_type = other RNA
cagagcgccctgacccaacccgcttccgtgtctgccgcgcctggccagaaggtcacaatcagctgctccgggtctagctccaacattggaaatatctacgtttcttggtatcagcagctcccgggcacggctcccaaactgcttatttacgagaacaataagagacctagcgggatccccgaccggttctccggaagcaaatctggcacctccgccacactggggattaccggactccaaacaggcgatgaagccgactattactgtggcacctggcacagctctctgtccgctgggggagtgtttggcacagggaccaaggtgacggtcctt

SEQ ID NO: 39790 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccacaccgggccagagagttacggtgagctgctccgggtctagctccaacatcggaaatcactacgtgtcttggtatcagcaggtccccggcaccgctcctaagctcctgatttacgacaacagcaatcggccctccgggatccctgatcgcttcagcggatctaaatccggcacaagcgccacccttgggattacaggactgcaaaccggcgacgaggcggattattactgtggcacatgggactcttccctcagcgctgggggagtgtttggcaccgggacgaaggttaccgtgctg

SEQ ID NO: 39791 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccctctctgccgctccgggccagagagtcacagttagctgctccgggtctagctccaacatcggagacaattacgtgtcttggtatcagcagctgcccggcgccgcgcctcggcttctgatttacgataacagcatccgcccctccgctattcctgccagattcagcgggtctaagtccggaacgagcgccaccctcgctatcacaggcctgcaaaccggggacgaggccgattattactgtggaacatgggactcttcccttagcgctggcggcgtgtttgggaccggaacaaaagtcaccgtgctg

SEQ ID NO: 39792 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccgcttccgtgtctggcagccctgggcagtccatcacaatttcttgcacgggaaccagctccgacgtcggcgggtacgattatgtttcttggtacctccagctgccgggaacagcccccaaacttctgatctatgagaacaataagagacctagcggcattcccgaccggttctccgggagcaagtctggaacctccgcgacactcggcatcaccggcctgcagacaggggatgaagctgactactattgtggaacctgggatagctctctttccgccggcggggtgtttggaacgggcaccaaagtgacagtcctg

SEQ ID NO: 39793 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacagtgagctgctccgggtctagctccaacatcggaaataactacgtgtcttggtatcagcagttccccggcacggcccctaagctcgtcatttacgacaccgataaacggcccagcgggatccctgaccgcttttccggaagcaagtctggcacatccgcgaccctggggattacaggacttcaaaccggcgatgaggctgactattactgtgccacatgggatagctctctgtccgccggcggggtgttcggaaccggcacgaaagttaccgtgctc

SEQ ID NO: 39794 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagagttacaatcagctgcacgggaaactcctctaatattggcgctgggtacgacgtgcactggtatcagcagctccccggaaccgcccctaagctgcttatcagcgagaacaataaacggccctccggcattcctgatcgcttctctgggagcaagtccggaacaagcgcgaccctgggcatcacaggcctccaaaccggggacgaagctgattactattgtggaacatgggactcttccctgagcgccggcggggtgtttggaaccggcacgaaagtcaccgtgctt

SEQ ID NO: 39795 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctggcacaccggggcagagagtcacgatcagctgctccggatctagctccaacattggctctaattacgttgactggtatcagcagctccccgggaccgctcctaagctgcttatctacgagaacaataaacggcccagcggcattcctgatcgcttctccggaagcaagtctgggacatccgccaccctgggaatcacaggcctccaaaccggcgacgaagcggattattactgtgggacatggcacagctctctgtccgctggaggcgtgtttgggaccggaacgaaagtgaccgtcctt

SEQ ID NO: 39796 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccacaccgggccagacggttaccatcagctgctccgggtctagctccaacattggaaataactacctctcttggtatagacagctgccccggacagctcctaaacttctgatctacgagaataaccgcagacccagcggcgtgcctgcccggttctccgggagcaagtctggaacctccgcgacactcgctattaccggcctgcagacaggggacgaagccgattattactgtggaacctgggacagctctctttccgccggcggcgtgtttgggacgggaaccaaggtcacagtgctg

SEQ ID NO: 39797 - RNA, 321 nt, synthetic construct
  misc_feature 1..321: note = derived and/or modified sequence opt5 from anti-HIV-1_LightChain
  source 1..321: mol_type = other RNA
cagagcgtgctgacccaacccccttccgtctctgccgctccgggccagagagttacaatcagctgcttcgggtcccggttttctagcgtgtcctggtaccagcagctccccggaacggcccctaagctgcttatttatcccaacggcgagcgcccttctgggatccccgacagattctttggaagcgaatccggcaccagcgcgacactggggattaccgctgtgcaaacaggagatgaggccgactactattgtggcacctgggatgactctctctccacaggcggggtcttcggaaccggcacgaaagtgaccgttctg

SEQ ID NO: 39798 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacactcagctgctccgggacgtctagcaacatcggaaataactacgtgtcctggtatcaacaggtgcccggcgccgcgcctaaagtcctgatttacgagaatgacaagagaccctctgggatccctgatcggttcagcggatccaaaagcggcacctctgctacacttgggattaccggactgcagacaggcgacgaagccgattattactgtggcacctgggaccgctccctcagcgccgggggagtgtttggcacagggaccaaggttacggtgctg

SEQ ID NO: 39799 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctaacagcaatattggaaacaattacgtgtcctggtatcagcagctccccggcacggccaccaaactgcttatctacgagaacgacaagagaccttctgggattcccgatcggttcagcggatccaaaagcggcacatctgcgaccctggggatcacaggactccaaaccggcgacgaagctgattattactgtggcacatggcactccagcctgtctgccgggggagtgtttggcaccgggacgaaggtcaccgtgctt

SEQ ID NO: 39800 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccctctctgccgctccgggccagcaggtcagcatctcctgcctggggagatctagcaacattggaacaaattacgtttcctggtatcagcaattccccggcacggcccctaaacttctgatctacgagaacaagaagcggccctctgaaattcctgaccgctttagcgggtccaaaagcggaacctctgcgacactcggcatcaccgggctgcagcccggagatgaggctgactattactgtggcacatgggattccagcctttctgccggcggggtgttcggaaccggcacaaaggtgaccgtcctg

SEQ ID NO: 39801 - RNA, 336 nt, synthetic construct
  misc_feature 1..336: note = derived and/or modified sequence opt5 from anti-HIV-1_LightChain
  source 1..336: mol_type = other RNA
cagagcgccctgacccaacccccttccgcttctggcagcccggggcagtccgtgacaatctcttgcacgggaaccagctccgacgtcggcgcctacaactctgttagctggtatcagcagctccccgggacagcgcctaagctgcttatttccgagaataacaaaagacccagcggaatccctgatcggttctctggctccaagagcgggacctctgctacactgggaattaccggcctccaaacaggcgacgaagccgattactattgtgggacctgggactccagcctgtctgccggaggcgtgtttgggacgggaaccaaagtgacagtcctt

SEQ ID NO: 39802 - RNA, 333 nt, synthetic construct
  misc_feature 1..333: note = derived and/or modified sequence opt5 from anti-HIV-1_LightChain
  source 1..333: mol_type = other RNA
cagagcgccctgacccaacccccttccgcttctggcagcccggggcagtccgtgacaatctcttgcagcggaggctcctctaacattgggaataaccacgtcagctggtaccagcatctccccggcagagcccctcagctgcttatctatgacacgacccaacggccctcccgcattcctgatagattcagcggatctcggtccgggacaagcgcgaccctggctatcacaggactccagaccggcgacgaggccgtttactattgtggcacatgggataattctctgtccaccgggggagtgtttggcacggggaccaaggtgacagtcctt

SEQ ID NO: 39803 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacaatcagctgctccgggggaacgtctaacattggcaatgagtacgtgagctggtatcagcagctccccgggaccgcccctaagctgcttatctacgaaaacaataaacggccctccggcattcctgaccgcttctctggaagcaagtccgggacaagcgcgaccctgggaatcacaggcctccaaaccggcgatgaggctgactattactgtgggacatgggattcttccctgagcgccggaggcgtgtttgggaccggaacgaaagtcaccgtgctt

SEQ ID NO: 39804 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagagagttacagtgagctgctccgggtctagctccaacatcggaaataactacgtgtcttggtatcagcagctccccggcgccgcgcctaagctgcttatttacgacacggataaacggcccagcgggatccctgaccgcttctccggaagcaagtctggcacctccgctacactggggattaccggactccaaacaggcgatgaggccgactattactgtggcacctgggatagaagcctgtctgccgggggagtctttggcacagggaccaaagtgacggttctt

SEQ ID NO: 39805 - RNA, 333 nt, synthetic construct
  misc_feature 1..333: note = derived and/or modified sequence opt5 from anti-HIV-1_LightChain
  source 1..333: mol_type = other RNA
cagagcctgctcacccaacccccttccgtgtctgccgctccgggccagaaggtcacaatcagctgctccgggggaaactctgacattggcaaaaatttcgttagctggtaccagcagtcccccggggccgcgcctagactgcttatctatgagaacgatcggcgcccctctggcattcctgacagatttagcggatccaagagcgggacgtctgctaccctgggaatcacaggcctccaaaccggcgatgaagccgactactattgtgggacatgggatcggtccctgagcgccggaggcgtgttcgggaccggaacaaaagtgaccgtcctt

SEQ ID NO: 39806 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttaacatcagctgctccgggtctagctccaatattggcaaaaactacgtgtcttggtatcagcagatccccggaacagcccctaaggtgctcatttacgagaataacaaaagacccagcgggatccctgaccggttctccggaagcaagtctggcacgtccgcgaccctggggattgctggacttcaaacaggcgatgaagccgactattactgtgccacctgggatagctctctgtccgctggcggggtctttggaacaggcaccaaagtgacagttctc

SEQ ID NO: 39807 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggaaatagacacgtgtcttggtaccagcagctccccggcacggtgcctaaactgcttatctatgagaccaacaagcggcccagcgggattcctgaccgcttctccggaagcaaatctggcacatccgccaccctggggatcacaggactccaaaccggcgatgaagcggactactattgtggcacatgggataatagcctgtctaccgggggagtctttggcacggggaccaaggtgacagttctt

SEQ ID NO: 39808 - RNA, 336 nt, synthetic construct
  misc_feature 1..336: note = derived and/or modified sequence opt5 from anti-HIV-1_LightChain
  source 1..336: mol_type = other RNA
cagagcgtgctgacccaacccccttccgtctctggcgccccggggcagagagttacaatcagctgcacgggatcctctagcaacattggcgctgggtacgacgtgcactggtatcagcagctccccggaaccgcccctaagctgcttatcttcggccatgataaacggccctccgggattcctgaccgcttttctggaagcaagtccggcacaagcgcgaccctgggcatcacagggctccaaaccggagatgaggctgactactattgtggcacatgggattcttccctgagcgccgggggagtgttcggcaccgggacgaaagtcaccgtgctt

SEQ ID NO: 39809 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaactcccctccgcctctggcctgcctgggcagacagtcacgatcagctgctccggatctaccagctccattggctctaaccacgtttactggtatcaacaggtggctgggacagccccgaaacttctgatctacgagaataacaagagacccagcggcattcctgaccggttctccggaagcaagtctgggacctccgcgacactcggaatcaccggcctgcagacaggcgatgaagctgactattactgtgccacctgggatagctctctttccgccgggggagtgtttggcacggggaccaaagtcacagtgctg

SEQ ID NO: 39810 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaaacaccctccgcctctggcgctcctgggcagggagtcacgatcagctgctccggctctagctccaacgttgggagaaattacgtgtcttggtatcagcagctcccgggaaccgcccccaagctgcttatttacgagaacacaaaacggcctagcggcatccccgaccgcttctccgggagcaagtctggaacctccgcgacactgggcattaccggcctccaaacaggggatgaagctgactattactgtggaacctgggatagaagcctgtctgccggcggggtgtttggaacgggcaccaaagtcacagtgctt

SEQ ID NO: 39811 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagttccccggcacggcccctaaactcctgatcagcgacaataacaagagaccctccgggattcctgatcggtttagcgtgtctaaatccggaaccagcgcgacacttggcatcaccgggctgcaagctggagacgaggccgattactattgtggcacatgggactcttccctcagcgccggcggggtcttcggaaccggcacaaaggtgaccgttctg

SEQ ID NO: 39812 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctaacagcaatattggaaacaattacgtgacgtggtatcagcagttccccggcaccgcccctaaagtgctcatctacgacaactccagacggccctctgggattcctgatcgctttagcggatccaagagcggcacatctgcgaccctggggatcacaggacttcaaaccggcgacgaggctgattattactgtggcacatgggactccagcctgtctgccgggggagtcttcggcaccgggacgaaagtgaccgttctc

SEQ ID NO: 39813 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctggcgccccggggcagagagttacaatcagctgctccggatctagctccaacattggcaataactacgtgtcttggtatcagcagctccccgggacggctcctaagctgcttatctacgagaataccaaacggcccagcggcattcctgaccgcttctccggaagcaagtctgggacatccgccaccctgggaatcacaggcctccaaaccggcgatgaagcggactattactgtgggacatgggatagaagcctgtctgctggaggcgtgtttgggaccggaacgaaagtcaccgtgctt

SEQ ID NO: 39814 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagacagttacgatcagctgctccgggtctaccagcaacattggacagaatttcctctcctggtttcagcacgtgcccggcacagcccctaagctgcttatctacgagaacaataaaagaccctctgggattcctgaccggttcagcggatccaagagcggcacctctgcgacactggggatcaccggactccaaacaggcgatgaagctgactattactgtggcacctggcattccagcctgtctgccgggggagtgtttggcacggggaccaaagtcacagtgctt

SEQ ID NO: 39815 - RNA, 333 nt, synthetic construct
  misc_feature 1..333: note = derived and/or modified sequence opt5 from anti-HIV-1_LightChain
  source 1..333: mol_type = other RNA
aacttcatgctgacccagccccctagcgcctccggcacaccggggcaaagagtgacgatctcttgcagcggatcctctagcaatattggctccaagtacgtctcttggtatcagcagctccccgggaccgctcctaaactgcttatctacgagaacacaaagcggcccagcggcattcctgaccgcttttccggaagcaaatctgggacctccgccacactgggaatcaccggcctccagacaggcgatgaagcggactattactgtgggacctgggatagaagcctgtctgctggaggcgttttcgggacgggaaccaaggtgacagtgctt

SEQ ID NO: 39816 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggaaataactacgtgtcttggtatcagctcctgcccggcacggcccctaaacttctgatctacgagaataacaagagacccagcgggattcctgaccggttctccggaagcaaatctggcacctccgcgacactcgggatcaccggactgcagacaggcgatgaagctgactattactgtggcacctgggataatagcctttctacagggggagtgtttggcaccgggacgaaggtcaccgtgctg

SEQ ID NO: 39817 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgtctctgccgctccgggccagaaggttacaatcagctgctccgggtctagctccaacattggaaataactacgtgtcttggtatcagcagctccccggcacggcccctaaaatcattatctacgacaataacaagagacccagcgggattcctgatcggttctccggaagcaaatctggcacctccgcgacactggggatcaccggacttcaaacaggcgacgaggctgattattactgtggcacctggcacagctctctgtccgccgggggagtgtttggcacagggaccaaggtcacggtgctc

SEQ ID NO: 39818 - RNA, 333 nt, synthetic construct
  misc_feature 1..333: note = derived and/or modified sequence opt5 from anti-HIV-1_LightChain
  source 1..333: mol_type = other RNA
cagagcgtgctgacccaacccccttccgcctctgctacaccgggccagagagtcacgatcagctgctccgggtctagctccaacattggatctaagcacgtttactggtatcagaaactccccggcaccgcccctaagctgcttatctacgagaatacaaaacggcccagcgggattcctgaccgcttctccggaagcaagtctggcacctccgcgacactggggatcaccggactccagacaggcgatgaagctgactattactgtggcacctgggatagaagcctgtctgccgggggagtgtttggcacggggaccaaagtgacagtcctt

SEQ ID NO: 39819 - RNA, 432 nt, synthetic construct
  misc_feature 1..432: note = derived and/or modified sequence opt5 from anti-HIV-1_HeavyChain
  source 1..432: mol_type = other RNA
caggcccaactggtggagagcggcgggggagtcgttcagcccggcagatccctccggctgtcttgcgctgccagcgggttcaccttttcctcttacggaatccactgggtgcgccaggcgcctggcaaggggcttgaatgggtggctgtcatgagctccgacggaacatataaatactatggcgattctatgaagggcagattcacgattagccgggacaactccaaaaatagcctgtacctccagatgaactctctgcgcgccgtggataccgccgtttattactgtgctaaggaccttggggagggagaaaatgaggaatgggccacagattattacgacttttccatcggctacccggggcaagatcccagaggagtggtcggcaccttcgacatttgggggcagggaacaatggtgaccgttagctct

SEQ ID NO: 39820 - RNA, 426 nt, synthetic construct
  misc_feature 1..426: note = derived and/or modified sequence opt5 from anti-HIV-1_HeavyChain
  source 1..426: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatcagcgacgatggatccaacaaatattacgctgactctgttaagggcagattcacaattagccgggataattccaaaaacacgctgtatctccagatgaatagcctgcgcgccgaggacaccgccgtgtactattgtgctaaggatcttggcgaatctgagaacgaagagtgggcctccgactactatgattttgggagcgactacccgggacaagatcccagagctgtcgtgggcgccttctgggggcagggaacaatggttaccgtgtcttcc

SEQ ID NO: 39821 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagtccggcagatctctccggctgagctgcgccgcttccgggttcaccttttctgcctacgcgcttcactgggtgcgccaggctcccggaaagggcctggaatgggtcgccgtgatcagctatgacgggagagataaagactacgccgattccgttaagggacggttcacaatttctcgcgacaacagcaaaaatacgctctatctgcagatgaactcccttagagctgaggataccgccgtgtactattgtgctaaggacctgggcgaaagcgagaatgaagagtgggcctctgattactatgactttggctccgattaccctgggcaagacccgcgggcggtcgtgggagccttcgatatctggggccaggggacaatggttaccgtgagctct

SEQ ID NO: 39822 - RNA, 432 nt, synthetic construct
  misc_feature 1..432: note = derived and/or modified sequence opt5 from anti-HIV-1_HeavyChain
  source 1..432: mol_type = other RNA
caggtgcaactggtccagagcggcgggggactcgttcagcccggcagatccctgcggctttcttgcgtggccagcgggttccgcttttccttccacggaatgcattgggtgagacaggctcctggcaaggggctggagtgggtcgccgtggtttctgacgatggaagcgaccaaaaatacgtggattccgtcaagggccggctcaccatctctcgcgacaacagcaaaaatacagtgtatctgcagatgaactcccttagagcggaagatacggctgtttactattgtgccaaggacctgggcgagagcgaaaatgaggaatgggcctctgattactatgactttgggtccgattacccgggacaggacccccgggctgtggtcggcgccttcgatatttgggggcagggaaccatggtgacagtgagctct

SEQ ID NO: 39823 - RNA, 432 nt, synthetic construct
  misc_feature 1..432: note = derived and/or modified sequence opt5 from anti-HIV-1_HeavyChain
  source 1..432: mol_type = other RNA
gaggtgcacctggtcgaaagcggcgggggagttgtgcagcccggcagatccctccggctgtcttgcgccgctagcgggttcacctttaactcctacgccatgatctgggtgcgccaagcgcctggaaagggccttgagtgggtcgctgtgatttcttatgacgggaataacaaatactatgccgatagcgttaagggaagattcacaatctcccgggaaaattctaaaaacacgctgtacctccagatgaatagcctgcgcgccgaggacaccgctgtgtatcattgtgccaaggatcttggcgaatccgagaacgaggaatgggctagcgactactatgattttggcagagactacccggggcaggatccccggggagtcgtgggcacattcgacatttgggggcacggaaccatggttacagtgtcttcc

SEQ ID NO: 39824 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcggcccggcgggtccctccggctgtcttgcaccgccagcggattccactttaacaagtacggcatgaattgggtgcgccaggctcctgggaaaggacttgccctggtcgcgttcatccagtccggcgcttcttataactactatgccgacagcgtgaagggcagatttacaatttcccgggataattctaaaaacacgctctacctgcagatgaatagccttcgcgccgaagacaccgctgtttattactgtgccaaggatctgggggactccgagaacgaagagtgggctagcgattattacgacttcggaagagattacccgggccaagaccccagaggggtggtcggagcctttgatatctggggccatgggacaatggtgaccgtttcttcc

SEQ ID NO: 39825 - RNA, 432 nt, synthetic construct
  misc_feature 1..432: note = derived and/or modified sequence opt5 from anti-HIV-1_HeavyChain
  source 1..432: mol_type = other RNA
caggtgcacctggtcgagagcggcgggggagttgtgcaacccggcaagtccctcaccatctactgcgccgtgtctgagttcacactgagcaactatgctatgcattgggtcagacttacgcctgggaaaggactgcagtgggtggccgttatttcctacgacggctctaataagtattacgcggatagcgtgaaagggcggtttaccatctcccgcgacaactctaagaatacactctatctgcagatgaacagccttagagctgaagataccgccgtctactattgtgccaaagacctgggagaatccgagaatgaagagtgggctagcgattactacgacttcggccgggattatccgggccaggacccccgcggggtggttggagtgtttgatatttggggccaagggacaatggtcaccgtgtcttcc

SEQ ID NO: 39826 - RNA, 432 nt, synthetic construct
  misc_feature 1..432: note = derived and/or modified sequence opt5 from anti-HIV-1_HeavyChain
  source 1..432: mol_type = other RNA
gaggtgcagctgctcgaaagcggcgggggagtcgttcaacccggcagatccctgcggctttcttgcgccgctagcgggttcaccttttccacatacgccctgcactgggtgcgccaggcgcctggaaagggcctcgagtgggtggctgtcatctcttatgacgggagcacgaaattctacgccgattccgtgaagggaagatttaccatttctcgggacaacagcaaaaatacactgtatcttcagatgaactccctgcgcgccgaagataccgctgtttactattgtgccaaggacctcggcgagagcgaaaatgaggagtgggcttctgattactatgacttcggctccgattacccggggcaggaccccagagccgtggtcggagcgtttgatatctggggccaagggacaatggtgaccgttagctct

SEQ ID NO: 39827 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcgggtccctccggctgtcttgcgccgctagcggattcaccttttcctcttacggcatgcactgggtgcggcaggcccctgggaagggacttgaatgggtcgcgttcatccgctatgacggcagcaataaatactatgctgattccgtgaagggcagatttacaatttctcgggagaatagcaaaaacacgctgtacctccagatgaactccctgcgcgccgaagacaccgccgtttatcattgtgctaaggatcttggggagagcgaaatcgaggagtggacatctgactactatgatttcggaagagactacccgggccaagatcccagaggggtgtttggaaccttcgacatttggggccacgggacaatggtcaccgtgtccagc

SEQ ID NO: 39828 - RNA, 432 nt, synthetic construct
  misc_feature 1..432: note = derived and/or modified sequence opt5 from anti-HIV-1_HeavyChain
  source 1..432: mol_type = other RNA
gaggtgcagctggtcgaaagcggcgggggagttgtgaagcccggcgggtccctcagactgtcttgcgtggtcagcggattcaccttttccaacgcctggatgtcttgggtgcggcaagctcctggcaaagggcttgagtgggttgccgtgatcagcgacgatggatccaataagtactatgcggactctgtcaaaggccgcttcacaattagcagagataactccaagaatacgctgtacctccagatgaacagcctgcgggctgaagacaccgccgtgtattactgtgccaaagatcttggcgagtctgaaaatgaggagtgggcttccgactattacgattttgggagcgactatccgggacaggatccccgcgccgttgtgggcgctttcgacatctgggggcagggaacaatggtcaccgtgtcttcc

SEQ ID NO: 39829 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcgggtccctccggctgtcttgcgccgctagcggattcaccttttccacatacggcatgcactgggtgcggcaggcccctgggaagggacttgaatgggtcgcgttcatccgctatgacggcagaaacaaaaattacgctgattctgtgaagggccggtttacgattagccgcgacaactccaaaaataccctgtatctccagatgaactctctgagagccgaggatacagccgtttactattgtgctaaggaccttggggaaagcgagaatgaagagtgggccaccgattactatgacttctccatcggatacccgggccaagatcccagaggggtggtcggaatttttgacatctggggccaggggacaatggtgaccgttagctct

SEQ ID NO: 39830 - RNA, 432 nt, synthetic construct
  misc_feature 1..432: note = derived and/or modified sequence opt5 from anti-HIV-1_HeavyChain
  source 1..432: mol_type = other RNA
caggtgcacctggtcgagagcggcgggggagttgtgcaacccggcgggtccctcagactgtcttgcgccgctagcggattctccttttctatctacggcatgcattgggtgcggcaggcccctgggaagggacttgaatgggtcaccttcacacgctatgacggcagcaacaaatactatacggattccgtgaagggcagatttaccatttctcgggacaatagcaaaaacacactgtacctccagatgaactccctgcgcaccgaggatacagcggtttattactgtgctaaggaccttggggaaagcgagaatgaagagtgggcctctgattattacgacttcggatccgattacccgggccaggaccccagagccgtggtcggggcttttgatatctggggacaaggcaccatggtgacagttagctct

SEQ ID NO: 39831 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcgggtccctccggctgtcttgcgccgctagcggattcaccttttcctcttacggcatgcactgggtgcggcaggcccctgggaagggacttgaatgggtcgcgttcatccgctatgacggcagcaacaaatactatgctgatccggtgaagggcagatttacaatttcccgggacaattctaaaaacacgctgtacctccagatgaatagcctgcgcgccgaggataccgccgtttattactgtgctaaggaccttggggaatccgagaacgaagagtgggccagcgattattacgacttcggaagagattaccccggccaagaccctagaggggtggtcggagtgtttgatatctggggccaggggacaatggttaccgcttcttcc

SEQ ID NO: 39832 - RNA, 432 nt, synthetic construct
  misc_feature 1..432: note = derived and/or modified sequence opt5 from anti-HIV-1_HeavyChain
  source 1..432: mol_type = other RNA
gagatgcagctggtggaaagcggcgggggactcgtccaacccggcgggtccctgagactttcttgcgccgctagcggattcaccttttcctcttactggatgagctgggttcggcaggcccctggcaaggggctggagtgggtggcggtgatctcctatgacggaaacaataaatactatgctgattctgtcaagggccgcttcacaattagcagagaaaactccaaaaatacgctctacctgcagatgaacagccttcgggccgaggacaccgccgtgtattactgtgctaaggatctgggcgaatctgagaatgaggaatgggcctccgactattacgattttgggagcgactacccgggacaggatccccgcggcgttgtggggacattcgacatctggggacacggcaccatggtcacagtgtcttcc

SEQ ID NO: 39833 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttcctcttgtgccatgcactgggtgcgccaggcgcctggaaagggccttgaatgggtcgctgtgatcagctacgacgggaacaataaacattatgccgattccgttaagggaagattcacaatttctcgggacaacagcaaaaatacgctgtacctccagatgaactccctgcgcgccgaggatatggctgtgtattactgcgccaaggaccttggcgaaagcgagaatgaagagtgggcttctgattattacgacttttggagagattatccgggccaagacccccgggggtgggtcggaaccttcgatatctggggccaggggacaatggtgaccgtttccagc

SEQ ID NO: 39834 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggccggtccctccggctgtcttgcgccgctagcgggttcaccttttccaactacggaatgcactgggtgcgccaggcccctggcaaggggcttgaatgggtcacagtgatctctagcgacggatccaaaaagtattacgcggattctgttaaaggcagattcacgattagccgggacaattccaagaacaccctgtatctccagatgaatggcctgcgcgctgatgacacagccgtgtactattgtgccaaagatcttggggacagcgagaacgaagagtgggcttctgattactatgactttggaagagattacccgggccaagaccccagaggggtcgtgggagccttcgatatctggggccatgggaccatggttacagtgtccagc

SEQ ID NO: 39835 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcgggtccctcagactgtcttgcgccgctagcggattcaccttttcctcttacggcatgcactgggtgcggcaggcccctgggaagggacttgaatgggtcgcgttcatccgctatgacggcagcaacaaatactatgctgattccgtgaagggcagatttacaatttctcgggacaatagcaaaaacacgctgtacctccagatgaactccctgcgcgccgttgataccgccgtgtattactgtgctaaggaccttggggagggagaaaatgaggaatgggccacagattattacgacttcagcatcggctacccggggcaagatcccagaggagtcgtgggcgcttttgacatttgggggcagggaaccatggttacagtgtcttcc

SEQ ID NO: 39836 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcacctttcgcaactacggaatgcactgggtgagacagtcccctggcaaggggcttgaatgggtcgccgtgatctcttatgacggaaaaattatcaattacattgatttcgttaagggccggtttacaatcagccgcgagaactccaaaaatacgctgtatctccagatgaactctctgagagcggaagacaccgctgtgtactattgtgccaaggatcttggcgagagcgaaaatgaggagtgggcctccgactactatgatttcgggagcgactacccgggacaagatccccggggcgtcgtggggacatttgacatttggggacatggcaccatggttacagtgtcttcc

SEQ ID NO: 39837 - RNA, 432 nt, synthetic construct
  misc_feature 1..432: note = derived and/or modified sequence opt5 from anti-HIV-1_HeavyChain
  source 1..432: mol_type = other RNA
gaggtgcagctgctcgaaagcggcgggggactggtccaacccggcagatcccttcggctgtcttgcgccgctagcgggttcaccttttcctcttacgttatgcactgggtgcgccaggcccctggaaagggcctcgagtgggtggcggtcatcagctatgacgggtccaacaaacattacgctgattctgtgaagggaagattcacaattagccgggacaattccaaaaacacgctgtatcttcagatgaatagcctgcgcgccgaagataccgccgtttactatagagctaaggacctcggcgagtctgaaaacgaggagtgggcctccgattactatgactttggccgggattacccggggcaggacccccgcggagtggtcggcgtgctgtacatctgggggcaaggaacaatggttaccgtgagctct

SEQ ID NO: 39838 - RNA, 432 nt, synthetic construct
  misc_feature 1..432: note = derived and/or modified sequence opt5 from anti-HIV-1_HeavyChain
  source 1..432: mol_type = other RNA
gaggtgcagctggtcgaaagcggcgggggactcgttaagcccggcgggtccctgagactttcttgcgccgctagcggattcaccttttccacatactctatgcactgggtgcggcaagcccctggcaaagggctggagtgggtggcggtcatcagctatgacggaaacaataagtactatgctgattccgtgaaaggccgcttcacgatttctagagaaaacagcaagaataccctctacctgcagatgaactcccttcgggccgaggacacagccgtttatcattgtgctaaagatctgggcgaaagcgagaatgaggaatgggcctctgactactatgattttgggcgcgactacccgggacaggatcccagaggcgtggtcgggaccttcgacatctggggacacggcacaatggtgaccgtttccagc

SEQ ID NO: 39839 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgacagcggcgggggagttgtgcagcccggcagatccctccggctgttctgcgccgtgtctgggtttaccttcagcacatacacgatgcactgggtccgccaggctcctggaagaggccttgagtgggtggccgttatctcctatgatgggtctaccaagtactatgcggacagcgtgcagggacggtttacaatttcccgcgataactctaaaaataccctgtacctccaaatgaacagcctgagagctgaagacacagccgtctattactgtgccaaggatcttggcgagtccgaaaatgaggaatgggctagcgactattacgatttcggctctgactacccggggcaggatccccgggccgtggttggagcttttgacatctggggccaggggaccatggtgacagtctccagc

SEQ ID NO: 39840 - RNA, 426 nt, synthetic construct
  misc_feature 1..426: note = derived and/or modified sequence opt5 from anti-HIV-1_HeavyChain
  source 1..426: mol_type = other RNA
caggtgcaactggtcgagagcggcgggggagttgtgcagcccggcagatccctccggctgtcttgcgccgctagcgggttcaccttttcctctttcggaatgcactgggtgcgccaggcccctggcaaggggcttgaatgggtcgcggtgatcagctacgacggaaacaataaatattacgctgattccgttaagggcagatttacaatttctcgggagaacagcaaaaatacgctgtatctccagatgaactccctgcgcccggaagacaccgccgtgtactattgtgccaaggatcttggcgagagcgaaaatgaggagtgggcttctgactactatgatttcgggagagactaccccggacaagatcctcggggcgtcgtggggacatttgacatctggggacatggcaccatggttacagtg

SEQ ID NO: 39841 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcatgttttcccgctacggaatgcactgggtgagacaggcccctggcaaggggcttgaatgggtcgcggtgatctctcatgacggaagcaacaaatattacgctgattccgttaagggccggttcattatctctcgcgacaatagcaaaaacaccctgtatctccagatgaactccctgagagccgatgacacagccgtgtactattgtgctaaggatcttggcgagagcgaaaatgaggaatgggcctctgactactatgatttttggattgggtacccgggacaagacccccggggcgtcgtgggggctttcgatatctggggacagggcacgatggttaccgtgtccagc

SEQ ID NO: 39842 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcgggtccctcagactgtcttgcgccgctagcgccttcaccttttcctcttacggaatgcactgggtgcggcaggcgcctggcaaggggcttgaatgggtcgctttcatccgctatgacggaagcaacaaatactatgccgattccgtgaagggcagatttacaatttctcgggacaatagcaaaaacacgctgttcctccagatgaactccctgcgcgccgaggatatggctgtttactattgtgccaaggaccttggcgaaagcgagaatgaagagtgggcttctgattactatgacttttggagagattacccggggcaagacccccggggatgggtgggcaccttcgatatctgggggcagggaacaatggtcaccgtgtccagc

SEQ ID NO: 39843 - RNA, 426 nt, synthetic construct
  misc_feature 1..426: note = derived and/or modified sequence opt5 from anti-HIV-1_HeavyChain
  source 1..426: mol_type = other RNA
caggtgcaactggtcgagagcggcgggggagttgtgcagcccggcagatccctccggctgtcttgcgccgctagcgggttcaccttttcctctttcggaatgcactgggtgcgccaggcccctggcaaggggcttgaatgggtcgcggtgatcagctacgacggatccaacaaatattacgttgattctgtgaagggcagatttacaattagccgggacaattccaaaaacacgctgtatctccagatgaatagcctgcgcgctgaggataccgccgtctacgccaaggaccttggcgaatctgagaacgaagagtgggcttccgattattacgacttcgggagcgattatccgggacaagaccccagaggcgtggttgggacatttgatatctggtctcagggaaccatggtgacagtctccagc

SEQ ID NO: 39844 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcgggtccctccggctgtcttgcgccgctagcggattcaccttttccacatacggcatgcactgggtgcggcaggcccctgggaagggacttgactgggtcgcgttcatccgctatgatggctctcataaatactatgctgacagcgtgaagggcagatttacgatttcccgggaaaactctaaaaataccctgtacctccagatgaacagcctgcgcccggaggatacagccgtttattactgtgccaaggaccttggggaatccgagaatgaagagtgggctagcgattattacgacttcggaagagattaccccggccaagaccctagaggggtggtcggaacctttgatatctggggccacgggacaatggtgaccgtttcttcc

SEQ ID NO: 39845 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatcagctatgacgggtccggagattactatgccgactctgttaaaggcagattcacaattagccgggataactccaagagcacgctgtacctccagatgaactctctgcgcccggaggacaccgccgtgtattactgtgctaaagatcttggcgaatccgagaatgaagagtgggccagcgactattacgattttgggagagactaccccggacaagatcctcggggcgtcgtggggacattcgacatctggggacatggcaccatggttacagtgtcttcc

SEQ ID NO: 39846 - RNA, 432 nt, synthetic construct
  misc_feature 1..432: note = derived and/or modified sequence opt5 from anti-HIV-1_HeavyChain
  source 1..432: mol_type = other RNA
caggtgcacctggtcgagagcggcgggggagttgtgcaacccggcgggtccctcagactgtcttgcgccgctagcggattcaccttttccacatacggcatgcagtgggtgcggcaggcccctgggaagggacttgaatgggtcgcgttcatcaaaaacgacggcacgaatgagttttatggcgattctgtgaaggggcgcttcaccattagcagagacaactccaaaaatacagtttctctgcatatggatagcctccggccggaagacaccgctctgtactattgtgccaaggatcttggagagtccgaaaacgaggagtgggccagcgactactatgattttggctctgactaccccgggcaggatcctcgcgctgtggtcggagccttcgacatctggggccaagggacaatggtgaccgtttccagc

SEQ ID NO: 39847 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcgggtccctcagactgtcttgcgtggccagcggattcaccttttcctcttacggcatgcactgggtccggcaggctcctgggaagggacttgaatgggtggccttcatccgctatgacggcagaaacaaatactatgcggatagcgttaagggccggtttacaatttcccgcgacaaatctaagaatacgctgtgtctccagatgaacagcctgagagtggaggataccgctgtctactattgcgccaaagaccttggggattccgaaaatgaggaatgggccagcgactactatgatttcggacgggactacccgggccaagatccccgcggggtggttggagcttttgacatctggggccatgggacaatggtgaccgtctcttcc

SEQ ID NO: 39848 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatcagctatgacggatccaacaaatactatagagattctgttaagggccggttcacaattagccgcgacaattccaaaaacacggtgtacctgcagatgaatagcctcagagctgaggataccgccgtctattactgtgccaaggacctgggcgaatctgagtccgaagagtgggctagcgattattacgactttgggcgggattacccgggacaagacccccgcggcgtggttggggcccttgatatctggggacagggcattatggtgacagtctcttcc

SEQ ID NO: 39849 - RNA, 432 nt, synthetic construct
  misc_feature 1..432: note = derived and/or modified sequence opt5 from anti-HIV-1_HeavyChain
  source 1..432: mol_type = other RNA
gaggtgcagctggtcgaaagcggcgggggaatggttcaacccggcagacctctccggctgtcctgcgccgcttctgggttcatctttagcggattcggccttcactgggtgcgccaggccccggggaagggactggagtgggtggcgtccatttcttacgacggcggcaacaaatattacgctgatagcgtcagagggcggtttaccatctcccgcgacaattctaagaacacactctatctgcagatgaatagccttagagccgaagatacggccgtgtactattgtgctaaagacctgggagagtccgaaaacgaggagtgggccagcgattactatgacttcggctctgattaccccgggcaggaccctcgggctgttgtgggagcctttgatatttggggccaagggaccatggtcacagtgtccagc

SEQ ID NO: 39850 - RNA, 432 nt, synthetic construct
  misc_feature 1..432: note = derived and/or modified sequence opt5 from anti-HIV-1_HeavyChain
  source 1..432: mol_type = other RNA
gaggtgcagctggtcgaaagcggcgggggagttgtgcggcccggcgggtccctccggctgtcttgcgccgctagcggattcacctttaacgactacggcatggcctgggtgcgccaagcgcctgggaagggacttgagtgggtcgctgatatctcctatgacggctctaataaatactatgccgatagcgtgaagggcagattcacaatttcccgggacaactctaaaaatacgctgtacctccagatgaacagcctgcgcgccgaagataccgctgtttattactgtgccaaggaccttggggagtccgaaaatgaggagtgggctagcgattattacgactttggaagagattacccgggccaggaccccagaggggtggtcggagccttcgatatctggggccaggggacaatggtgaccgtttcttcc

SEQ ID NO: 39851 - RNA, 429 nt, synthetic construct
  misc_feature 1..429: note = derived and/or modified sequence opt5 from anti-HIV-1_HeavyChain
  source 1..429: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtggttagctatgacgagtccaaatactatgctgattctgtgaagggaagattcacaatcagccgggacaactccaaaaatacgctgtacctccagatgaacagcctgcgcgccgaagatatggccgtctattactgtgctaaggaccttggcgagtctgaaaatgaggagtgggcctccgattattacgaattttggagagactacccgggccaagatccccgggggtgggtgggaaccttcgacatttggggccaggggacaatggttaccgtgagctct

SEQ ID NO: 39852 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagcccggcagaggggttgtgcaccctggaggcagcctccggctgtcctgcgtgacctctgggttcacatttgaaaacttcccgatgcattgggtccgccaggcccccggaaagggccttgagtgggtggctctgatcagctacgacgggtccgataaatattactctgacagcgttaagggaagatttacgatttcccgggataattctaaaaacaccctctatctgcagatgaatagccttcgcgccgaagacacagcggtgtactattgtgctaaggatctgggcgagtccgaaaacgaggagtgggccagcgactactatgatttcggctctgactaccctgggcaggatcccagaggagtcgtgggcacctttgacatctgggggcacggaacaatggttaccgtgtccagc

SEQ ID NO: 39853 - RNA, 432 nt, synthetic construct
  misc_feature 1..432: note = derived and/or modified sequence opt5 from anti-HIV-1_HeavyChain
  source 1..432: mol_type = other RNA
caggcccaactggtggagagcggcgggggagtcgttcagcccggcagatccctccggctgtcttgcgctgccagcgggttctcctttgcgacccacgctatgcattgggtgcgcagatctcctggaaagggccttgaatgggtggccacaatcagctacgggggcaaaaacgagtattacgccgactccgtcaagggacggttcacgatttctcgcgaaaatagcaaaaacaccctgtatctccagatgaactccctgagagctgaggatacagccgtgtactattgtgctaaggaccttggcgaaagcgagaatgaggaatgggcctctgattactatgactttgggtccgattacccgggacaggacccccggggcgttgtggggaccttcgatatctggggacacggcacaatggtcaccgtgagctct

SEQ ID NO: 39854 - RNA, 432 nt, synthetic construct
  misc_feature 1..432: note = derived and/or modified sequence opt5 from anti-HIV-1_HeavyChain
  source 1..432: mol_type = other RNA
gccgtgcagctggtcgagagcggcgggggactcgttaagcccggcgggtccctgagactttcttgcgctgccagcggattcacctttttcaacacatggatgtcctgggtgcggcaatctcctggcaaagggctggaatgggtggcggacatcagctacgatggatccaataagtattacgctgactctgtcaaaggccgctttacgattagcagagataactccaagaataccctctatctgcagatgaacagccttcgggccgaggacacagccgtgtactattgtgctaaagatctgggcgaatctgagaatgaagagtgggcctccgactactatgatttcgggcgcgactacccgggacaggatcccagaggcgttgtgggggtctttgacatctggggacagggcaccatggtgacagttagctct

SEQ ID NO: 39855 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatcagctatgacggatccaacaaatactatgctgattctgttaagggcagattcacaattagccgggacaattccaaaaacacgctgtacctccagatgaatagcctgcgcgccgaggataccgccgtgtattactgtgctaaggaccttggcgaatctgagaacgaagagtgggcctccgattattacgactttgggagcgattacccgggacaagaccccagagctgtcgtgggcgccttcgatatctgggggcagggaacaatggttaccgtgtcttcc

SEQ ID NO: 39856 - RNA, 432 nt, synthetic construct
  misc_feature 1..432: note = derived and/or modified sequence opt5 from anti-HIV-1_HeavyChain
  source 1..432: mol_type = other RNA
caggtgagactggtcgagagcggcgggcgggttgtgcaacccggaggctccctccgcctgtcttgcgtggccagcgggttcaccttttcctcttacggaatccactgggtcagacaggctcctggcaaggggcttgaatgggtgacattcatttggcatgacggacgggatacgtattacgccgacgcggttaaaggccgctttaccatcagcagagataactccaagaatacactgtatctccagatgaactctctgcgggctgaggacaccgccgtgtactattgtgccaaagatcttggcgaaagcgagaatgaagagtgggctacagactactatgatttctggaccgggtacccgggacaggacccccgcgccgtcgtgggcgcttttgatatttgggggcaaggaacaatggttaccgtgtccagc

SEQ ID NO: 39857 - RNA, 432 nt, synthetic construct
  misc_feature 1..432: note = derived and/or modified sequence opt5 from anti-HIV-1_HeavyChain
  source 1..432: mol_type = other RNA
caggtgcacctggtcgagagcggcgggggagttgtgcaacccggcagatccctccggatctactgcgccgtgtctgagttcacctttcgcaactatgctatgcattgggtcagactggcccctgggaagggacttcagtgggtggcggttattagctacgacggctccaataaatattacggggattctgtgaagggacggttcacaatcagccgcgacaactccaaaaatacgctgtatctccagatggattctctgagagctgaagacaccgccgtctactattgtgccaaggatcttggcgaaagcgagaacgaagagtgggcttccgactactacgattttggccgggactatccggggcaggatccccgcggagtggttggcacattcgacatttgggggcacggaaccatggtgacagtcagctct

SEQ ID NO: 39858 - RNA, 432 nt, synthetic construct
  misc_feature 1..432: note = derived and/or modified sequence opt5 from anti-HIV-1_HeavyChain
  source 1..432: mol_type = other RNA
gaggtgcagctggtcgaaagcggcgggggactcgttaagcccggcgggtccctgagactttcttgcgccgctagcggattcaccttttccgacgcctggatgtcttgggtgcggcaagcgcctggcaaagggatggagtgggtggctgtcatcagctacgatggatccaacaagtattacgccgactctgtgaaaggccgcttcacaattagcagagataattccaagaacacgctgtatctccagatgaatagcctgcgggccgttgacaccgctgtgtactattgtgccaaagatcttggcgaaggggagaacgaagagtgggctacagactactatgatttttctatcggatacccgggccaggacccccgcggggtcgtgggagccttcgatatttggggccaggggaccatggttacagtgtccagc

SEQ ID NO: 39859 - RNA, 432 nt, synthetic construct
  misc_feature 1..432: note = derived and/or modified sequence opt5 from anti-HIV-1_HeavyChain
  source 1..432: mol_type = other RNA
gaggtgcaggtcgttgaaagcggcgggggactggtgaagcccggcgggtccctcagactgtcttgcgaggccagcggattcaccttttccaacgcttggatgtcttgggtgcggcaagcccctggcaaagggcttgaatgggtcgcggtgatcagctacgacggaaataacaagtattacgctgattccgttaaaggccgcttcacaatttctagagagaatagcaagaacacgctgtatctccagatgaactccctgcgggccgaagacaccgccgtgtaccactgtgctaaagatcttggcgagagcgagaatgaagagtgggcctctgactattacgattttgggcgcgactatccgggacaggatcccagaggcgtcgtggggacattcgacatctggggacatggcaccatggttacagtgtccagc

SEQ ID NO: 39860 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcgggtccctcagactgtcttgcgccgctagcggattcaccttttcctcttacggcatccactgggtgcggcaggcccctgggaagggacttgaatgggtcgcgttcattcgcagcgacgctacaaacaaatattacgccgattccgtgaagggcagatttacgatctctcgggagaatagcaaaaacaccctgtatctccagatgaactccctgcgcgccgaagacacagctgtttactattgtgccaaggatcttggcgagagcgaaaatgaggagtgggcttctgactactatgatttcgggtccgactacccgggacaagatcccagaggcgtggtcgggacctttgacatttggggacatggcacaatggtgaccgttagctct

SEQ ID NO: 39861 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttcctctttcggaatgcactgggtgcgccaggcccctggcaaggggcttgaatgggtcgcggtgatcagctacgacggaaacaataaatattacgctgattccgttaagggcagatttacaatttctcgggagaacagcaaaaatacgctgtatctccagatgaactccctgcgcgccgaagacaccgccgtgtactattgtgctaaggatcttggcgagagcgaaaatgaggagtgggcctctgactactatgatttcgggtccgactacccgggacaagatcccagaggcgtcgtggggacatttgacatctggggacatggcaccatggttacagtgagctct

SEQ ID NO: 39862 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttccaactacgccatggactgggtgcgccaggcgcctggaaagggccttgaatgggtcgctgtgatctcttatgatgggagcaataaatactatgccgactccgttaagggaagattcacaatttctcgggataacagcaaaaatacgctgtacctccagatgaactccctgcgcgccgaggacaccgctgtgtattactgtgccaaggatcttggcgaaagcgagaatgaagagtgggctacagactattacgatttttggaccggctacccggggcaagaccccagagccgtcgtgggagcgttcgatatctggggccaggggacaatggttaccgtgtcttcc

SEQ ID NO: 39863 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtggttagctatgacgagtccaacaaatactatgctggatctgtgaagggcagattcacaatcagccgggataattccaaaaacacgctgtacctccagatgaatagcctgcgcaccgaagacatggccgtctattactgtgccaaggatcttggcgagtctgaaaacgaggagtgggcttccgactattacgattttgggagagaatacccgggacaagacccccggggctgggtggggacattcgatatttggggacagggcaccatggttacagtgagctct

SEQ ID NO: 39864 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttcctcttacggaatgcactgggtgcgccaggcccctggcaaggggcttgaatgggtcgcggtgatcagctatgacggatccaacaaatactatgttgattctgtgaagggcagattcacaattagccgggacaattccaaaaacacgctgtacctccagatgaatagcctgcgcgctgaggataccgccgtctattactgtgccaaggaccttggcgaatctgagaacgaagagtgggctacagattattacgacttttccatcgggtacccgggacaagatcccagaggcgtggttgggattttcgacatctggggacagggcaccatggtgacagtcagctct

SEQ ID NO: 39865 - RNA, 432 nt, synthetic construct
  misc_feature 1..432: note = derived and/or modified sequence opt5 from anti-HIV-1_HeavyChain
  source 1..432: mol_type = other RNA
caggtgcaactggtcgagagcggcgggggagttgtgcagcccggcagatccctccggctgtcttgcgccgctagcgggttcaccttttccacatctggaatgcactgggtgcgccaggcccctggcaaggggatggaatgggtcgcggtgatcagctacgacggatccaacaaatattacgctgattctgttaagggcagattcacgattagccgggacaattccaaaaacaccctttatctgcagatgaatagcctccgcgccgtggatacagccgtctactattgtgctaaggacctgggcgagggggaaaacgaggaatgggccaccgattactatgacttttctatcggatacccgggccaagatcccagaggggtggttggagctttcgacatttggggccaggggacaatggtgaccgtctccagc

SEQ ID NO: 39866 - RNA, 363 nt, synthetic construct
  misc_feature 1..363: note = derived and/or modified sequence opt5 from anti-HIV_C38-VRC18.02_HeavyChain
  source 1..363: mol_type = other RNA
caggtgagactggtccaaagcggcaaccaggttcggaagcccggggcctccgtgcgcatctcttgcgaggctagcggatacaaattcattgaccactttatccattgggtgagacaggtccctggccacgggctcgaatggctgggatggattaatccgcggggcgggggagtgaactattcccgctctttccagggcaaacttagcatgaccatgacaagagataattttgaggaaacggcctacctggacctctccaagctgaaccccggcgataccgcggtttatttctgtgctcgggggtttgccggatacgagtggtctttcatctggggccaagggacacttgtgattgtcagctcc

SEQ ID NO: 39867 - RNA, 396 nt, synthetic construct
  misc_feature 1..396: note = derived and/or modified sequence opt5 from anti-HIV_44-VRC13.02_HeavyChain
  source 1..396: mol_type = other RNA
caggtgcaactggtccagagcggcaccgccctcaagtcccccgggtctagcgctaaactgtcctgcacagttcttggagacgagttcggcacgtactttatctcttggattagacaggcccctgggcagggactggaatgggtgggcgggatcgtgccgcacagccaactccagtcctctgcgcagaagttccatggacggattatcattagcgctggcgccggcgtcacaccccctgtggtttccctgcagcttaccaacctgacctttgaggatacagggacctatttctgtgcccgcgaaagaggacggcaccgcgaccccaaaacaggcgatgctctcagagggcggtactttgacttctggggacgcggcaccgggctgagagtgagcacg

SEQ ID NO: 39868 - RNA, 321 nt, synthetic construct
  misc_feature 1..321: note = derived and/or modified sequence opt5 from anti-HIV-1_LightChain
  source 1..321: mol_type = other RNA
gacatcaagctgacccagagccccgccttcctctccgcttctgtgggcgagagagtcacatttacgtgccgggccagccaagatatttcccacgacctggtttggttccagcagaaagcggggcgcgctccttctcttctgatgttttacggaagcaccctcgaaagaggcgtgccgccccggttctccgggcgcagatctggaacagagtttaccgtgacaatcgatagcctgcagcctgaagacgtcggcacctattactgtcaacagctttccgccttccccctgacatttgggggaggcaccacggtggatattaag

SEQ ID NO: 39869 - RNA, 321 nt, synthetic construct
  misc_feature 1..321: note = derived and/or modified sequence opt5 from anti-HIV-1_LightChain
  source 1..321: mol_type = other RNA
gacatcaagatgacccagagccccgccttcctgtccgcttctgtgggcgagagagtcacatttacgtgccgggccagccaagatatttcccacgacgttgtgtggttccagcagaaatctgggagcgcgcctaagctcctgatgttttacggatccacccttgaacgcggcgtgccgcccagattctctgggcggcgcagcggaacagagtttaccgtcacaatcgatggcctgcagcctgaagacgtggggacctattactgtcaacagctctccgctttccccctgacatttggaggcggcaccacggttgatattaaa

SEQ ID NO: 39870 - RNA, 321 nt, synthetic construct
  misc_feature 1..321: note = derived and/or modified sequence opt5 from anti-HIV-1_LightChain
  source 1..321: mol_type = other RNA
gacatcaagctgacccagagccccgccttcctctccgcttctgtgggcgagagagtcacatttacgtgccgggccagccaagatattcgccacgaactggtttggtaccagcagaagcctgggagaggaccgaaacttctgatctattacggctccaccctcgaagggggagtgccctctcggttcagcggccgcagatccgggacagagtttaccgtgacaatttctagcctgcagcctgaggacgtcggaacctattactgtcaacagcttaactccttccccctgacatttggcggcgggaccacggtggatatccgg

SEQ ID NO: 39871 - RNA, 321 nt, synthetic construct
  misc_feature 1..321: note = derived and/or modified sequence opt5 from anti-HIV-1_LightChain
  source 1..321: mol_type = other RNA
gacatccagctgacccaaagcccctccttcctctctgccagcgtgggcgatagagtctccattacatgccgggcttctcaggggatcaagcacgagctggcctggtaccagcagaaacctggacgcgcgccgagccttctgatttattacgcttccacgctcgccagaggcgttccctctcggtttagcgcctcctggagcgggaccctgttcacacttaccatcaatggactgcaacctgaagactttgctacatatttctgtcagcagatgaactctctccccctgacctttggcgggggaacaaagatggatgtgcgc

SEQ ID NO: 39872 - RNA, 321 nt, synthetic construct
  misc_feature 1..321: note = derived and/or modified sequence opt5 from anti-HIV-1_LightChain
  source 1..321: mol_type = other RNA
gacatccagctgacccaaagcccctccttcctctctgccagcgtgggcgataaggtcacaattacgtgcagagcttcccacggggttcggaacgagctggcctggtaccagcagaaacctggaaaggcgccgaatcttctgatctattacgcttctaccctccagagcggcgtgccctcccgcttttctgccacagggagcggaacccatttcacactgaccgtgtccagccttcaacctgaagactttgccacatatttctgtcagcacatgtcttcctaccccctgacctttggcgggggaacgaaagtcgagattaag

SEQ ID NO: 39873 - RNA, 321 nt, synthetic construct
  misc_feature 1..321: note = derived and/or modified sequence opt5 from anti-HIV-1_LightChain
  source 1..321: mol_type = other RNA
gacatccagctgacccaaagcccctccttcctctctgccagcgtgggcgataaggtcacatttacgtgcagagcttcccagggggttcggaacgagctggcctggtaccagcagaaacctggaaaggcgccgaatcttctgatttattacgcttctaccctccaaagcggcgtgccctcccgcttctctgccacagggagcggaacccacttttccctgacagtgagctctcttcagcctgaagacttcgccacctatttttgtcagcatatgtccagctaccccctgacattcggcgggggaaccaaagtcgagatcaag

SEQ ID NO: 39874 - RNA, 321 nt, synthetic construct
  misc_feature 1..321: note = derived and/or modified sequence opt5 from anti-HIV-1_LightChain
  source 1..321: mol_type = other RNA
gacatccagctgacccaaagcccctccttcctctctgccagcgtgggcgataaggtcacaattacgtgcagagcttcccagggggttcggaacgagctggcctggtaccagcagaaacctggaaaggcgccgaatcttctgatctattacgcttctaccctccaaagcggcgtgccctcccgcttttctgccacagggagcggaacccacttcacactgaccgtgtccagccttcagcctgaagactttgccacatatttctgtcagcatatgtcttcctaccccctgacctttggcgggggaacgaaagtcgagattaag

SEQ ID NO: 39875 - RNA, 366 nt, synthetic construct
  misc_feature 1..366: note = derived and/or modified sequence opt5 from anti-HIV-1_HeavyChain
  source 1..366: mol_type = other RNA
agccagtacctggcccaacccggcgctgaggtggccaagcctggggcgtccgtcaaagtttcttgcaaggtgcacggagacaacttcagaggccattatctccactgggtgcggcaggctccggggcagggactgcagtggatcggcgggattaatccctttagcggagaagccgcctacggcaaacgcttcgagggcagacttcggctgacccgcgatacatccgtcaacacggcttatatggaactcgccaagctgacccctgacgatacagctgtgtacttttgtgccagagacaaaacctataatgatgagttcacagcgatggacatctgggggcatggaaccacagttattgtgtctagc

SEQ ID NO: 39876 - RNA, 366 nt, synthetic construct
  misc_feature 1..366: note = derived and/or modified sequence opt5 from anti-HIV-1_HeavyChain
  source 1..366: mol_type = other RNA
agccagtacctggcccaacccggcgctgaggtggccaagccttgggcgtccgtcaaagtttcttgcagagtgcacggggacaacttccggggattttatctccattgggtgcgccaggctccgggccaggggctggaatggatcggaggcattaatcccttcagcggggaggccgcctacggaagacggtttgaaggccgccttagactgacccgggatacatccatcaacacggcttatatggaggtcaccaagctcacatctgacgataccgccgtgtacttctgtgctcgcgacaaaacatataatgatgaatttaccgccatggacatttggggccaggggacaaccgttatcgtgagctcc

SEQ ID NO: 39877 - RNA, 366 nt, synthetic construct
  misc_feature 1..366: note = derived and/or modified sequence opt5 from anti-HIV-1_HeavyChain
  source 1..366: mol_type = other RNA
agccagtacctggcccaatccggctctgaggtgaagaaacccggggctagcgtcaaggtttcctgcagactccacggagacaaattcggcgcccattatatccactgggtgcggcaggcgcctgggcagggactggaatggcttggctttttccatccggggaccggagatgctgtgtctgcccagaagtttcaaggccgcattagcctgacaagagacacgtccatctctaccggctacctcgaggtccggcgcctgagctccgatgacacagccgtgtattactgtgctagagataaaacctatagcgacgaagccacagggatggatatttggggacagggcaccacagttatcgtgtcttcc

SEQ ID NO: 39878 - RNA, 366 nt, synthetic construct
  misc_feature 1..366: note = derived and/or modified sequence opt5 from anti-HIV-1_HeavyChain
  source 1..366: mol_type = other RNA
agcctggagctcgtgcagtccggcaccgaagtcaagaaacccggggcctctgttaaggtgagctgcaaactgttcggagacacaatcacgtccggccctattcactgggtgagacaagctccggggcagggacttgagtggatgggctggaccaacccccattctggggatacagccaccgcgcctaagtttcagggacgggtctacatgacaaatgacaaaaagatcaacaccgctttcctggatgtgacacgcctcgccagcgacgataccgccatttatttttgtgctagagacatgtactattccaatgaagccgttggcatggatgtgtggggccaggggacgaccgtctctgtgagctcc

SEQ ID NO: 39879 - RNA, 366 nt, synthetic construct
  misc_feature 1..366: note = derived and/or modified sequence opt5 from anti-HIV-1_HeavyChain
  source 1..366: mol_type = other RNA
caggaggtgctggtccaaagcggcgccgaagttaagaaacccggggcttccgtgaaggtgtcttgcagagccttcggatacacctttacagcgcacgctctccattgggtccggcaggcccctggccaggggctggagtggcttggatggatcaacccgcacagcggcgacacgaccacatcccagaaattccaagggcgcgtgtatatgaccagagataagtctattaatacagcctacctggaagttacccggctcacaagcgacgataccgctatcttttattgtgcccgcgacaaatactatggagatgaggctgtgggcatggacgtctggggccaggggacgtccgtgaccgtttctagc

SEQ ID NO: 39880 - RNA, 366 nt, synthetic construct
  misc_feature 1..366: note = derived and/or modified sequence opt5 from anti-HIV-1_HeavyChain
  source 1..366: mol_type = other RNA
caggaggtgctggtccaaagcggcgccgaagttaagaaacccggggcttccgtgaaggtgtcttgcagagccttcggatacacctttacaggcaacgcgctccactgggtccggcaggctcctgggcagggactggagtggcttggctggatcaatccgcatagcggggacacgaccacatcccagaaattccaaggacgcgtgtatatgaccagagataaggccattaacacagcctacctggacgttacccggctcacatctgatgacaccgctatctattactgtgcccgcgataaatattacggcaatgaagctgtgggcatggacgtctgggggcagggaacgagcgtgaccgtttcctct

SEQ ID NO: 39881 - RNA, 366 nt, synthetic construct
  misc_feature 1..366: note = derived and/or modified sequence opt5 from anti-HIV-1_HeavyChain
  source 1..366: mol_type = other RNA
caggaggtgctggtccaaagcggcgccgaagttaagaaacccggggcttccgtgaaggtgtcttgcagagccttcggatacacctttacaggcaacgcgctccactgggtccggcaggctcctgggcagggactggagtggcttggctggatcaatccgcatagcggggacacgaccacatcccagaaattccaaggacgcgtgtatatgaccagagataagtctattaacacagcctttctggacgttacccggctcacaagcgatgacaccggcatctactattgtgcccgcgataaatactatggcaatgaagctgtggggatggacgtctggggacagggcacgtccgtgaccgtttctagc

SEQ ID NO: 39882 - RNA, 303 nt, synthetic construct
  misc_feature 1..303: note = derived and/or modified sequence opt5 from anti-HIV_45_LightChain
  source 1..303: mol_type = other RNA
agcctgacccagtcccccggcacactctctctgagccctggggagacggccatcatttcctgcagaacctctcaatacggaagccttgcttggtatcagcagcggccgggccaggcgccccgcctggtgatctactccgggtctacaagagccgctggcattcctgaccggttcagcggatcccgctgggggcccgattataacctcaccatcagcaatctggaatctggagactttggcgtctactattgtcaacagtacgagttctttggccaggggacaaaggttcaggtggatattaaa

SEQ ID NO: 39883 - RNA, 303 nt, synthetic construct
  misc_feature 1..303: note = derived and/or modified sequence opt5 from anti-HIV_45_LightChain
  source 1..303: mol_type = other RNA
gtgctgacccagagccccggcacactctccctgtctcctggggagacggccaccatcagctgcagaacatcccaatacggatctcttgcttggtatcagcagcggccgggccaggcgccccgcctggtcatttacagcgggtccaccagagccgctggaatccctgaccggttctctggcagccgctccgggcccgattatacactcaccattagcaacctggaatctggagactttggcgtttactattgtcaacagtacgagttctttggccaggggacaaaggtgcagcaagataataaa

SEQ ID NO: 39884 - RNA, 303 nt, synthetic construct
  misc_feature 1..303: note = derived and/or modified sequence opt5 from anti-HIV_45_LightChain
  source 1..303: mol_type = other RNA
gtgctgacccagagccccggcacactctccctgtctcctggggagacggccatcattagctgcagaacctcccaatacggatctcttgcttggtatcagcagcggccgggccaggcgccccgcctggtgatctacagcgggtccacaagagccgctggcattcctgaccggttctctggaagccgctgggggcccgattataacctcaccatctccaatctggaaagcggagactttggcgtttactattgtcaacagtacgagttctttggccaggggacaaaggtccaggtggatattaaa

SEQ ID NO: 39885 - RNA, 363 nt, synthetic construct
  misc_feature 1..363: note = derived and/or modified sequence opt5 from anti-HIV_45_HeavyChain
  source 1..363: mol_type = other RNA
caggtgagactgagccaatccggcgggcagatgaagaaacccggagagtctatgcggatcagctgccgcgcctccggctacgagttcattgactgtaccctcaactggatcagactggctcctgggcggcgcccggaatggatgggatggcttaagcccagaggcggggccgtcaattatgcgcgggtttttcagggacgcgtgacaatgacgagagatgtgtactctgacaccgctttcctggaactccggagcctgacagccgatgacaccgccgtctatttttgcacacgcggcaaaaccgtggattacaactgggacttcgagcacgttggccctgggacacccgtgaccgtctcctct

SEQ ID NO: 39886 - RNA, 363 nt, synthetic construct
  misc_feature 1..363: note = derived and/or modified sequence opt5 from anti-HIV_45_HeavyChain
  source 1..363: mol_type = other RNA
caggtgagactgagccaatccggcgggcagatgaagaaacccggagagtctatgcggatcagctgccaggcctccggctacgagttcattgactgtaccctcaactgggtccgcctggctcctgggagacggccggaatggatgggatggcttaagccccgcggcggggccgttaattatgcgagaatctttcagggacgggtgacaatgacgcgcgatgtgtactctgacaccgctttcctggaactcagaagcctgacagccgatgacaccgccgtctatttttgcacacggggcaaaaactgtgattacaattgggacttcgagcacgtgggccctgggtatcccgttaccgtgtcccct

SEQ ID NO: 39887 - RNA, 375 nt, synthetic construct
  misc_feature 1..375: note = derived and/or modified sequence opt5 from anti-HIV_45_HeavyChain
  source 1..375: mol_type = other RNA
caggtgagactgagccaatccggcgggcagatgaagaaacccggagactctatgcggatcagctgccgcgcctccggctacgagttcattaactgtcctatcaattggattagactcgctccggggaagcggcccgaatggatgggatggatgaaacctcgcggcggggccgtctcttatgcgagacagctgcagggacgggttaccatgacacgcgatatgtacagcgagacggcttttcttgaactgagatccctcacctctgacgatacagccgtgtatttctgcacccggggcaagtactgtacagcccgcgactattacaactgggattttgagcactggggccaagggacccccgtgacagtcagctcc

SEQ ID NO: 39888 - RNA, 435 nt, synthetic construct
  misc_feature 1..435: note = derived and/or modified sequence opt5 from anti-HIV_cap256-206-252885_VR-Chain
  source 1..435: mol_type = other RNA
caggagcaactggtggaaagcggcgggggagtcgttccccctggctcctctctcaccctgagctgcgtggcctcccggttcacattttctgctttcgggatgcactgggtgcggcaggccccgggaaagggccttgagtgggtcgcgggggtgagctttgttggaatcaaaaagtactatgctgactccgtgaaaggccgcttcacgatttctagagataacagcaagaataccctgtttctccagatgaacggcctgcgcggggaagacacaggactttactattgtgtcaaagatatgcggtacctggagtgcgaagagtgggcctccgactattacgatttcggcaagcccaatcagccttgtctcgacagaagaggggtgagcggaatctctgccttttggggccaagggaccacagttaccgtgtccagc

SEQ ID NO: 39889 - RNA, 438 nt, synthetic construct
  misc_feature 1..438: note = derived and/or modified sequence opt5 from anti-HIV_cap256-206-249183_VR-Chain
  source 1..438: mol_type = other RNA
caggtgctgctcgtcgagagcggcgggggagttgtggaacccggcacctccctgacactttcttgcgccgctagcagattcacgttttccaacttcgggatgcactgggtgcggcaaacccctggaggcgggctggagtgggtcgcctctatcagcaatgaaggaaacaagaaataccatgcggagtccgtgtggggccgctttattatctctagagacaatagcaagaacacagttttcctccacatgtccagcctgcggccggatgactctgctctttatttttgtgtgcgcgatagacaggaagacgattgcgaggtctggtggtccgactacgaggccttcggccgggaaattccctgtcgccagtatagagggcagggactggccggcatctttgatatttgggggcggggaaccatggtgacagttagctct

SEQ ID NO: 39890 - RNA, 438 nt, synthetic construct
  misc_feature 1..438: note = derived and/or modified sequence opt5 from anti-HIV_cap256-206-220956_VR-Chain
  source 1..438: mol_type = other RNA
cagatgatgctggtggagagcggcggggacgtcgttgaacccggaagatccctcaccctgtcttgcgccacaagccaattcacgttttccaactacggcatgcactgggtgcggcaggctcctgggcgcggacttgagtgggtggcctctatcagcaatgaaggcaacaagaaatatcatgcggagtccgtctgggggagactgattatctctcgggataatagcaagaacaccctcttcctgcacatgtccagccttcgcgctgacgattctgccctgtacttttgtgtgagagaccggcaggaagatgagtgcgaggaatggtggtccaattattacgccttcggacgcggcggcccgtgtagaaaatatcgggggcagggactcgctggcatttttgacgtttgggggcgcggaacaatggtgaccgtcagctct

SEQ ID NO: 39891 - RNA, 432 nt, synthetic construct
  misc_feature 1..432: note = derived and/or modified sequence opt5 from anti-HIV_cap256-206-220629_VR-Chain
  source 1..432: mol_type = other RNA
caggagcaactggtggaaagcggcgggggagtcgttccccctggcaagtccctcaaactgtcttgcgtggccagcagattctcctttggggctttcggaatgcactgggtgcggcaggccccgggcaaggggcttgagtgggtcgcgggaatctcttttgctggcattaaaaagtactatggcgacagcgtgaaagggcgcttctacatctccagagataactctcagaataccctgtttctcgaaatgaacggactgcggggcgacgatacagcccgctattactgtgttaaggaccttagagagctggaatgcgaggagtgggccagcgattattacgacttcgggaagccccagccttgtctcgattcccggggagtgagcggcatttctgctatgtgggggcccggaacgatggtcaccgtgtccagc

SEQ ID NO: 39892 - RNA, 381 nt, synthetic construct
  misc_feature 1..381: note = derived and/or modified sequence opt5 from anti-HIV_cap256-206-200599_VR-Chain
  source 1..381: mol_type = other RNA
caggagaagctggtggaaagcggcgggggagccgtccaacccggcgggtccctcagactgtcttgcgttgctagcggattcacctttaacggcttcgggatgcactgggtgcggcaggcccctggaaaaggccttgagtgggtggcgacaatctccttttctggcgtctacattagccgcgaaaattccaagaacacgctgtatctccagatgaatgggctgagaggagaggacaccgctctttactattgtgccaaagatctgcggtacctcgaatgcggcgagtggtctacatattacccgcagccctgtctggacacccgcggggtgagcggaatctccaacgtttggggccctgggacaagagtgaccgtcagctct

SEQ ID NO: 39893 - RNA, 432 nt, synthetic construct
  misc_feature 1..432: note = derived and/or modified sequence opt5 from anti-HIV_cap256-206-186347_VR-Chain
  source 1..432: mol_type = other RNA
caggagctgctcgtggaaagcggcgggggagtcgttccccctggcaagtccctgaccatctcttgcgtggccagcagattcacattttccgctttcgggatgcactgggtgcggcaagccccgggaaaaggccttcagtgggtcgcgtctattagctttgctgggacgaagaaatactatgccgacttcgtgaagggacgctttaccatctccagagataactctaaaaatacaattttcctgcagatgaacggcctccggggcgaggacaccgccctgtaccattgtgttaaggatatgcgccagcttgaatgcgaggaatggacaagcgactattacgattttgggagaccccaaccttgtatcgaccggcgcggagtgtccggcattagcgctatgtgggggcccggaaccatggtcacagtgtcttcc

SEQ ID NO: 39894 - RNA, 438 nt, synthetic construct
  misc_feature 1..438: note = derived and/or modified sequence opt5 from anti-HIV_cap256-206-186226_VR-Chain
  source 1..438: mol_type = other RNA
cagatgctgctcgtggagagcggcgggggagtcgttgaacccggcagatccctgaccctttcttgcgccacaagccaattcacgttttccaactacgggatgcactgggtgcggcagacccctggaacaggcctggagtgggtggcttctatcagcaatgaagggaacaagaaatatcatggagaggccgtctggggccgcttcattatctccagagacaattctaagaaaaccctctttctgcacatgagcaaccttcgggcggatgactccggcctgtacttctgtgtgcgcgatagacaggaagacgagtgcgaggaatggtggagcgattattactcttttgggcggggaggcccgtgtcgcaagtatcatgggcagggactcgctggcattttcgacatctgggggagaggaacactggttaccgtgtccagc

SEQ ID NO: 39895 - RNA, 435 nt, synthetic construct
  misc_feature 1..435: note = derived and/or modified sequence opt5 from anti-HIV_cap256-206-179686_VR-Chain
  source 1..435: mol_type = other RNA
caggagcaactggtggaaagcggcgggggagtcgttcccccttggaagtccctcaccctgtcttgcgaggccagccggttcacattttccgctttcggcatgcactgggtgcggcaggccccggggaaaggacttgaatgggtggcgggcatctcttttgctgggattaagaaatactatgccgacagcgtcaagggacgcttctttatctccagagataactctaaaaatcgggtgctgctcgagatgaacggcctgcgcagagaagacacggcccggtacttctgtgttaaggatcttcgcgagctggagtgcgaagagtgggctagcgactattacgattttggcaagcccaatcagccttgtctcgacagaagaggggtgtccggaattagcgccatgtggggccaggggaccatggtcacagtgtcttcc

SEQ ID NO: 39896 - RNA, 417 nt, synthetic construct
  misc_feature 1..417: note = derived and/or modified sequence opt5 from anti-HIV_cap256-206-173707_VR-Chain
  source 1..417: mol_type = other RNA
caggagaagctggtggaaagcggcgggggagccgtccaacccggcgggtccctcagactgtcttgcgttgctagcggattcacctttaaaggcttcgggatgcactgggtgcggcaggcccctggaaagggccttgagtgggtggcgacaatctccttttctggcgtcaaaaagtactatgggaacagcgctaaaggacgcttctttatttccagagacaatctgaagaacacggtgtacctcgaaatgaatggcctgcgcggggaggataccgccctttattactgtgccaaggacctgcggtatctcgaatgcggagagtggtctacatactatccgcagccctgtctggataccagaggcgttagcgggatctccaacgtgtggggacctggcacaaaagtcaccgtgagctct

SEQ ID NO: 39897 - RNA, 432 nt, synthetic construct
  misc_feature 1..432: note = derived and/or modified sequence opt5 from anti-HIV_cap256-206-173339_VR-Chain
  source 1..432: mol_type = other RNA
caggagctgctcgtggaaagcggcgggggagtcgttccccctggcaagtccctgaaactttcttgcgtggccagcagattcacctttggggctttcggaatgcactgggtgcggcaagccccgggcaaggggctggagtgggtcgcgggaatctcctttgctggcacgaaaaactactatgccgactctgtgaagggccgcttcacaattagcagagataatcccaaaaacaccctctttctgcagatgaatgggcttcggggagacgatacaggcctgtactattgtgttaaggacatgcgcgaactcgagtgcgaactgtggacctccgattactatgacttcgggagacctcagccctgtatcgatcagcggggagtgtctggcattagcgccatgtgggggcaaggaacaatggtcaccatctccagc

SEQ ID NO: 39898 - RNA, 438 nt, synthetic construct
  misc_feature 1..438: note = derived and/or modified sequence opt5 from anti-HIV_cap256-206-172689_VR-Chain
  source 1..438: mol_type = other RNA
cagatgatgctggtggagagcggcgggggagtcgttgaacccggcagatccctcaccctgtcttgcgccacaagccacttcacgttttccaactacgggatgcattgggtgcggcaagctcctggaggccgccttgagtgggtggcctctatcagcaatgcggggaacaagaaatatcacggagactccgtctggggcagactgattatctctcgggataatagcaagaacaccctcttcctgcatatgtccagccttcgcgtggacgattctgctctgtacttttgtgttagagaccggcaggaagatgagtgcgaagagtggtggtccgactattacgccttcggccgcgggggaccgtgtagaaaatatcggggccaggggctcgccggaatttttgatatctggggccgcgggacaatggtgaccgtcagctct

SEQ ID NO: 39899 - RNA, 432 nt, synthetic construct
  misc_feature 1..432: note = derived and/or modified sequence opt5 from anti-HIV_cap256-206-162744_VR-Chain
  source 1..432: mol_type = other RNA
caggagaagctggtggaaagcggcgggggagtcgttccccctggcaaatccctcagactgtcttgcgtggccagcgggttcaccttttccgctttcggaatgcactgggtgcggcaagccccgggcaaggggcttgagtgggtcgcgggaatctcttttgctggcattaaaaactactatgccgacagcgtgaagggccgcttcacaatctccagagataattctaaaaacagcctgtttctccagatgaatgggctgcggggagacgatacggcccgctactattgtgttaaggacatgagagaacttgagtgcgaagagtggacctccgattactatgacttcggcaagccccagccttgtattgatcggcgcggggtgagcggaatctctgctatgtggggccaggggacaatggtcaccatttccagc

SEQ ID NO: 39900 - RNA, 438 nt, synthetic construct
  misc_feature 1..438: note = derived and/or modified sequence opt5 from anti-HIV_cap256-206-146057_VR-Chain
  source 1..438: mol_type = other RNA
cagatgcaactggtggagagcggcgggggagtcgttcagcccggcacctccctcacactgtcttgcgtggccagccagttcacgttttccaactacgggatgcactggatcagacaggctcctggacaaggccttgaatgggtggcctctattagcaatgacgggggaaagcggtatcatggcgatgcggtctgggctcgcttcatcatttccagagacaactctaaaaataccgtgtttctgcagatgacaagcctccgggccgaggataccgcccgctacttctgtgttagagaccggcaggaagatgagtgcctggaatggtggtccgactattacaactttggccgccagcttccgtgtgctaagttcagagggctgggactcgccggcgtgtttgatatctgggggcacggaacaatggtcaccgtgagctct

SEQ ID NO: 39901 - RNA, 435 nt, synthetic construct
  misc_feature 1..435: note = derived and/or modified sequence opt5 from anti-HIV_cap256-206-139519_VR-Chain
  source 1..435: mol_type = other RNA
caggagcaactggtggaaagcggcgggggagtcgttccccctggcacctccctcagactgtcttgcgtggccagccggttctcctttgggtctttcggaatgcactgggtgcgccaggctccgggcaaggggcttgagtgggtcgccggaatcagctttgtgggcattaaaaagtactatggcgactccgttaaagggagattctttatctctcgggataacagcaagaatacactgttcctcgaaatgaacggactgcgcggcgaggacacggcgagatactattgtgtgaaagatatgcgggaacttgagtgcgaggaatgggcttccgactactatgattttgggaagcccaatcagccttgtctggaccgcagaggagtcagcggcatttctgccatgtgggggcccggaaccatgctcacagtgtccagc

SEQ ID NO: 39902 - RNA, 432 nt, synthetic construct
  misc_feature 1..432: note = derived and/or modified sequence opt5 from anti-HIV_cap256-206-136316_VR-Chain
  source 1..432: mol_type = other RNA
caggagcaactggtggaaagcggcgggggagtcgttccccctggcaagtccctcaccctgtcttgcgtggccagcgggttcacattttccgctttcggaatgcactgggtgagacaggccccgggcaaagggcttgagtgggtcgcgggaatctcttttgtgggcattaagaaatactatggcgacagcgttaaggggcggttcacgatctcccgcgataactctaaaaataccctgtttctccagatgaacggactgagaggcgacgatacagctctttaccattgtgtgaaggacatgcggcagctggaatgcgaggaatggaccagcgattattacgacttcgggaagccccaaccttgtattgatccccgcggagtctccggcatcagcgccatgtgggggcagggaacaatggtgaccgtttcttcc

SEQ ID NO: 39903 - RNA, 438 nt, synthetic construct
  misc_feature 1..438: note = derived and/or modified sequence opt5 from anti-HIV_cap256-206-116098_VR-Chain
  source 1..438: mol_type = other RNA
cagatgatgctggtggagagcggcgggggagtcgttgaacccggcagatccctcaccctgtcttgcgccgctagccaattcacattttccaactacgggatgcactgggtgcggcaggcccctggacgcgagcttgaatgggtggcgtctatcagcaatgctggcaacaagaaatatcatggggaggccgtctggggaagactgattatctcccgggacaattctaagaacaccctcttcctgcacatgagcaatcttcgcccggatgactccgccctgtacttttgtgtgagagatcggcaggaagacgagtgcgaggaatggtggagcgattattacgctttcggccgcggcgggccctgtagaaaatatcatggacagggcctcgccgggatttttgacatctggggacggggcacgatggttacagtgtcttcc

SEQ ID NO: 39904 - RNA, 432 nt, synthetic construct
  misc_feature 1..432: note = derived and/or modified sequence opt5 from anti-HIV_cap256-206-115862_VR-Chain
  source 1..432: mol_type = other RNA
caggagcaactggtggaaagcggcgggggagtcgttccccctggcaagtccctcagactgtcttgcgtggggagccggttcaccttttccgccttcggaatgcactgggtgcgccaggctccgggcaaagggcttgagtgggtcgcctctatcagctttgcgggaacaaagaaatactatgtggactccgttaagggcagattctttatttctcgggataacagcaaaaatacggtgttcctggaaatgaacggcctccgcggggaggacaccggactgtactattgtgtcaaggatatgagagaacttgagtgcgaggaatgggcttccgactactatgattttggcaagccccagccttgtctggaccggcgcggggtgagcggaatctctgccatgtggggccaggggacactcgttattatctccagc

SEQ ID NO: 39905 - RNA, 435 nt, synthetic construct
  misc_feature 1..435: note = derived and/or modified sequence opt5 from anti-HIV_cap256-206-107018_VR-Chain
  source 1..435: mol_type = other RNA
caggagcaactggtggaaagcggcgggggagtcgttccccctggcaagtccctcaccctgtcttgcgtggccagccggttctccttttctgctttcgggatgcactgggtgcggcaggccccgggaaaaggccttgagtgggtcgcgagcatctcctttgtggggattaagaaatactatggagactctgttaagggccgcttctttatcagcagagataactccaaaaatacagtgttcctggaaatgaacggcctccgcggggaggacacgggactgtactattgtgtcaaggatatgcgggaacttgagtgcgaggaatgggctagcgactactatgattttggcaagcccaatcagccttgtctggacagaagaggggtgtctggaatttccgccatgtggggccaggggaccctcgttatcgtgagctct

SEQ ID NO: 39906 - RNA, 438 nt, synthetic construct
  misc_feature 1..438: note = derived and/or modified sequence opt5 from anti-HIV_cap256-206-098644_VR-Chain
  source 1..438: mol_type = other RNA
cagatgctgctcgtggagagcggcgggggagtcgttgaacccggcagatccctgaccctttcttgcgccgctagccaattcacattttccaactacgggatgcactgggtgcggcaggcccctggaggcgggctggagtgggtggcgtctatcagcaatgaaggaaacaagcgctatcatggcgagtccgtctggggcagattcgtgatttctcgggacaatagcaaaaacacgctctttctgcacatgtccacccttcgcccggatgacagcgctctgtacttctgtgttagagatcggcaggaagacgagtgcgaggaatggtggtctgattattacgcctttgggcgcggaggcccctgtagaaagtatcatgggcagggactcgccggcatcttcgacgtgtgggggcggggaacaatggtcaccggcctgttt

SEQ ID NO: 39907 - RNA, 417 nt, synthetic construct
  misc_feature 1..417: note = derived and/or modified sequence opt5 from anti-HIV_cap256-206-098135_VR-Chain
  source 1..417: mol_type = other RNA
caggagaagctggtggaaagcggcgggggagccgtccaacccggcgggtccctcagactgtcttgcgttgctagcggattcaccttttccggcttcgggatgcactgggtgcggcaggcccctggaaaaggccttgagtgggtggcgacaatctcttttagcggcatgaagaaatactatgggacgtccgctaagggacgcttctctatttacagagacaacagcaaaaataccctgtatctccagatggatggcctgcgggaaaaggacacagccctttactattgtgccaaggatctgcgctacctcgagtgcggggaatggtccacctattacccgcagccctgtctggacagacggggagtcagcggcatctctaacgtgtgggggcctggaacaatggttaccgtgtccagc

SEQ ID NO: 39908 - RNA, 435 nt, synthetic construct
  misc_feature 1..435: note = derived and/or modified sequence opt5 from anti-HIV_cap256-206-096276_VR-Chain
  source 1..435: mol_type = other RNA
caggagcaactggtggaaagcggcgggggagtcgttccccctggctcctctctcagactgagctgcgtggcctcccggttcaccttttctgctttcgggatgcactgggtgcgccaggccccgggaaagggccttgagtgggtcgcggggatcagctttgtgggaattaaaaagtactatgctgactccgttaaaggcagattcacaatctctcgggataacagcaagaatacgctgtttctccagatgaacggcctgcgcggggaagacaccggactttactattgtgtgaaagatatgagagagctggaatgcgaggagtggcggtccgactactatgatttcggcaagcccaatcagccttacctcgaccgcagaggggtcagcggaatttctgccttttggggccaagggacaatggtgaccgtttccagc

SEQ ID NO: 39909 - RNA, 438 nt, synthetic construct
  misc_feature 1..438: note = derived and/or modified sequence opt5 from anti-HIV_cap256-206-092794_VR-Chain
  source 1..438: mol_type = other RNA
cagatgatgctggtggagagcggcgggggagtcgttgaacccggcagatccctcaccctgtcttgcgccacaagccaattcacgttttccaactacgggatgcactgggtgcggcaggctcctggacgcggccttgagtgggtggcctctatcagcaatgaagggaacaagagatatcatggagagtccgtctggggccggttcattatctctcgcgacaatagcaaaaacaccctgtttctccacatgtccacactgagagcggatgacagcgctctttacttctgtgtgcgggatcgccaggaagacgagtgcgaggaatggtggtctgattattacgcctttggcagagggggaccgtgtcggaagtatcatggccaggggctggccggaattttcgacatcgttggccgcgggaccctcgtgacagtctccagc

SEQ ID NO: 39910 - RNA, 432 nt, synthetic construct
  misc_feature 1..432: note = derived and/or modified sequence opt5 from anti-HIV_cap256-206-086817_VR-Chain
  source 1..432: mol_type = other RNA
caggagcaactggtggaaagcggcgggggagtcgttccccctggcaagtccctcagactgtcttgcgccgctagcgggttctcctttggagccttcggcatgcactgggtgcggcaggcgccggggaaaggacttgagtgggtggctggcatctcttttgtcggcattaagtactattacgccgacagcgtgaaagggcgcttcaccatctccagagataactctaagaatacagtttttctgcagatgaacggactccggggcgacgatacggggcgctattactgtgtgaaagacatgagagaactggagtgcgaagagtggaccagcgattattacgacttcggaaagccccagccttgtattgatcggcgcggcgtctccgggatcagcgccatgtggggacaaggcacaatggtgaccatttcttcc

SEQ ID NO: 39911 - RNA, 432 nt, synthetic construct
  misc_feature 1..432: note = derived and/or modified sequence opt5 from anti-HIV_cap256-206-086446_VR-Chain
  source 1..432: mol_type = other RNA
caggagcaactggtggaaagcggcgggggagtcgttccccctggcaagtccctcagactgtcttgcgtggccagccggttcaccttttccgctttcgggatgcactgggtgcgccaggccccgggaaaaggccttgagtgggtcgcggggatctcttttgtgggaattaagaaatactatagcgacgctgttaagggcagattctacatctcccgggataactctaaaaatacactgtttctcgaaatgaacggcctgcgcggggacgatacggccagatattactgtgtgaaggaccttcgggagctggaatgcgaggagtgggccagcgattattacgacttcggaaagccccagccttgtctcgattcccgcggcgtcagcgggatttctgctatgtggggacagggcaccatggtgacagtttccagc

SEQ ID NO: 39912 - RNA, 432 nt, synthetic construct
  misc_feature 1..432: note = derived and/or modified sequence opt5 from anti-HIV_cap256-206-086180_VR-Chain
  source 1..432: mol_type = other RNA
caggagcaactggaagagagcggcgggggagtggttccccctggcaagtccctccggctgtcttgcgtcgccagccggttcaccttttccgctttcgggatgcactgggtgcgccaggccccgggaaaaggccttgaatgggtggcggggatctcttttgtcggaattaagaaatactatgctgacagcgtgaagggcagattcacaatctcccgggataactctaaaaatacgctgtttctccagatgaacggcctgcgcggggacgataccggactttacttctgtgttaaggacatgagagagctggaatgcgagcagtggacaagcgattattacgactttggcaagccccaaccttgtattgatcccagaggggtgtccggaatcagcgccatgtggggccaggggaccatggtcacagtgtcttcc

SEQ ID NO: 39913 - RNA, 435 nt, synthetic construct
  misc_feature 1..435: note = derived and/or modified sequence opt5 from anti-HIV_cap256-206-083708_VR-Chain
  source 1..435: mol_type = other RNA
caggagcaactggtggaaagcggcgggggagtcattccccctggccagtccctcagactgtcttgcgttgccagccggttcaccttttccgctttcgggatgcactgggtgcgccaggccccgggaaagggccttgagtgggtgtctagcgtctcctttgcggggatcaaaaagtactatgctgactctgtgaaaggaagattctttatcagccgggataactccaagaatacagttttcctggaaatgaacggcctccgcggcgaggacacggggctgtactattgtgtgaaagatatgagagaacttgagtgcgaggaatgggccagcgactactatgattttggaaagcccgaccagccttgtctggatcggcgcggcgtctctgggatttccgccatgtggggacaaggcaccctcgtgatcgttagctct

SEQ ID NO: 39914 - RNA, 432 nt, synthetic construct
  misc_feature 1..432: note = derived and/or modified sequence opt5 from anti-HIV_cap256-206-079556_VR-Chain
  source 1..432: mol_type = other RNA
caggagcaactggtggaaagcggcgggggagtcgttccccctggcaagtccctcagactgtcttgcgtggccagcgggttcaccttttccggattcggcatgcactgggtgcggcaggctccggggaaaggacttgagtgggtcgccggcatctcttttgtgggcattaagtactattacgcggacagcgttaaagggcgcttctccatctctagagataacagcaagaatacactgtttctccagatgaacggactgcggggcgacgatacggctctttattactgtgtgaaagacatgcgcgaactggagtgcgaagagtggacctccgattattacgacttcgggaagccccagccttgtattgatagacggggagtcagcggcatctctgccatgtgggggcaaggaacaatggtgaccgtttccagc

SEQ ID NO: 39915 - RNA, 438 nt, synthetic construct
  misc_feature 1..438: note = derived and/or modified sequence opt5 from anti-HIV_cap256-206-078657_VR-Chain
  source 1..438: mol_type = other RNA
cagatgctgctcgtggagagcggcgggggagtcgttgaacccggcagatccctgaccctttcttgcgccacaagccaattcacgttttccaactacgggatgcactgggtgcggcaggctcctggacgcggcctggagtgggtggcctctatcagcaatgaagggtccaagaaatatcatggagagccggtctggggcagattcattatctctcgggacaacagcaagaaaaccctctttctgcacatgtccaatcttcgcgtggatgacagcgcgctgtacttctgtgttagagatcggcaggaagacgagtgcgaggaatggtggtctgattattacgcttttggccgcgggggaccctgtagaaagtatcatggccaggggctcgccggaattttcgacatctggggccgggggacaatggtgaccgtctccagc

SEQ ID NO: 39916 - RNA, 438 nt, synthetic construct
  misc_feature 1..438: note = derived and/or modified sequence opt5 from anti-HIV_cap256-206-075802_VR-Chain
  source 1..438: mol_type = other RNA
cagatgctgctcgtggagagcggcggggacgtcgttgaacccggaaagtccctgaccctttcttgcgccacaagcagattcacgttttccaactacggcatgcactgggtgcggcaagctcctgggggaggcctggagtgggtggcctctatcagcaatgaagggaacaaaaagtatcatggagagtccgtctggggccgcttcattatctctagagataatagcaaaaacaccctctttctgcacatgtccgcgcttcggacagacgatagcgctctgtacttctgtgtgcgcgacagacaggaagatgagtgcgaggaatggtggtctgactattacgcctttggccgcgggggaccgtgtcggaagtatcatggccaggggctcgccggaattttcgatatctggggcagagggaccatggttacagtgtccagc

SEQ ID NO: 39917 - RNA, 438 nt, synthetic construct
  misc_feature 1..438: note = derived and/or modified sequence opt5 from anti-HIV_cap256-206-069097_VR-Chain
  source 1..438: mol_type = other RNA
cagatgctgctcgtggagagcggcgggggagtcgttgaacccggcagatccctgaccctttcttgcgccacaagccggttcacgttttccaactacgggatgcactgggtgcgccaagctcctggaagagagctggaatgggtggcctctatcagcaatgagggcaacaagaaatatcatgcggaatccgtctgggggcggttcattatctctcgcgacaatagcaagaacaccctctttctgcacatgtccaatgtgagaggagatgacagcgctctttacttctgtgttcgggatcgccaggaggacgagtgcgaagagtggtggtctgattattacgcctttggcagaggcgggccgtgtcggaaatatcatggacagggcctggccgggattttcgacgtgtggggacgcggcacagtcgtgaccgtttccagc

SEQ ID NO: 39918 - RNA, 438 nt, synthetic construct
  misc_feature 1..438: note = derived and/or modified sequence opt5 from anti-HIV_cap256-206-067758_VR-Chain
  source 1..438: mol_type = other RNA
cagatgctgctcgtggagagcggcgggggagtcgttgaacccggcagatccctgaccctttcttgcgccgctagccaattcacattttcccactacgggatgcattgggtgcggcaggcccctggacgcggcctggagtgggtggcgtctatcagcaacgaagggaataagagatatcacggagagtccgtctggggccggttcattatctctcgcgacaacagcaaaaatacgctctttctgcatatgtccgctcttagaaccgatgacagcgccctgtacttctgtgtgcgggatcgccaggaagacgagtgcgaggaatggtggtctgattattacgcctttggcagagggggaccgtgtcggaagtggcacggccaggggctcgctggaattttcgacatctggggccgcgggacagttgtgaccgtctccagc

SEQ ID NO: 39919 - RNA, 417 nt, synthetic construct
  misc_feature 1..417: note = derived and/or modified sequence opt5 from anti-HIV_cap256-206-057019_VR-Chain
  source 1..417: mol_type = other RNA
caggagaagctggtggaaagcggcgggggagccgtccaacccggcgggtccctcagactgtcttgcgttgctagcggattctccttttctggctacgggatgcactgggtgcggcaggcccctggaaaaggccttgagtggctggcgaccatcagcttctccggcgtgaagaaatattacgggacatctgctaagggacgcttttatatttacagagacaacacgaaaaataccatgtatctcgaaatgaacggcctgcgcggggaggatacagccctttactattgtgccaaggacctgcggtacctcgaatgcggagagtggagcacctactatccgcagccctgtctggatacaagaggcgtctccgggatcagcaatgtgtggggacctggcaccatggttacagtgtcttcc

SEQ ID NO: 39920 - RNA, 438 nt, synthetic construct
  misc_feature 1..438: note = derived and/or modified sequence opt5 from anti-HIV_cap256-206-055385_VR-Chain
  source 1..438: mol_type = other RNA
cagatgatgctggtggagagcggcgggggagtcgttgaacccggcagatccctcaccctgtcttgcgccgctagcaagttcacattttccaactacgggatgcactgggtgcggcaagcccctggacgcggccttgagtgggtggcgtctatcagcaatgaagggaacaaaaagtatcatggagagccggtctggggcagactgattatctcccgggacaattctaaaaacaccctcttcctgcacatgagcgatcttcgcgctgacgattccgccctgtacttttgtgtgagagaccggcaggaagatgagtgcgaggaatggtggagcaattattacgccttcggccgcgggggaccctgtagaaagtggcggggccaggggctcgctggaatttttgacgtttggggccgcgggacgatggtgacagtctcttcc

SEQ ID NO: 39921 - RNA, 435 nt, synthetic construct
  misc_feature 1..435: note = derived and/or modified sequence opt5 from anti-HIV_cap256-206-053187_VR-Chain
  source 1..435: mol_type = other RNA
caggagcaactggtggaaagcggcgggggagtcgttccccctggctcctctctcagactgagctgcgtggcctcccggttcaccttttctgctttcgggatgcactgggtgcgccaggccccgggaaagggccttgagtgggtcgcggggatcagctttgtgggaattaaatactattacgctgactccgttaagggcagattcacaatctctcgggataacagcaaaaatacgctgtttctccagatgaacggcctgcgcggggaagacaccggactttattactgtgtgaaggatatgagagagctggaatgcgaggagtgggcctccgactattacgatttcggcaaacccaatcagccttgtctcgaccggcgcggggtcagcggaatttctgccttttggggccaagggacaatggtgaccgtttccagc

SEQ ID NO: 39922 - RNA, 438 nt, synthetic construct
  misc_feature 1..438: note = derived and/or modified sequence opt5 from anti-HIV_cap256-206-053139_VR-Chain
  source 1..438: mol_type = other RNA
cagatgctgctcgtggagagcggcggggacgtcgttgaacccggaagatccctgaccctttcttgcgccacaagccaattcacgttttccaactacggcatgcactgggtgcggcaggctcctgggcgcggactggagtgggtggcctctatcagcaatgaaggctccaagaaatatcatggggagtctgtctggggaagattcattatcagccgggataactccaagaataccctctttctgcacatgacaacccttcgcccggacgatagcgcgctgtacttctgtgtgagagaccggcaggaagatgagtgcgaggaatggtggtctgactattacgcttttggccgcggcgggccctgtagaaaatatcatggacagggcctcgccgggattttcgatatctggggacggggcacaatggttaccgtgtccagc

SEQ ID NO: 39923 - RNA, 432 nt, synthetic construct
  misc_feature 1..432: note = derived and/or modified sequence opt5 from anti-HIV_cap256-206-050350_VR-Chain
  source 1..432: mol_type = other RNA
caggagcaactggtggaaagcggcgggggagtcgttccccctggcaagtccctcaaactgtcttgcgtggccagcagattctcctttggggctttcggaatgcactgggtgcggcaggccccgggcaaggggcttgagtgggtcgcgggaatctcttttgtgggcattaaaaagtactatgctgacagcgttaaaggccgcttctacatctccagagataactctaagaataccgtgtttctggaaatgaacgccctccgcggggaggacacagccctgtatcattgtgtcaaggatatgcgggaacttgagtgcgaggaatgggctagcgactactatgatttcggaaaaccccagccttgtctggacagacggggcgtgtccgggattagcgccatgtggggacccggcacgatggttatcgtgtcttcc

SEQ ID NO: 39924 - RNA, 432 nt, synthetic construct
  misc_feature 1..432: note = derived and/or modified sequence opt5 from anti-HIV_cap256-206-046207_VR-Chain
  source 1..432: mol_type = other RNA
caggagcaactggtggaaagcggcgggggagtcgttccccctggcacctccctcagactgtcttgcgtggccagccggttcacattttccgctttcgggatgcactgggtgcgccaggccccgggaaagggccttgagtgggtcgcggggatctcttttgctggaattaaaaagtactatgccgacagcgtgaaaggcagattcacgatctcccgggataactctaagaatagcctgtttctcgaaatgaacggcctgcgcggggacgataccgccctttactattgtgttaaagacctgagatacctcgagtgcgaactgtggacatccgattattacgacttcggacggccccagccttgtattgatagccgcggcgtgtctgggatctccgctatgtggggacccggcaccatggtcacagtgagcgcc

SEQ ID NO: 39925 - RNA, 417 nt, synthetic construct
  misc_feature 1..417: note = derived and/or modified sequence opt5 from anti-HIV_cap256-206-043389_VR-Chain
  source 1..417: mol_type = other RNA
caggagaagctggtggaaagcggcgggggagccgtccaacccggcgggtccctcagactgtcttgcgttgctagcggattcaccttttccggcttcgggatgcactggtttcggcaggcccctggaaaaggccttgagtgggtggcgacaatctctttcagcggcattaagaaatactataacacgtccgctaaggggcgctttttcatctctagagacaataccaaagatacactgtacctccagatggacggactgcaggaaaaggataccgccctttatctgtgtgccaaggacctccggtacctggagtgcggctattggagcacatactatccgcaaccctgtctggatacccgcggggtgtccggaattagcaacgtctggggccctgggacaatggtgaccgtttcttcc

SEQ ID NO: 39926 - RNA, 432 nt, synthetic construct
  misc_feature 1..432: note = derived and/or modified sequence opt5 from anti-HIV_cap256-206-042555_VR-Chain
  source 1..432: mol_type = other RNA
caggagcaactggtggaaagcggcgggggagtcgttccccctggcaagtccctcagactgtcttgcgtggtgagcgggttcaccttttccgccttcggaatgcactgggtccggcaggctccgggcaaagggcttgagtgggtggccggaatctcttttgcgggcacaaagagctactatgctgaatccgttaaaggccgcttcacgatttctagagacaacagcaaaaattccctgtttctccagatgaacgggctgcggggagatgacaccgccctttactattgtgtgaaggatatgcgcgagctggaatgcgagctctggacaagcgactactatgatttcggcagaccccagccttgtatcgaccggcgcggggtctctggaatttccgccatgtggggccaagggaccatggtgacaatcagctct

SEQ ID NO: 39927 - RNA, 432 nt, synthetic construct
  misc_feature 1..432: note = derived and/or modified sequence opt5 from anti-HIV_cap256-206-029720_VR-Chain
  source 1..432: mol_type = other RNA
caggagaagctggtggaaagcggcgggggagtcgttcaacccggcagatccctcaccctgtcttgcgtggccagccacttcacattttccggggtgggaatgcattgggtccggcaggctcctggcaaagggcttgagtgggtggccggaatctctttcgcgggcacgcgcaagtactatgctgacagcgttaaaggcagatttaccatttcccgggataactctaagaatacagtgtacctgcagatgaacgggctccgcggagaagacaccgccctgtatcactgtgccaaagatcttagagagctggaatgcgagctctggacaagcgactactatgatttcggccggccgcagccctgtatcgaccgcagaggggtctccggaatttgcgatatgtggggccaagggaccatggtgatcgttagctct

SEQ ID NO: 39928 - RNA, 432 nt, synthetic construct
  misc_feature 1..432: note = derived and/or modified sequence opt5 from anti-HIV_cap256-206-028848_VR-Chain
  source 1..432: mol_type = other RNA
caggagcaactggtggaaagcggcgggggagtcgttccccctggcaagtccctcagactgtcttgcgtggccagcgggttcaccttttccggattcggcatgcactgggtgcggcaggctccggggaaaggacttcagtgggtcgccggcatctcttttgcgggcacaaagtactattacgaggacagcgtgaaagggcgcttcacgatttccagagataactctaagaataccgtttttctgcagatgaacggactccggggcgacgatacagctctgtattactgtgtgaaagacatgcgcgaacttgagtgcgaagagtggaccagcgattattacgacttcgggaagccccaaccttgtatcgatagacggggagtctccggcattagcgccatgtgggggcagggaacaatggtgaccatctcttcc

SEQ ID NO: 39929 - RNA, 432 nt, synthetic construct
  misc_feature 1..432: note = derived and/or modified sequence opt5 from anti-HIV_cap256-206-027652_VR-Chain
  source 1..432: mol_type = other RNA
caggagcaactggtggtcagcggcggggacgttgtgccccctggaaagtccctcagactgtcttgcgtggccagcggcttcaccttttccgctttcgggatgcactgggtccggcaggccccgggaaaaggccttgaatgggtggcgtctatcagctttgctgggacaaagtactattacgccgattccgttaaaggacgcttcgccatttctagagacaacagcaagaatacgctgtttctccagatgaacggcctgcggcgcgaggataccggcctttattactgtgtgaaagacatgagacagctggaatgcgaggaatggacatccgattattacgacttcgggcggccccaaccttgtatcgatcgcagaggagtcagcggcatttctgctatgtgggggcagggaaccatggtgacaatctccagc

SEQ ID NO: 39930 - RNA, 417 nt, synthetic construct
  misc_feature 1..417: note = derived and/or modified sequence opt5 from anti-HIV_cap256-206-024075_VR-Chain
  source 1..417: mol_type = other RNA
caggagaagctggtggaaagcggcgggggagccgtccaacccggcgggtccctcagactgtcttgcgttgctagcggattcaccttttccggcttcgggatgcactgggtgcggcaggcccctggaaaaggccttgagtggctggcgacaatctcttttagcggcgtgaagaaatactatgggacgtccgctaagggacgcttctacatttctagagacaacaccaaaaatacagtctatctccagatggatggcctgcgcggggacgataccgccatctactattgtgccaaggaccttcggtttctggaatgcggactctggagcacatactatccgcagccctgtctggataccagaggcgtgtccgggattagcaacgtttggggacctggcacaatggtgaccgtctcttcc

SEQ ID NO: 39931 - RNA, 417 nt, synthetic construct
  misc_feature 1..417: note = derived and/or modified sequence opt5 from anti-HIV_cap256-206-008748_VR-Chain
  source 1..417: mol_type = other RNA
caggagaagctggtggaaagcggcgggggagccgtccaacccggcgggtccctcagactgtcttgcgttgctagcggattcacctttaacggcttcgggatgcactgggtgcggcaggcccctggaaaaggccttgagtgggtggcgacaatctccttttctggcgtcaagaaatactatgggacgagcgctaagggacgcttctttatttccagagaaaattctaaaaacaccctgtacctccagatgaatggcctgcgcggggaggacacagccctttattactgtgccaaggatctgcggtatctcgaatgcggagagtggagcacctactatccgcagccctgtctggacacaagaggcgtgtccgggatcagcaacgtttggggacctggcacccgggtgacagtctcttcc

SEQ ID NO: 39932 - RNA, 432 nt, synthetic construct
  misc_feature 1..432: note = derived and/or modified sequence opt5 from anti-HIV_cap256-206-008530_VR-Chain
  source 1..432: mol_type = other RNA
caggagcaactggtggaaagcggcgggggagtcgttccccctggcaagtccctcagactgtcttgcgtggccagcgggttctcctttggagctttcggcatgcactgggtgcggcaggccccggggaaaggacttgagtgggtcgcgggcatctcttttgtgggcattaagtactattacgctgacagcgttaaagggcgcttcaccatctccagagataactctaagaaaacactgtttctccagatgaatggactgcggggcgacgatacggccctttattactgtgtgaaggacatgcgcgaactggagtgcgaagagtggaccagcgattattacgacttcgggaagccccagccttgtattgatagacggggagtctccggcatcagcgccttttgggggcaaggaacaatggtgaccatttcttcc

SEQ ID NO: 39933 - RNA, 432 nt, synthetic construct
  misc_feature 1..432: note = derived and/or modified sequence opt5 from anti-HIV_cap256-176-723043_VR-Chain
  source 1..432: mol_type = other RNA
caggagcaactggtggaaagcggcgggggagtcgttccccctggcaagtccctccggctgtcttgcgtggccagcgggttcaccttttccgctttcggaatgcactgggtgcggcaggccccgggcaaagggcttgagtgggtcgcgggagtgtcttttgctggcatcaagtactattacgccgacagcgttaaaggccgcttcacaatttccagagataactctaagaatacgctgtttctccagatgaacgggctgcggggagacgataccgccctttattactgtgtgaaagacctgcgcgaactcgagtgcgaagagtggacaagcgattattacgacttcggcagaccccagccttgtatcgatcccagaggggtctccggaattagcgctatgtggggccaagggaccgtggttacaatctcttcc

SEQ ID NO: 39934 - RNA, 432 nt, synthetic construct
  misc_feature 1..432: note = derived and/or modified sequence opt5 from anti-HIV_cap256-176-600049_VR-Chain
  source 1..432: mol_type = other RNA
gaggtgcagctggtccaaagcggcgggggagttgtgcagcccggcagatccctccggctgtcttgcgccgctccttacttcgaatttgggcgctatggattccactgggtgagacaggccccgggcaaggggcttgagtgggtcgcgagcatctcctttgctggacggggctactatcattctcccagcgtgtggggccgcttcaccatttccagagacaactctaaaaatacactgtacctccagatgaacagcctgcggatcgaagatacggccctttatttttgtgcccgcgacctgagagagtccgaatgcgaggagtgggaaagcgattactatgacttcgggaagaaaggaccttgtgttaagccccggggcgtggctgggggactcgatctgtggggccaagggaccatggtcattgtgtcttcc

SEQ ID NO: 39935 - RNA, 432 nt, synthetic construct
  misc_feature 1..432: note = derived and/or modified sequence opt5 from anti-HIV_cap256-176-531926_VR-Chain
  source 1..432: mol_type = other RNA
caggtgcaactggtcgagagcggcgggggagttgtgccccctggcaagtccctcaccctgtcttgcgtggccagcagattcacattttccgctttcgggatgcactgggtccggcaggccccgggaaaaggccttgaatgggtggcggggatctcttttgttggcattcgcaagtactatgctgacagcgtgaaaggaagattctccatctctcgggataacagcaagaatacggtctttctggagatgaacggcctccgcggggaagacaccggactgtactattgtgtgaaagatatgagagagcttgaatgcgaggagtgggcctccgactactatgatttcggcaagccccagccttgtctggaccggcgcggggttagcggaatttctgccatgtggggccaggggacactcgtgatcatttccagc

SEQ ID NO: 39936 - RNA, 432 nt, synthetic construct
  misc_feature 1..432: note = derived and/or modified sequence opt5 from anti-HIV_cap256-176-504134_VR-Chain
  source 1..432: mol_type = other RNA
gaggtgcagctggtcgaaagcggcgggggagttgtgccccctggcaagtccctcagactgtcttgcgtgaccagccggcttgccttcggggcttttggaatgcactgggtccgccaagccccgggcaaagggctggagtgggtggcgtccatctctttcgctggaattaagaaatactatgccgacagcgttaagggcagatttacaatctcccgggataactctaaagacacggtgttcctcgaaatgaatggcctgcgcggggatgacaccggactttactattgtgtcaaggatatgagatacctggagtgcgaagagtgggccagcgactattacgattttggccggccccagccttgtctcgacccccgcggggtgtccggaattagcgctatgtggggccaggggacactggttatcatttcttcc

SEQ ID NO: 39937 - RNA, 432 nt, synthetic construct
  misc_feature 1..432: note = derived and/or modified sequence opt5 from anti-HIV_cap256-119-186229_VR-Chain
  source 1..432: mol_type = other RNA
cagatgcaactggtggagagcggcgggggagtcgttcagcccggcgggtccctcagactgctttgctctgccagcggattcaccttttccacatacggcatgcactgggtgcggcaggctcctgggaagggactggaatgggtggcctctatcagctatgacggctccgataaataccatgcgggcctcgtctgggggcgcttcattatctctagagacaacagcaagaatacgctgtatcttcagatgaactccctgcgggctgaggataccgccctctactattgtgtgcgcgacgaaagagagagcgaatgcgagctgtgggagtctgattactataattttggcaaaaagctgccgtgtgttaaaccccggggagtggccgggacactcgacatttggggacaaggcaccacagtcatcgtgtccagc

SEQ ID NO: 39938 - RNA, 432 nt, synthetic construct
  misc_feature 1..432: note = derived and/or modified sequence opt5 from anti-HIV_cap256-119-183891_VR-Chain
  source 1..432: mol_type = other RNA
caggtgcaactggtcgagagcggcgggggagttgtgcagcccggcgggtccctcagactgtcttgcgccgctagcggattcaccttttcctcttacggcatgcactgggtgcggcaggcccctgggaagggacttgaatgggtcgcgttcacacgctatgacggcagcgataaatactatctggactccgtgaagggcagatttacgatctctcgggataacagcaaatacaccctcttcctgcagatggtttcccttcgcacagaggacaccgctctgtatttttgtgccagagatctccgggaaagcgagtgcgaagagtgggagtcttactattacgacttcgggaagaaaggaccgtgtgtgaagccccgcggcgtcgtgggggttctggatatttggggacaaggcacactggtgaccgtctccagc

SEQ ID NO: 39939 - RNA, 435 nt, synthetic construct
  misc_feature 1..435: note = derived and/or modified sequence opt5 from anti-HIV_cap256-119-183631_VR-Chain
  source 1..435: mol_type = other RNA
caggtgcaactggtccagagcggcgggggagttgtgcagcccggcagatccctccggctgtcttgcgccgctagcaagttcaccttttccacatacacgcttcactgggtgcgccaggcccctgggaaaggactggagtgggtcgcggtgatctctcatgacggcgggaacagattctatgctgatagcgttaagggacggtttaccatttcccgcgacaattctaaaaacaatctcttcctgcaaatgaacagccttagagtggaagatacagccctgtactattgtgcccgggacctccgcgagatggaatgcgaggaatggaccctgtacaattattacgattttggctccagaggcccgtgtgtcgacccccggggagtggttgggagcttcgatgtgtggggccaggggacaatggtcaccgtgtcttcc

SEQ ID NO: 39940 - RNA, 432 nt, synthetic construct
  misc_feature 1..432: note = derived and/or modified sequence opt5 from anti-HIV_cap256-119-182676_VR-Chain
  source 1..432: mol_type = other RNA
caggtgcaactggtcgagagcggcgggggagttgtgcagcccggcaagtccctcagactgtcttgcgtggtcagcgggttcaccttttccaactaccctatgcactgggtgcggcaggccccgggaaaaggccttgaatgggttgcttctatcagcttcgccgggattaagaaatattacggagactccgtgaagggccgctttacaatctctagagataatagcaaaaacacgctgtatctccagatggacggcctgcgcggggaggataccgcgctttactattgtgctaaggacctgcgggaactcgagtgcgaagagtgggcctccgattactatgacttcggaagaccccaaccttgtctggatccccggggcgtcagcgggatttctaatgtgtggggacagggcacaatggttaccgtgtccagc

SEQ ID NO: 39941 - RNA, 432 nt, synthetic construct
  misc_feature 1..432: note = derived and/or modified sequence opt5 from anti-HIV_cap256-119-180772_VR-Chain
  source 1..432: mol_type = other RNA
caggtgcaactggtcgagagcggcgggggagttgtgcagcccggcagatccctccggctgtcttgcgccgctagcgagttcaccttttccaactacgccatgcactgggtgcgccaggcgcctgggaagggacttgaatgggtcgcttctatcagcttcgacggcagagataaatatcattcctctctggtgtgggggcggctcacaattagccgcgacaattccaagagcacgctgtttcttcagatgaactctctgagaccggaagataccgccctctactattgtgcccgggacgttcgcgagtccgaatgcgaggagtggcaaagcgattactatgctttctacagaaaactgccctgtgtgaagcctcggggagtcgccggcacactggacatctggggccaggggaccatggtgacagtttcttcc

SEQ ID NO: 39942 - RNA, 435 nt, synthetic construct
  misc_feature 1..435: note = derived and/or modified sequence opt5 from anti-HIV_cap256-119-180508_VR-Chain
  source 1..435: mol_type = other RNA
caggtgcacctggtcgagagcggcgggggagttgtgcaacccggcagatccctccggctgtcttgcgccgctagccatttctccctttctagctacgggatgcactgggtgcgccagacccctggaaagggcctggaatgggtcgccgggatctcctttgcgggagtgaaaacatattacggcacgtctgttaagggcagattcaccattagccgggacaactccaaaaataacctctatctgcagatgaatagccttcgcccggaggatacagctctgtactattgtgccagagacctccgggaaatggagtgcgaagagtggaagctgtacaactattacgattttcgcaccagagggccctgtgtggaccctcggggagtcgtgggctctttcgatgtttgggggcagggaacagtggtcaccgtgtccagc

SEQ ID NO: 39943 - RNA, 432 nt, synthetic construct
  misc_feature 1..432: note = derived and/or modified sequence opt5 from anti-HIV_cap256-119-180260_VR-Chain
  source 1..432: mol_type = other RNA
gaggtgcagctggtcgaaagcggcgggggagttgtgagacccggcgggtccctccggctgtcttgcgccgctagccaattcaccttttccaatttcggaatgcactgggtgcgccaggcccctggcaaggggcttgagtgggtcgcgtctatcagctttgtgggaattaaaacacattacgctaattccgttagaggccggttcacgatctctcgcgaccagagcaagaacaccctgtatctccagatgaactccgtgagagtcgaagatacaggccggtactattgtgcccgcgacatgagagagtacgaatgcgagctgtgggccagcgattattacgactttgggaaaccgcaaccctgtgaggatcctcggggagtggttggcaccttcgacatgtgggggcttggaacactggtgaccgtctcttcc

SEQ ID NO: 39944 - RNA, 432 nt, synthetic construct
  misc_feature 1..432: note = derived and/or modified sequence opt5 from anti-HIV_cap256-119-180173_VR-Chain
  source 1..432: mol_type = other RNA
gaggtgcagctggtcgaaagcggcgggggactcgttcaacccggcgggtccctgagactttcttgcgccgctagcggattcaccgtgtcctctaactacatgagctgggtgcggcaggcccctggcaaggggctggagtgggtcgcgtccatctcttttgctggaacgaaaaagcactatggcaatagcgtgaaaggccgcttcacaatttccagagacaacagcaagaataccctctacctgcagatgaactctcttcgcggggaagatacagccctgtattactgtgccaaagacctccgggagtatgaatgcgaggagtggacctccgattactatgactttggaagaccgcagccctgtatcgatagccggggcgttgtggggattctggacatctggtctcaaggaacaatggtcaccgtgtccagc

SEQ ID NO: 39945 - RNA, 432 nt, synthetic construct
  misc_feature 1..432: note = derived and/or modified sequence opt5 from anti-HIV_cap256-119-179839_VR-Chain
  source 1..432: mol_type = other RNA
caggtgcaactggtcgagagcggcgggggagttgtgcagcccggcagatccctccggctgtcttgcgccgctagcgggttctcctttggaacctctgacgtgcactgggtccgccaggcccctggcgaagggcttgagtgggtggcgctgatcagcttcgatggaagacagaaggacctcgctgattccgttcggggccgctttacaatttctagagacagctccaaaaacacgctgtaccttgaaatgaatagcctgcggccggaggataccgccctctattactgtgccaaggacatgcgcggctatgaatgcgaggagtggacatctgattactatgacttcgggagaccccaaccttgtatcgattcccggggagtggtcggcacctttgacgtgtgggggcagggaacaatggttaccgtgagctct

SEQ ID NO: 39946 - RNA, 423 nt, synthetic construct
  misc_feature 1..423: note = derived and/or modified sequence opt5 from anti-HIV_cap256-119-179262_VR-Chain
  source 1..423: mol_type = other RNA
caggtgcaactggtcgagagcggcgggagagttgtgcagtccggaggctctctccggctgagctgcggggcctccggattctcttttaccacaagcgctatgcactgggtgcgccaggcccccggcaaggggcttgaatgggtcgcgatcaacggagctaataaacattacgccgagtccgtgaagggcagattcacgatttctcgggacaacagcaaaaataccctgtttctcgaaatgaactccctgcgccctgatgacacagccctttatttctgtgttaaggatcagagagaggacgaatgcgaggagtggtggagcgattactatgactttggccgggaacaaccgtgtctggatccccgcggggtggtcggaatcttcgacctctggggccaggggaccatggtgacagtttcttcc

SEQ ID NO: 39947 - RNA, 432 nt, synthetic construct
  misc_feature 1..432: note = derived and/or modified sequence opt5 from anti-HIV_cap256-119-178995_VR-Chain
  source 1..432: mol_type = other RNA
caggtgcaactggtcgagagcggcgggggagttgtgcagcccggcaagtccctcagactgtcttgcgccgctagcgggttcacccttacacggtttgccatgcactgggtgcgccaggcgcctggaaaaggcctggaatgggtcgctgtgatctggtacgacgggtccaacaagtattacgccgattctgttaaaggaagattcacggtgagccgggacaattccaagaacaccctctatctgcagatgaactctcttcgcacagaggataccgccctgtactattgtgtcagagaccggcgcgaaagcgagtgcgaactctgggagtccgattactataattttggcagacggctgccgtgtgtgaaaccccgcggcgttgctgggattctggacatctggggacaaggcacaaccgtgacagtcagccct

SEQ ID NO: 39948 - RNA, 432 nt, synthetic construct
  misc_feature 1..432: note = derived and/or modified sequence opt5 from anti-HIV_cap256-119-178455_VR-Chain
  source 1..432: mol_type = other RNA
gaggtgcagctggtcgaaagcggcgggggactcgttcaacccggcgggtccctgagactttcttgcgtggtgagcggattcaccttttccaacttctggatgtcttgggtccggcaggcccctggcaaggggctggagtgggtggctagcatctcctacgacggacgcgataaatatcactctagcctcgtttggggcagactgacaatttcccgggacaatagcaagtctacgctttttctgcagatgaactccctccgcgccgaagataccgcgctgtactattgtgctagagacctgcgggagagcgaatgcgaggagtggcagtctgattactatgccttctacaaaaagctcccgtgtgtgaaaccccgcggcgtcgccgggacactggacatctggggacaaggcaccatggtgacagtttccagc

SEQ ID NO: 39949 - RNA, 438 nt, synthetic construct
  misc_feature 1..438: note = derived and/or modified sequence opt5 from anti-HIV_cap256-119-177993_VR-Chain
  source 1..438: mol_type = other RNA
caggtgcacctggtcgagagcggcgggggagttgtgcaacccggcaagtccctcagaatctactgcgccgtgtctgagttcacctttagcaactatgctatgcattgggtccggctggcccctgggcgcggacttcagtggctggcggtgatttcctacgacggctctaaaaagtattacgctgatagcctcgaagggagattcacaatctccaaagacaattctaagaacacgctgtttcttcagatgaatagcctgcgggttgaagataccgccctctatttctgtgtgaaagaccagcgcgaggatgaatgcgaggagtggtggtccgactactatgattttggagaaagagccccgctgcccaaggtccctggccccggccctgggtggaacctggacatgtggggacacggcacaatggtgaccgttagctct

SEQ ID NO: 39950 - RNA, 438 nt, synthetic construct
  misc_feature 1..438: note = derived and/or modified sequence opt5 from anti-HIV_cap256-119-177727_VR-Chain
  source 1..438: mol_type = other RNA
caggtgcaactggtcgagagcggcgggggagttgtgcagcccggcagatccctccggctgtcttgcgccgctagcgggttcaccctttcccgctacgacatgcactgggtgagacaggcccctggaaagggcctggaatgggtcgcgtctatcagcaaagatgggacaaagaaatatcatggagactccgtgtggggccggtttattatctctcgcgataacagcaagaataccctcttcctgcagatgtccagccttagagctgaggacacggccctgtacttttgtgttcgggatcaacgcgaagccgagtgcgaagagtggtggtctgactattacgatttcggcagagagctcccgtgtcggaaatttcgcgggctgggactggctggcattttcgacatctgggggcacggaacaatggtgaccgtctccagc

SEQ ID NO: 39951 - RNA, 432 nt, synthetic construct
  misc_feature 1..432: note = derived and/or modified sequence opt5 from anti-HIV_cap256-119-176746_VR-Chain
  source 1..432: mol_type = other RNA
gaggtgcagctggtcgaaagcggcgggggactcgttcaacccggcgggtccctgagactttcttgcgccgctagcgacttcacctttgatgactacgccatgcactgggtgcggcaggcgcctggaaagggcctggagtgggtcgggggaatctcctatgatggctctgacaaataccatacaaacagcgtgtggggccgcttcattgtgtccagagataattctaagaacacgctctatctgcagatgaatagccttcggccggaagacaccgctctgtactattgtgttcgcgatagacgggagtccgaatgcgaggagcgctggagcgactactatgattttgggaaacagctcccctgtgtgaagcctagaggagtcgccggcatcttcgacatttgggggcaaggaacaatggtgaccgtttcttcc

SEQ ID NO: 39952 - RNA, 432 nt, synthetic construct
  misc_feature 1..432: note = derived and/or modified sequence opt5 from anti-HIV_cap256-119-176241_VR-Chain
  source 1..432: mol_type = other RNA
caggtgcaactggtcgagagcggcgggggagttgtgcagcccggcagatccctccggctgtcttgcgccgctagcgggttcaccttttccaactacgccatgcactgggtgcgccaggcgcctggaaagggccttgaatgggtcgctgtgatctcttatgacgggagcaataaatactatgccgattccgttaagggaagattcacaatttctcgggacaacagcaaaaatacgctgtacctccagatggatggcctgcgcggcgaggacaccgccctttattactgtgctaaggatctgagagaactcgagtgcgaagagtgggcctccgactattacgattttgggcggccgcaaccctgtctggaccctcgcggagtgagcggcatctctaacgtctgggggcagggaacaatggtgaccgtttccagc

SEQ ID NO: 39953 - RNA, 432 nt, synthetic construct
  misc_feature 1..432: note = derived and/or modified sequence opt5 from anti-HIV_cap256-119-175215_VR-Chain
  source 1..432: mol_type = other RNA
caggtgcaactggtcgagagcggcgggggagttgtgcagcccggcagatccctccggctgtcttgcgccgtgagccagttcacctttgggcgctacggaatgtattgggtcagacaggctcctggcaaggggcttgaatgggtggccggaatctcctacgacggctctgataaatatcacacaaacagcgtttggggccggttcattgtgtcccgcgacaattctaagaacatgctgtacctccaaatgaataacctgagaccggaggatacggcgctttattactgtgtccgggaccgcagagaaagcgagtgcgaggaacggtggtccgattattacgactttgggaaacagctgccctgtgtgaagcctcgcggagttgctggcatcttcgatatttgggggcagggaaccatggtgacagtcagctct

SEQ ID NO: 39954 - RNA, 432 nt, synthetic construct
  misc_feature 1..432: note = derived and/or modified sequence opt5 from anti-HIV_cap256-119-173928_VR-Chain
  source 1..432: mol_type = other RNA
ggcgtggagctgctcgaaagcgggggaggcctggtcgagcccgggggatcccttagactgtcttgcgttggcagccagttctcctttgaccggtacgggatgcactgggtgcgccaagcccctggaaagggcctcgaatgggtggctgccgtctctttcgatggcaccgacaaatatcatgcggatgacgtgtgggggagatttacaatcagccgggataactccaagaatacgctgtaccttcagatgaactctctgcgcgctgaggacaccgccctctattactgtgccaaagatctgagagaagacgagtgcgaggaatggtggagcgattattacgacctgggaaagcagctcccgtgtcggaaatcccgcggcgttgctggggtgctggataagtggggacttggcacaatggtcaccgtgagctct

SEQ ID NO: 39955 - RNA, 432 nt, synthetic construct
  misc_feature 1..432: note = derived and/or modified sequence opt5 from anti-HIV_cap256-119-173495_VR-Chain
  source 1..432: mol_type = other RNA
caggtgcaactggtcgagagcggcgggggagttgtgcagcccggcaagtccctcagactgtcttgcgccgctagccggttcacctttaaccgctacgggatgcactgggtgagacaggcccctggaaaaggccttgaatgggtcgcggctatctccttcgacgggacagataagtatcattctgacgatgtgtggggacggtttacgattagccgcgacaattccaaaaacaccctgtacctccagatgaactctctgagagccgaggatacagccgtttattactgtgctaaggaccttcgggaagatgagtgcgaggaacgctggagcgactattacgatttcggcaaacaactgccgtgtagaaagtcccggggcgtggccgggatctttgacaattggggacagggcaccatggtcacagtgagctct

SEQ ID NO: 39956 - RNA, 432 nt, synthetic construct
  misc_feature 1..432: note = derived and/or modified sequence opt5 from anti-HIV_cap256-119-172882_VR-Chain
  source 1..432: mol_type = other RNA
caggtgcaactggtcgagagcggcgggggagttgtgcagcccggcagatccctcaccctgtcttgcgaagtgagcgggttcacatttaagacgtacggaatgcactgggtccggcaggcccctggcaaagggcttgagtgggtggcttccatctcttatgacggaagcgataagtaccatgccgaccgcgtttggggcagattcaccatttcccgggataactctaaaaatacactgtatctccagatgaacagcctgcgcgcggaagacaccgctctttactattgtgtgagagatgcccgggagtccgaatgcgagctgtgggagagcgactactataattttggccgcaagctcccgtgtgtcaaacccagaggggtggccggaacactggatatctggggccaagggaccatggttacagtgtcttcc

SEQ ID NO: 39957 - RNA, 432 nt, synthetic construct
  misc_feature 1..432: note = derived and/or modified sequence opt5 from anti-HIV_cap256-119-172429_VR-Chain
  source 1..432: mol_type = other RNA
gaggtgcagctggtcgaaaccggcgggggactcatccaacccggcgggagcctgagactttcctgcgttgcctctcagttcacatttagcggatgtggcctgcactgggtgcggcaggctcctgggaagggactcgagtgggtggcctccatttctttcgcgggcacgaaaaagcattacggcaacagcgtcaaagggcgctttaccatctccagagacaattctaagaacacactgtatcttgaaatgaataccctgcgggctgaggatacagccctctactattgcgccaaagacctgcgcgaatacgagtgtgaggaatggaccagcgattattacgacttcggaagaccgcagccctgcattgattcccggggcgtggttgggatcctggacatttggggacaaggcacaatggtgagcgtctcttcc

SEQ ID NO: 39958 - RNA, 432 nt, synthetic construct
  misc_feature 1..432: note = derived and/or modified sequence opt5 from anti-HIV_cap256-119-172223_VR-Chain
  source 1..432: mol_type = other RNA
caggtgcaactggtcgagagcggcgggggagttgtgcagcccggcagatccctccggctgtcttgcgccgctagcgggttcaccttttcctcttacgccatgcactgggtgcgccaggcgcctggaaagggccttgaatgggtcgctgtgatcagctatgacgggagagatttctaccatgcccggtccgtttggggacgctttacaatttctagagacaacagcaaaaatacgctgcacctccagatgaactccctgcggccggaggataccgccctttatttctgtgctcgcgacctgagagaaagcgagtgcgaagagtgggagtcttactattacgattttggcaagaaagacccctgtgtgaagcctcggggcgtcgtgggggttctcgatatctggggacaaggcacactggtgaccgtctccagc

SEQ ID NO: 39959 - RNA, 432 nt, synthetic construct
  misc_feature 1..432: note = derived and/or modified sequence opt5 from anti-HIV_cap256-119-171838_VR-Chain
  source 1..432: mol_type = other RNA
caggtgcaactgggcgagagcgggggaggcgtcgttcagcccgggcggtccctccggctgtcttgcgccgctagcggattcaccttttccacattcgccatgcactgggtgcgccaggcgcctggcaaggggcttgaatgggtggctgtcatctcttacgacggaagcaacaaatattacgccgattccgtgaagggcagatttgccatttctcgggacaatgctaaaaacctgctccatctgcagatgaatagccttcgcccggaggatacggccctgtattactgtgctaaggacctccaagaagatgagtgcgaagagtggtggtccgactattacgatttcggcaaacagctgccctgtagaaagagcagaggggttgccggaatctttgacgattggggccaggggaccatggtgacagtctcttcc

SEQ ID NO: 39960 - RNA, 432 nt, synthetic construct
  misc_feature 1..432: note = derived and/or modified sequence opt5 from anti-HIV_cap256-119-171587_VR-Chain
  source 1..432: mol_type = other RNA
gaggtgcagctggtcgaaagcggcgggggactcgttcaacccggcgggtccctgagactttcttgcgccgctagcggattcaccttttccgactactatatgtcttggatccggcaggcccctggcaaggggctggagtgggtggcgagcatttccttcgctggaacaaaacagcactacggcaactctgtgaagggccgctttacgatcagcagagataattccaaaaacaccgtctatctccagatgaatagcctgcggcttgaagacacagccctgtactattgtgccaaggatctccgcgagtacgaatgcgaggagtggacctctgactattacgatttcgggagaccgcaaccctgtattgactcccggggagtggttggcatcctggatatttgggggcagggaacaatggtgaccgtcagctct

SEQ ID NO: 39961 - RNA, 432 nt, synthetic construct
  misc_feature 1..432: note = derived and/or modified sequence opt5 from anti-HIV_cap256-119-169596_VR-Chain
  source 1..432: mol_type = other RNA
ctggtgcagctcgtcgagagcggcgggggagttgtgcaacccggcagatccctgcggctttcttgcaccgccagcgggttcacattttcctctttcgctatgcaccgcgtgagacagacgcctggaaagggcctggaatgggtcgccagcatctcctacgacgggtctgataaatatcatgcggaccgggtgtggggacgctttaccattagcagagataactccaagaatacactctacctgcagatgaacagccttcgggctgaggacaccgccctgtattactgtgttcgcgatgccagagaatctgagtgcgaactctgggagtccgactattacaatttcggccggaaactgccgtgtgtgaagccccgcggcgtcgctgggacactggatatctggggacagggcaccatggtgacagttagctct

SEQ ID NO: 39962 - RNA, 432 nt, synthetic construct
  misc_feature 1..432: note = derived and/or modified sequence opt5 from anti-HIV_cap256-119-169523_VR-Chain
  source 1..432: mol_type = other RNA
caggtgcaactggtcgagagcggcgggggagttgtgcagcccggcgaatccctccggctgtcttgcgccgctagcgggttctcctttggaacctctgacgtgcactgggtccggcaggcccctggcgaggggcttgaatgggtggcgagcatctccttcgctggaattaagaaatactatggcgattctgttaagggccgctttacaatcagcagagacaactccaaaaatacgctgtacctccagatggatgggctgcggggagaggacaccgccctttattactgtgccaaggatctgcgcgaactcgagtgcgaggaatgggctagcgactattacgatttcggcagaccgcaaccctgtctggaccctagaggggtgtctggaatttccaacgtctggggccaggggacaatggtgaccgttagctct

SEQ ID NO: 39963 - RNA, 432 nt, synthetic construct
  misc_feature 1..432: note = derived and/or modified sequence opt5 from anti-HIV_cap256-119-169462_VR-Chain
  source 1..432: mol_type = other RNA
gaggtgcagctggtcgaaagcggcgggggactcgttcaacccggcgggtccctgagactttcttgcgccgctagcggattcacctttacaacgtactccctgcactgggtgcggcagtctcctggcaaggggctcgagtgggtggccgcgatcagcttcgctggaaccaaagaaaactatgccaattccgtccgcggcagatttacaatttctcgggacaacagcaagaataccctgtaccttcagatgaactccctgcgcgccgaggatacagctctctattactgtaccaaagacatgagagaatatgagtgcgaggaatggacaagcgattactatgacttcggccggccgcagccctgtatcgattctcgcggggtggttggaacctttgacgtgtggggccaagggacgatggtcaccgtgtccagc

SEQ ID NO: 39964 - RNA, 432 nt, synthetic construct
  misc_feature 1..432: note = derived and/or modified sequence opt5 from anti-HIV_cap256-119-169092_VR-Chain
  source 1..432: mol_type = other RNA
gaggtgcagctggtcgaaagcggcgggggactcgttcaacccggcgggtccctgagactttcttgcgtgatcagcggattcaccttttcctcttacgagatgaactgggtgcggcaggcccctggcaaggggctggaatgggtcgctggaattagctatgacggccgcgataaataccacgcccatttcgtgtggggcagaatcacaatttcccgggacaattctaagaacacgctctatctgcagatgaatagccttcgcgcggaggataccgctctgtaccactgtgttagagacctccgggaatccgagtgcgagctgtgggaaagcgattattacgactttgggaaaaagctgccgtgtgtgaaaccccgcggagtcgccggcatcttcgatctctgggggcagggaacaatggtgaccgtttcttcc

SEQ ID NO: 39965 - RNA, 432 nt, synthetic construct
  misc_feature 1..432: note = derived and/or modified sequence opt5 from anti-HIV_cap256-119-168680_VR-Chain
  source 1..432: mol_type = other RNA
caggtgcaactggtcgagagcggcgggggagttgtgcagcccggcagatccctccgggtgtcttgcgccgctagccacttcaccttttcccgctacgggatgcattgggtcagacaggcccctggaaagggcctggaatgggtggcgtctatcagctatgacgggcgggatttctaccacgctcgctccgtttggggaagatttgccatttctcgggacaacagcaaaaatacacttcatctgcagatgaactccctccgcacggaggataccgccctgtatcactgtgtgagagaccttcgggaaagcgagtgcgaactgtgggagtctgattactatgacttcggcaagaaactcccgtgtgtcaagccccgcggcgtggctgggacatttgatctgtggggacaaggcaccatggttacagtgtccagc

SEQ ID NO: 39966 - RNA, 438 nt, synthetic construct
  misc_feature 1..438: note = derived and/or modified sequence opt5 from anti-HIV_cap256-119-166385_VR-Chain
  source 1..438: mol_type = other RNA
caggtgcaactggtcgagagcggcgggggagttgtgcaccccggcagatccctccggctgtcttgcgccgctagcgggttctcctttggaaacttcggcatgcattgggtgcgccaggcccctgggaagggacttgaatgggtcgcgtctatcagcaatgacggcaccaaaaagtaccacgctgagtccgtgtgggatagattttctattagcaaagacaactccaagaatacactgttcctccagatgaacagcctgcgggttgaagatacggccctttatttttgtgtgaaagaccagcgcgaggatgaatgcgaggagtggtggtctgactactatgatttcggcagagaactgccgtgtcggaagtcccgcgggctcggactggccggcatctttgacatgtgggggcatggaaccatggtcacagtgagctct

SEQ ID NO: 39967 - RNA, 432 nt, synthetic construct
  misc_feature 1..432: note = derived and/or modified sequence opt5 from anti-HIV_cap256-119-165943_VR-Chain
  source 1..432: mol_type = other RNA
gaggtgcagctggtcgaaagcggcgggggactcgttcaacccggcagatccctgcggctttcttgcgccgtgagcgggttcaccgtgtcctctaactacatgagctgggtccgccaggctcctggaaagggcctggagtgggtggcctccatctcttttgcggggattaaaaagtattacggagacagcgttaaaggcagattcacaatctcccgggataatagcaagaacacgctctatctgcagatggacggccttcgcggggaagataccgctctgtactattgtgccaaagacctcagagagctggaatgcgaggagtgggcctctgattactatgactttggacggccgcagccctgtctggatcctcgcggcgtgtccgggattagcaatgtctggggacaaggcacaatggtgaccgtttcttcc

SEQ ID NO: 39968 - RNA, 432 nt, synthetic construct
  misc_feature 1..432: note = derived and/or modified sequence opt5 from anti-HIV_cap256-119-165738_VR-Chain
  source 1..432: mol_type = other RNA
gaggtgcagctggtcgaaagcggcgggggactcgttcaacccggcagatccctgcggctttcttgcgccgctagcgggttcacctttgacgattacgccatgaactgggtgcgccaggcgcctggaaagggcctggagtgggtggctacaatctccttcgacgggacggataaatatcacgccgacgatgtctggggaagatttaccatttctcgggacaatagcaagaaaacactctacctgcagatgaactcccttcgcgccgaagataccgctctgtattactgtgccaaggacctcagagaggatgaatgcgaggagtggtggtctgactattacgatctgggcaaacagctgccgtgtcgcaagagccggggcgtggctggggttctcgacaagtggggactgggcacaatggtgaccgtctccagc

SEQ ID NO: 39969 - RNA, 432 nt, synthetic construct
  misc_feature 1..432: note = derived and/or modified sequence opt5 from anti-HIV_cap256-119-164913_VR-Chain
  source 1..432: mol_type = other RNA
caggaccacctggtggagagcggcgggggaggcgtccaacccgggaagtccctcagactgtcttgcgccgctagcggattcaccttttccgcccatgcgatgcactgggttcggcaggctcctggcaaagggccggaatgggtggccgtgatctctcatgatggaggccagcagttctaccgcgagagcgtcaagggcagatttacaatttcccgggacaactctaaaaatacgctttatctgcaaatggatgggctccgcggagaagacaccgccctgtactattgtgctaaggatcttagagagctggaatgcgaggagtgggccagcgactactatgatttcggccggccccagccttgtctcgacccccgcggggtgtccggaatcagcaacgtttggggccaggggacaatggtgaccgtctcttcc

SEQ ID NO: 39970 - RNA, 432 nt, synthetic construct
  misc_feature 1..432: note = derived and/or modified sequence opt5 from anti-HIV_cap256-119-164167_VR-Chain
  source 1..432: mol_type = other RNA
gaggtgagactggtcgaaagcggcgggggactcatccagcccggcgggtccctgcggctttcttgcgccgctagcggactgaccgtttcctctaatcacatgagctgggtgcgccaagcccctggcaaggggctcgagtgggtggcgtccatttcttacgacggaagagatttctatcatgctcggagcgtctggggccgctttacaatctccagagacaatagcaaaaacacgctgcaccttcagatgaactctctgcggccggaagataccgccctctacttctgtgcccgcgacctgagagagtccgaatgcgaggagtgggaaagctattactatgattttggcaagaaagggccctgtgtgaagcctcggggagttgtgggcgtcctggacatttgggggcagggaacactcgtgaccgtttcttcc

SEQ ID NO: 39971 - RNA, 432 nt, synthetic construct
  misc_feature 1..432: note = derived and/or modified sequence opt5 from anti-HIV_cap256-119-163558_VR-Chain
  source 1..432: mol_type = other RNA
cagatgcaactggtggagagcggcgggggagtcgttcagcccggcagatccctcaccctgtcttgcgccgctagccagttcaactttgccaattacgggatgcactgggtgcggcaggcgcctggaaagggccttgaatgggtggcttccatctcttatgacgggagcgataaataccatgccgaccgcgtctggggaagattcacaatttcccgggataactctaagaatacgctgtatctccaaatgaacagcctgcgcgccgaggacaccgctctttactattgtgtgagagatgcccgggaatccgagtgcgaactgtgggagagcgactactataattttggccgcaaactcccgtgtgttaagcccagaggcgtggctgggacactggatatctggggacagggcaccatggtcacagtgtcttcc

SEQ ID NO: 39972 - RNA, 432 nt, synthetic construct
  misc_feature 1..432: note = derived and/or modified sequence opt5 from anti-HIV_cap256-119-162043_VR-Chain
  source 1..432: mol_type = other RNA
caggtgcaactggtcgagagcggcgggggagttgtgcagcccggcagatccctccgggtgtcttgcgccgctagccacttcaccttttcccgctacgggatgcattgggtcagacaggcccctggaaagggcctggaatgggtgacagggatctctttcgcggctacgaaaacctattacggagacagcgttcggggccgctttacagtgtccagagatatttctaagaacaccctttatctgcagatgaatagcctccggccggaggacacagccatgtactattgtgcccgcgatcaaagatactatgaatgcgaggaatgggcttccgactactacgatttcggccgggagcagccctgtcaggaccctcgcggggtcgtgggaatcctggatctttggggccaggggaccatggttacagtgagctct

SEQ ID NO: 39973 - RNA, 432 nt, synthetic construct
  misc_feature 1..432: note = derived and/or modified sequence opt5 from anti-HIV_cap256-119-161718_VR-Chain
  source 1..432: mol_type = other RNA
caggtgcaactggtcgagagcggcgggggagttgtgcagcccggcaagtccctcagactgtcttgcgccgctagccacttctcctttaatcggtacgggatgcattgggtgcgccaggcccctggaaaaggccttgaatgggtcgcggctatctcttatgacgggaccgataagtaccacgccgaccaggtgtggggaagattcacaattagccgggataattccaaaaacacgctgtatctccaaatgaactctctgcgcccggaggacaccgccctttactattgtgctaaggatctgagagaagacgagtgcgaagagtggtggagcgattactatgacctcggcaaacagctgccctgtcggaagtcccgcggcgttgccgggatctttgataagtggggacagggcacaatggtgaccgtcagctct

SEQ ID NO: 39974 - RNA, 432 nt, synthetic construct
  misc_feature 1..432: note = derived and/or modified sequence opt5 from anti-HIV_cap256-119-161675_VR-Chain
  source 1..432: mol_type = other RNA
caggtgcaactggtcgagagcggcgggggagttgtgcagcccggcagatccctccggctgtcttgcaccgccagcgggttcacattttccatctactctatgaactgggtgcgccaggctcctggaaagggccttgactgggtcgccgggattagcttcgcggctacgaaaacctattacggaggctccgtgaagggcagatttacagtttctcgggatatcagcaaaaataccctgtatctccagatgaactccctgcgcccggaagacacagccatgtactattgtgccagagatcaacggtactatgagtgcgaagagtgggctagcgactactacgatttcgggcgcgaacagccctgtcaggaccctagaggagtggtcggcgtgtttgatatgtgggggcagggaaccatggttacagtgtcttcc

SEQ ID NO: 39975 - RNA, 432 nt, synthetic construct
  misc_feature 1..432: note = derived and/or modified sequence opt5 from anti-HIV_cap256-119-161053_VR-Chain
  source 1..432: mol_type = other RNA
caggtgcacctggtcgagagcggcgggggagttgtgcaacccggcacctccctcagactgtcttgcgtggccagcgggttcacattttccaacttcgctatgcattgggtccggcaggcccctggaaagggccttgaatgggcggctatcatttctacgcgcgggaataacagaaattacgccgacagcgtgcggggacgctttaccgtttccagagatatctctaaaaacacactgtatctccagatgaatagcctgcggccggaggacaccgccatgtactattgtgctcgcgatcagagatactatgaatgcgaggaatgggcctccgactactatgatttcggccgggagcaaccctgtcaggaccctcgcggcgtggtcgggattcttgatctgtggggacagggcacaatggtgaccgttagctct

SEQ ID NO: 39976 - RNA, 432 nt, synthetic construct
  misc_feature 1..432: note = derived and/or modified sequence opt5 from anti-HIV_cap256-119-159499_VR-Chain
  source 1..432: mol_type = other RNA
caggtgcaactggtcgagagcggcgggggagttgtgcagcccggcagatccctccggctgtcttgcgccgctagcgggttcgccttttcccactacggaatcttctgggtgcgccaggcgcctggcaaggggcttgaatgggtcgcttctattagctttgacggaagagattattaccattccccgcacgtgtggggccggctgaccatctctcgcgacaacagcaaaaatacactctatctgcagatgaactcccttagagccgaggatacggccctgtactattgtgctcgggacctccgcgaaagcgagagagaagagtgggagtctgattactatgacttcggcaagaaagggccctgcgttaagcctcggggagtggccggctccctggatatgtgggggcaaggaaccatggtcattgtgagctct

SEQ ID NO: 39977 - RNA, 432 nt, synthetic construct
  misc_feature 1..432: note = derived and/or modified sequence opt5 from anti-HIV_cap256-119-159114_VR-Chain
  source 1..432: mol_type = other RNA
gaggtgcagctggtcgaaagcggcgggggactcgttcaacccggcgggtccctgagacttgcctgcgctgcctctggactgaccttccggaagcacggcatgcattgggtgcgccaggcgcctgggaaaggactcgagtgggtgagctacatctcctctgacggcgtcaacaattatctgattgatagcgtgagaggccggtttacagtttcccgcgacaactctaagaatacgctttacctgcagatggatgggctcagaggagaagacaccgctctgtattactgtgccaaagatctgcgggagctcgaatgcgaggagtgggccagcgactattacgatttcggccgcccgcagccctgtctggaccctagaggggtgtccggaatcagcaacgtctggggccaagggacaatggtgaccgtttcttcc

SEQ ID NO: 39978 - RNA, 432 nt, synthetic construct
  misc_feature 1..432: note = derived and/or modified sequence opt5 from anti-HIV_cap256-119-156751_VR-Chain
  source 1..432: mol_type = other RNA
gaggtgcagctgctcgaaagcggcgggggactggtccaacccggcgggtcccttagactgtcttgcgccgctagcggattcgccttttcctcttacggcatgcactgggttcggcaggcgcctgggaagggactcgagtgggtggctagcatctcctatgacggccgcgatttctaccatgccagatctgtgtggggccggtttaccattagccgcgacaactccaaaaatacactgcaccttcagatgaacagcctgagaccggaagatacggccctctatttctgtgctcgggacctgcgcgagtctgaatgcgaggagtgggaatcctactattacgattttgggaagaaaggaccctgtgtcaagcctagaggcgtggttggggtgctggacatctggggacagggcaccctcgtcacagtgagctct

SEQ ID NO: 39979 - RNA, 432 nt, synthetic construct
  misc_feature 1..432: note = derived and/or modified sequence opt5 from anti-HIV_cap256-119-155656_VR-Chain
  source 1..432: mol_type = other RNA
gaggtgcagctggtcgaaagcggcgggggactcgttcaacccggcgggtccctgagactttcttgcgccgctagcggaatcaccttctcctcttacggcatgcactgggtgcggcaggcccctgggaagggactggagtgggtggcgtttattcgctatgacggcagctccaaatactatgctgattctgtcaagggcagattcacaatcagccgggacaactccaaaaatacgctctacctgcagatggatgggcttcgcggagaagacaccgccctgtattactgtgccaaggatctcagagagctggaatgcgaggagtgggctagcgactattacgattttggccggccgcagccctgtctggaccctcgcggggtgtctggaatttccaacgtttggggccaagggacaatggtgaccgtcagctct

SEQ ID NO: 39980 - RNA, 432 nt, synthetic construct
  misc_feature 1..432: note = derived and/or modified sequence opt5 from anti-HIV_cap256-119-154420_VR-Chain
  source 1..432: mol_type = other RNA
caggtgcggctggtcgagagcggcgggggagttgtgcaacccggccggtccctccgcatctcttgcgccgctagccagttcatgttttccagatacgggatgcactgggtgcggcaggcccctggaaagggcctggaatgggtcgcgtctattagctatgacgggaccgataaataccatgctgaccttgtgtggggacgcttcacaatctccagagataactctaagaatacgctgtatctccagatgaacagcctgcgggccgaggacaccgccctttactattgtgctcgcgatctgagagaatccgagtgcgaagagtgggagagcgactactatgattttggcaaaaagggcccgtgtgttaaacccagaggggtggccggatctctcgacatgtggggccaagggacaatggtcattgtgtccagc

SEQ ID NO: 39981 - RNA, 432 nt, synthetic construct
  misc_feature 1..432: note = derived and/or modified sequence opt5 from anti-HIV_cap256-119-153954_VR-Chain
  source 1..432: mol_type = other RNA
gaggtgcaggtcctggaaagcggcgggggactcgttcaacccggcgggtccctgagactttcttgcgtggccagccagttcaccttttccggatgtggcctgcactgggtgcggcaggctcctgggaagggactcgagtgggtcgcctctatcagcttcgcgggcacgaaaaagcattacggcaattccgtgaaagggcgctttacaatttctagagacaatagcaagaacaccgtttatctggaaatgaactcccttcgggctgaggatacagccctgtactattgcgccaaagacctccgcgaatacgagtgtgaggaatggaccagcgattattacgacttcggaagaccgcagccctgcatcgattctcggggcgtggtcgggattctggacatctggggacaaggcacaatggtgaccgtttccagc

SEQ ID NO: 39982 - RNA, 432 nt, synthetic construct
  misc_feature 1..432: note = derived and/or modified sequence opt5 from anti-HIV_cap256-119-153864_VR-Chain
  source 1..432: mol_type = other RNA
caggtgcacctggtcgagagcggcgggggagttgtgcaacccggcgggtccctcagactgtcttgcgccgctagcggattcaccttttccggctgtgggcttcattgggtgcggcaggcccctggaaagggcctggaatgggtcgcgtctatcagcttcgctggcacgaaaaagcactacgggtcctctgtgcgcggaagatttagcatttcccgggacaacagcaaaaatacactctatctgcagatgaactctcttcgcaccgaggatacagccctgtacttctgcgccaaggacctcagagaatatgagtgtgaagagtggacctccgattactatgactttggccggccgcagccctgcatcgatagccgcggggttgtgggcattctggacatctggggacaagggacaatggtcaccgtgtcttcc

SEQ ID NO: 39983 - RNA, 432 nt, synthetic construct
  misc_feature 1..432: note = derived and/or modified sequence opt5 from anti-HIV_cap256-119-153793_VR-Chain
  source 1..432: mol_type = other RNA
gaggtgcagctggtcgaaagcggcgggggagttgtgcaacccggcgggtccctcagactgtcttgcgccaccagcggattcacatttggcacgttcgggatgcactgggtgcggcaggctcctggaaagggccttgactgggtcgcctacatccgctatgatggcaaaaccaagaactacggggagtccgtgaaaggaagatttacaatttctcgggacaatagcaagaacaccatgtccctgcagatgaactctctccgcccggaagatacagcgctgtattactgtgctaaagaccttagagaggatgaatgcgaggagcggtggagcgactattacgatttcggcaagcagctgccctgtcgcaagtccagaggggttgccggagtgtttgacaattggggccaagggaccatggtcacagtgagctct

SEQ ID NO: 39984 - RNA, 432 nt, synthetic construct
  misc_feature 1..432: note = derived and/or modified sequence opt5 from anti-HIV_cap256-119-153462_VR-Chain
  source 1..432: mol_type = other RNA
caggtgcaactggtcgagagcggcgggggagttgtgcagcccggcgggtccctcagactgtcttgcgccgctagcggattcaccttttccaactacggcatgcagtgggtgcggcaggcccctgggaagggacttgaatgggtcgcggctatctcttatgacggccgcaatgagtactatgccgaaagcgtgaaaggcagattcacaatttcccgggataactttaagtctacgctgttcctccaaatgaatagcctgcgcgccgaggacaccgctctttactattgtgccagagatctgcgggaatccgagtgcgaggaatgggagagcgactactatgctttttaccgcaaactcccgtgtgttaagcccagaggggtggccggaacactggatatctggggccaggggaccatggtcacagtgtcttcc

SEQ ID NO: 39985 - RNA, 438 nt, synthetic construct
  misc_feature 1..438: note = derived and/or modified sequence opt5 from anti-HIV_cap256-119-153124_VR-Chain
  source 1..438: mol_type = other RNA
caggtgcaactggtcgagagcggcgggggagttgtgcagcccggcagatccctcaccctgtcttgcatcgccagccagttcaattttgcttcctacgggatgcactgggtgcggcaggcccctggaaagggccttgaatgggtcgcgtctattagccatgacgggacgaaaaagtatcacgctgagtccgtgtggggacgcttcacaatctctaaagataatagcaagaacaccctgtttctccaaatgaactccctgagagttgaagacacagccctttacttctgtgtgaaagatcagcgggaggacgaatgcgaggagtggtggagcgattattacgactttggccgcgaactgccgtgtagaaagtctcggggcctcgggctggccggaattttcgatatgtggggccatgggaccatggtcacagtgtccagc

SEQ ID NO: 39986 - RNA, 438 nt, synthetic construct
  misc_feature 1..438: note = derived and/or modified sequence opt5 from anti-HIV_cap256-119-153025_VR-Chain
  source 1..438: mol_type = other RNA
cagatgcaactggtggagagcggcgggggagtcgttcagcccggcaagtccctcaccctgtcttgcgccgctagccagttcacattttccaattacgggatgcactgggtgagacaggcccctggaaaaggccttgaatgggtggcgtctatcagcaatgacgggaacaagaaatatcatggagattccgtctggggccggctgacgatttctcgcgacaatagcaagaacaccctcttcctgcaaatgaactcccttagaccggaggatacagctctgtacttttgtgtgaaagaccagcgggaagatgagtgcgaagagtggtggagcgactattacgatttcggccgcgagctcccctgtagaaagtttcgggggctgggactggccggcatcttcgacatttgggggcacggaaccatggttacagtgtcttcc

SEQ ID NO: 39987 - RNA, 432 nt, synthetic construct
  misc_feature 1..432: note = derived and/or modified sequence opt5 from anti-HIV_cap256-119-152713_VR-Chain
  source 1..432: mol_type = other RNA
gaggtgcagctggtcgaaagcggcgggggactcgttagacccggcgggtccctgcggctttcttgcgccaccagcggattcacattttcctctcactggatgagctgggtgcgccaagctcctggcaaggggctggagtgggtggccggaatctccttcgcgggcacgaaaacctactatggcgactctgtcaaggggagatttacagtgagcaccgatatttccaaaaacacactctacctgcaggttaatagccttcggccggaagacaccgctatgtattactgtgcccgcgatcagagatattacgagtgcgaagagtgggcctctgactattacgatttcggaaaggagcagccctgtctggaccctcggggcgtggtcgggatctttgatatttggggacaaggcacaatggtgaccgtttccagc

SEQ ID NO: 39988 - RNA, 438 nt, synthetic construct
  misc_feature 1..438: note = derived and/or modified sequence opt5 from anti-HIV_cap256-119-151794_VR-Chain
  source 1..438: mol_type = other RNA
cacgtgcagctggtcgagagcggcgggggagttgtgcaacccggcacctccctcagactgtcttgcgtggccagcgagttctcctttaagaactacgggatgcattgggtccggcaggctcctggaaaaggccttgaatgggtggcctctatcagcaatgacgggacaaagaaatatcacgcggaatccgtttgggatcgcttctctattagcaaggacaactccaaaaatacgctgtttctccagatgaacagcctgagagtggaggataccgctctttacttctgtgtcaaggaccagcgggaagatgagtgcgaggaatggtggtctgactattacgattttggacgcgagctgccgtgtagaaagtcccggggcctcggcctggccgggatcttcgacatgtggggacatggcacaatggtgaccgttagctct

SEQ ID NO: 39989 - RNA, 438 nt, synthetic construct
  misc_feature 1..438: note = derived and/or modified sequence opt5 from anti-HIV_cap256-119-150980_VR-Chain
  source 1..438: mol_type = other RNA
caggtgcaactggtcgagagcggcgggggagttgtgcagcccggcaagtccctcagactgtcttgcgccgctagcgggttcatcctttccaactacgccatgcactgggtgcggcaggcgcctggaaaaggcctggaatgggtcgcttctattagcaatgacgggtccaagaaatatcatggagattctgtgtgggcccgctttatcattagcagagacaactccaagaataccctcttcctgcagatgagctctcttcgggccgaggatacagctctgtacttttgtgttcgcgaccacagagaagatgagtgcgaagagtggtggtccgactattacgatttcggccgggagctcccgtgtcgcaaatttagaggcctggggctggccggaatcttcgacatttggggccatgggacgatggtgaccgtcagctct

SEQ ID NO: 39990 - RNA, 432 nt, synthetic construct
  misc_feature 1..432: note = derived and/or modified sequence opt5 from anti-HIV_cap256-119-148895_VR-Chain
  source 1..432: mol_type = other RNA
caggtgcaactggtcgagagcggcgggggagttgtgcagcccggccggtccctccggctgtcttgcgccgctagcgggttcacctttcgctcctacggaatgcactgggtgagacaggcccctggcaaggggcttgaatgggtcgcggtgatctctagcgacggagatattgagtattacacacagtccgttaaaggccggttcacgatctctcgcgacaacagcaagaataccctgtatctccaaatgaacgctctgagaccggaagatacagccatgtactattgtgcccgggaccagcgctactatgagtgcgaagagtgggcttccgattactacgactttggcagagagcagccctgtcaggatcctagaggggtggtcggagtgttcgacatgtggggccaagggaccatggttacagtgagctct

SEQ ID NO: 39991 - RNA, 438 nt, synthetic construct
  misc_feature 1..438: note = derived and/or modified sequence opt5 from anti-HIV_cap256-119-148848_VR-Chain
  source 1..438: mol_type = other RNA
cagatgcaactggtggagagcggcgggggagtcgttcagcccggcagatccctcaccctgtcttgcgccgctagccagttctcctttacatcttacgggatgcactgggtgcggcaggcccctggaaagggccttgaatgggtggcgagcatctccaacgacgggacgaaaaagtatcatggagagtctgtctgggatcgcttcagcatttccagagacaatagcaaaaacaccctgtttctccaaatgaactctctgcgggtggaagatacagctctttacttctgtgttaaggaccagcgcgaggatgaatgcgaggagtggtggtccgactattacgattttggcaaagaactgccgtgtagaaagtggaagacccggggcgtggccgggatcctcgacaattggggacagggcacaatgctgaccgtcagctct

SEQ ID NO: 39992 - RNA, 432 nt, synthetic construct
  misc_feature 1..432: note = derived and/or modified sequence opt5 from anti-HIV_cap256-119-148743_VR-Chain
  source 1..432: mol_type = other RNA
caggtgcaactggtcgagagcggcgggggagttgtgcagcccggcagatccctcaccctgtcttgcgccgctagccagttcaattttgccaattacgggatgcactgggtgcggcaggcgcctggaaagggccttgaatgggtcgcttccatctctaacgacgggacgaaaaagtatcatgccgagagcgtgtgggatcgcttctccatttctaaagacaatagcaagaacacactgtttctccaaatgaactccctgagagttgaagataccgccctttacttctgtgtgaaagaccagcgggaggatgaatgcgaggagtggtggagcgactattacgattttggaaagaagctgccgtgtcgcaaatctagaggcctcgctggcatcttccacgtctgggggcatggaacaatggtgaccgtttccagc

SEQ ID NO: 39993 - RNA, 432 nt, synthetic construct
  misc_feature 1..432: note = derived and/or modified sequence opt5 from anti-HIV_cap256-119-148595_VR-Chain
  source 1..432: mol_type = other RNA
gaggtgcagctggtcgaaagcggcgggggactcgttcaacccggcgggtccctgagactttcttgcgccgctagccggttcacctttgacaactacggaatgcactgggtgcgccaggcccctggcaaggggctggagtgggtggcgctcctgaattatgatggatccaaaaagtactatgtcgactctgtgaaaggcagattcatcatttttcgggataacagcaagaatacacttttcctgcagatgaactccctccgcccggaagacacggctctgtacttttgtgttaaagatcagagagaggacgcctgcgaagagtggtggtctgattattacgacttcggcaagaagctgccctgtcggaaaagccgcgggctcgccggaatctttcatgtgtggggccacgggaccatggtcacagtgtccagc

SEQ ID NO: 39994 - RNA, 432 nt, synthetic construct
  misc_feature 1..432: note = derived and/or modified sequence opt5 from anti-HIV_cap256-119-148490_VR-Chain
  source 1..432: mol_type = other RNA
caggtgcaactggtcgagagcggcgggggagttgtgcagcccggcagatccctccggctgtcttgcgtggccagcgggttcaccttttccgactacgctatgcactgggtccgccaggcccctggaaagggccttgaatgggtggcgacaatctctttcgatggggctgacaaatatcatgccgatgacgtttggggaagatttacgattagccgggataactccaagaataccctgtacctccagatgaactctctgcgcccggaggacacagccctttattactgtgctaaagatctgagagaagacgagtgcgaggaacggtggagcgattattacgacttcggcaagcaactcccctgtcgcaaatccagaggcgtggccggggtctttgataattggggacagggcaccatggtgacagttagctct

SEQ ID NO: 39995 - RNA, 438 nt, synthetic construct
  misc_feature 1..438: note = derived and/or modified sequence opt5 from anti-HIV_cap256-119-148470_VR-Chain
  source 1..438: mol_type = other RNA
caggtgcaactggtcgagagcggcgggggagttgtgcagcccggcagatccctccggctgtcttgcgtggccagcgggttcaccttttcctcttacggaatccactgggtccgccaggctcctggcaaggggcttgaatgggtggccgttattagcgacgatggatccaaaaagtatcatgaggaatctgtgtggggcagattcacaatcagcaaagacaactccaagaatacgctgtttctccagatgaacagcctgcggattgaggataccgcgctttacttctgtgtcaaagaccaacgcgaagatgagtgcgaggaatggtggtctgactattacgattttggcagagagctgccgtgtcggaagtcccgcgggctcggactggctggcatcttcgacatgtgggggcacggaacaatggtgaccgttagctct

SEQ ID NO: 39996 - RNA, 432 nt, synthetic construct
  misc_feature 1..432: note = derived and/or modified sequence opt5 from anti-HIV_cap256-119-148107_VR-Chain
  source 1..432: mol_type = other RNA
gaggtgcagctggtcgaaagcggcgggggactcgttcaacccggcgggtccctgcggctttcttgcgccgctagcggattcaccgtgtcctctaactacatgacatgggtgcggcaggcccctcgcaagggcctggagtgggtcgggagcatctcctatgacggatctgataaataccacacgaatagcctctggggcagatttattgtgtcccgggacaacagcaagaataccctgtatcttcagatgaacaatctgcgcccggaagatacagcgctctactattgtgttagagaccggcgcgagtctgaatgcgaggagagatggtccgattactatgacttcggcaaacagctgccctgtgtgaagcctagaggggtcgctggaatctttgatatttggggccaagggaccatggtgacagttagctct

SEQ ID NO: 39997 - RNA, 432 nt, synthetic construct
  misc_feature 1..432: note = derived and/or modified sequence opt5 from anti-HIV_cap256-119-147933_VR-Chain
  source 1..432: mol_type = other RNA
gagctgcagctcgtggaaagcggcgggggactggtccaacccggctggtcccttagactgtcttgcgaggccagcgggttccctttttccgctttctggatgacctgggttcggcaggccccgggaaagggcctcgggtgggtggcgtttatccgctacgacggatctaacaaatattacgctgatagcgtgaagggcagattcacaatttcccgggacaattctatgacgaccctgtatcttcagatgaacagcctgcgcgccgaagatgccgctgtctactattgtgccaaagacctcagagaggatgaatgcgaggagtggtggtccgactactatgattttggcaagcggctgccctgtcgcaaaagcagaggggtggctggagttttcgacaagtggggccaggggacaatggtgaccgtctcttcc

SEQ ID NO: 39998 - RNA, 432 nt, synthetic construct
  misc_feature 1..432: note = derived and/or modified sequence opt5 from anti-HIV_cap256-119-147434_VR-Chain
  source 1..432: mol_type = other RNA
caggtgcaactggtcgagagcggcgggggagttgtgcaggccggcagatccctccggctgtcttgcgctgccagccagttcacctttgggcgctacggaatgcactgggtgagacaggcgcccggcaaggggcttgaatgggtcggatccatctcttatgacggcagcgataaataccatacaaattccgtgtggggccggttcattgtttctcgcgacaatagcaagaacacgctgtatctccaaatgaactccctgagacctgaggataccgctatgtactattgtgcccgggaccagcgctactatgaatgcgaggaatgggccagcgattactacgactttgggagagagcagccgtgtcaggatccccggggagtggtcggcgtgttcgacatgtgggggcaaggaacaatggttaccgtgtcttcc

SEQ ID NO: 39999 - RNA, 435 nt, synthetic construct
  misc_feature 1..435: note = derived and/or modified sequence opt5 from anti-HIV_cap256-119-146106_VR-Chain
  source 1..435: mol_type = other RNA
caggtgcaactggtcgagagcggcgggggagttgtgcagcccggcagatccctccggctgtcttgcgccgctagcgggttcaccttttcctctagcggaatgcactgggtgcgccaggcccctggcaaggggcttcagtgggtcgcggtgatctcctacgacggaggcaacaaatattacgctgattctgttaagggcagattcacaattagccgggacaattccaaaaacaatctgtatctccaaatgaacagcctgcgcccggaagatacggccctttactattgtgccagagacctgcgggagatggaatgcgaggaatggaagctctacaattattacgattttcgcaccagagggccctgtgtggaccctcggggagtcgtgggctctttcgatgtttgggggcagggaacagtggtcaccgtgtccagc

SEQ ID NO: 40000 - RNA, 438 nt, synthetic construct
  misc_feature 1..438: note = derived and/or modified sequence opt5 from anti-HIV_cap256-119-145604_VR-Chain
  source 1..438: mol_type = other RNA
gacgtgcagctggccgagagcggcgggggactcgtccaacccggcgggtccctgagactttcttgcgttgctagcggattcaccttttcctctttcgaaatgcactgggtgcggcaggcccctggcaaggggctggagtgggtggcgagcatctccaatgatggaacaaaacgctaccatgctgaatctgtctgggacagatttagcatttccaaggataatagcaaaaacaccctcttcctgcagatgaactctcttcgggtggaggacacggccctgtatttttgtgttaaggatcagcgcgaagacgagtgcgaggaatggtggtccgattactatgacttcggcagagagctcccgtgtcggaaaagccgcggcctggggctggccggaatctttgatatgtggggccacgggacaatggtgaccgtctcttcc
